United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 3

SEQ ID NO: 208 - DNA, 133287 bp, Homo sapiens
tgttcaaattaatatatacagaaatactatgtaaaaccaaaaaaaatgtagtttagaattacagtaatcaaaaaaatatggtgttggctaaagaatagaccattctcatatatatcacgctatattctgtgtggttatcacacacaagtagttagtgtcagcctcctgctcaagtctccagtgattttctattgtctatagtagtgatgtccaacataactctctataatgatggaaatattttataatctatactgtccaatagggtagccactaggtacatgtggctaaggagcacttgaaacataactcatgaagccggtaccgaatttttcattttgcttaatcttaattttattaattaatttttttttgacagagtctcactctgttgcctagtctggagtgtagtggtgcagtcactactcactgtagtcttgtcctggactcaagccatcctcccatttcagactcatgagtagctgaaactataggcatgcaccaccatgcccagctaatttttgtattttttgcagagatagggtctcatcatgttgcccaggctgatctccaattcctgggctcaggcaatcctcctgccttagccttccaaagttctgagattacaggcatgagccaccattcccagtgtcttgattcgtttaaatgtacacggtcgcaggtgtttcatgacttccgtgctacacagccaaggtctataatgtcaaggctaaactctttatcaagtactcaagatcctatataattttagttgagacaaactgagctcaaggtctataggccctaagaataaaaactgaaagaccttagaatctgtttattttctatgggaaagggggcaggtggggtgaggggtgcagaagtaggttttgactcttgttccataaatatctgcatgtttgcaatgaaaagcttaaagaaaaaagctgtttgtggaagacacagaaacaaaatcccccatttttcataaaagtgttttaaaagatgtgggccaataccttcctactcaagagtattctcaggattgagaaaattgaggaagtacattcatatctaaggagatatttactatgctaggttctttgccatcttttcatttaaaccttacaatactcctgcaatatgtctcccttctttttgccaataaagaaactgttttcagaaaatgatcaaactgagtagaaaaatgggtagagctatggccaacaactaattttacaaagtacaaatgcctaataaacaaatgagaagtttcttaaccttactagtaatcagaaaaataaaaattaaaacaacacaataatttgccatctcattgggaaaatataaaagactgaaaaacaggcagtgtagcaagtattcattcaacaagcatttatttcattgcctgctacatgccaatataggaattagaatatgacaccccaaaatatgccactttgatataaggatgatttggagctgaaagcaattgaggagcaacattgatatggtttggctctgtgtccccacccaaatctcatctcgaattgtaatcctcaggtgttgagggagaggcctggtgggaggtgattggatcatgggggtgttttcccccatgctgttcttgtgatagtgagtgagttctcacaagatctaatggttttataattggaggtttcccctgctctcttttctgctgccttgtgaaaaaggtacttgaagtttcttgaggcctccccagccatgctaaactgtaagtcaattaaatctttcctttataaactacccagtctcagatattccttaatagcagtgtgaaaatggactaacatgagcacacacaggaagaactttccggcctcctcctttctgccttacagtggtgtataaattttcctttgtaaaggcaacacagattttcatttgtaaaggtgtttttctctccagtcccgagtgtaggataattattcttatctgcctaacaaaacttactaaacaagccttatctaccccagatttaccagtctctgttccatagtttactgcccctaggagccctcatttcttttgtctagtcacttctccataatatatcacactttgttaaaatggtatatatgcctacaagtctaacttctttgagttttcactttctttctgtgagaccctatgcacataaaaaaatttagcatcaataaagatacatacaccttttttcctgttaatctgtcttttgtcaatttaatatgcaagcctcaaccacacaacctcagccactactacaggtgctgatgaaataagactgatcaacattctgctttcatgataatttggaataaaacaaaaaaaccctaaatatccatctaaataaaaacgattaaatgatgatacatctacactatggaatattagaagacatgtacaactggaatatgataaaatatttatatattgatgcaggttggggaagccacaatactattagttgataaaaatcaagatgtgaaacagcaagtaaggtattatctgatttacgtaaaaataaaacaattttaaaagctattatacaacctacatcatcctggccagtttataccctcattttgaaaagatcctcacataggatcatattccaagaaacaactctcctgcagccaaagataaccgaaagcaatgtgcatcctaattgcacttcctcacaacattgccaaaaggggaagtacattcaactcttaaaaatgctctttttctttctctttcagtctcagttatctcagagcagctgttctccacaaaaaactttcatattcctctctccttattccctaaaaatttctcctacatccaataggattgaattcttgtcttttctgtttctcctctagccttcttaattatttttctccctagcatttctttttatttcaatatgaatttcctggcttcctgagatcactccttgtctttccccaactcattaccccaataagcatattaaagactcaggatttagtgactaattgtttaaggatgggggatcatgactgatgactggagagggggaaaatgtgtttgttatactgttaattgaaaaaagcagaataaaaatattatatacacacaatttgagtataactgtggaaagcatataacctaaaaccttttacgggataaaaaataaaacactaaaaggaaatgcactaaaatgttaacagagagtatttttaaaaattttttatgggcaattccccctctataattacttcttgatattttcttaaatatttactataagcatgtattttatttttatttattttttatttttatttttatttttatttttgagacagagtctcactctgttgcccaggctggagtagtgttgtgatcatagctcactgcagcctcaatctcccaggctcccaatcctcccacctcagccttctgagtagctgggaatacaggcacacactaccacacctggctaattttttttactttttattaataatttttggtagagacagggtctcgctatgttccccagataagcatgtattttataataaatagatttaaatattggtatatcttaaggaatttgataattgtgtatctctcagctggaatctatatttttcactcatttctagatccacagacatctgagtgtatttgcctgaaataacaaggagtcttcagtgagataactcaatataacaggtaacagaaggggaagtcaggaagactaggtttgtccaattacttttatgatatctaaagaaaaataaatctgaatataacataatatctttcacttgtcgtgtccactagctcccaactgcatgcttaggtcctgaaattggcagtgagacttagaggaaaacctaaatacactgtttacattaaaacatttgttagcccctgtagtggaagtagtaaagcagtaagagaaattgtgacccaaagcgacaagagaagcctttgcttctgtgtggaccacaacttggtttaagtgtcttaagggctgcagaaaatccaggtccattttgatgccttgcaagctacagaatgtcagagatagagctgtgtggaagaaggcagctagcaacattagccagatacttccacctagttcattaggtaagctatgtgtcaacagtagataccaaccaaaaggttcacagtaggagagacaaagtgatggagcacatctgagatagtcattgggaatggtcaggaatatttggggaatagaaggttcgttcaagacccttagaggatgttgttgcaattgcatgaaaggtaagcctaaaaacatgacttacatgacacacaggaaaactatttcttacttctcctctgaaggtgtcaactctattcttattgaacattcagcttctgcttaaaaatcattcggccagctcctcttctcctccttatccagctcatgtttttggttactgcagggatgttaactgggggggaaaaaggatgtagagtgtaaatatagtcttatagttaaccttttatggtgctcgtatttggggaatggacagggtaagaatcataccacttttggctagtcaatatttggtttactacattcaattgtttgagagataatctgatacatatttacatttacattttgtttggcagcagggttctacaaattaatatgcttaaaaattttttattgagccttttgactataaatgaaaaataaaattctaagcccccgaactaactgaatggacccctcttttcagccaaggacattccaaagttaactggaaacaccagttcaggccatgatggaaatgggtggttgggtatgcataccctctgccctttgaaattcccacacaactgaccagcattaatattaaagcacagacctttggactgacgagacagactttttgtagcaataagataccaacatgacagataccaggccctgaaaaaaaatgaagcagtttatccccaaatatatttctttgacatgttttgaaatggccctgcaaacattctcttgtggaaaaaatctacattctgtagagaatccccttccctttccaagtctttttcctgatccagaagagaattaactaagaatctggcatctttttaagtctgataagaaacatttaaagtctattctctctgaagcctgctacctggaggctccatcagtaaactaatacccttggtctccacaaccccttatcttaacccagatattcctttctgctgattccaggtctttagataaactcagaaaatctttgaatccacctatgacctggaactcccccctcctacccccctttcaagctgtcgggcctttccagactgaaccaatgtacattttacaagtatcgattgacgtcttctgtctccctaaaacatacgaaaccaaactgtagcccaaccatcctgggcacatgttctcaggacctcctgaggctgtatcccgggcatgtccttaaccttggcaaaagaaacttctaaattgattgagacttatctcagatactttttggtttacatgacatattgatatgacattttaaattatttttaatattctaattcttcatttatatagacaatgaagaattatgtcatttggatgattaagtttatactttgtaatgatcttatatgtaaagaatgcagaggacatagatacttggtctgattgtttatctaatgggcttggaattccatttacctgaattctattattttcaaaattattaatttcaaaatttctatgtcaggaactgcttagctgtttagagattgtaagtttatgagtgcaaatggcctcctgatttttacagaacaaaaatactagctcttctttggcaggcaaaacacgttcactgatatgatctccttatctcactttaaataacaaaaattggctttttctgaatgttttgtctatgcatcatctttaacattttaattgatttgaaatgatcttggccttgtaaagtatgcttactaaatggttgggtttttctttttctttttaaccagtgtaagcattttatagcacccagttctttgaaaagcagaacgcatgccatacctacaagttggcatacagccaagaaagtccttttgtgtgcgtgtatttgtggtgaatcattcatagcctgtaagatctatcaaaatagctttgtttgaaaacctagttttccccatattttttttctgatgactcacacttcactgctttcatgtctagattctcttttctttcttgtttctcatcatgttcattcagaagatgttctttcactagttccaaaatttgtatttctatattctgtcagttttcatcttgaaacatacacacagcaatatgctctgaatcataaaattctgcattaaatcccaacacttaaaaaaaacacatattctcaatataggtttacctgctcctgttgccatttttatttagtacaaatttattaacatttaaaaatcattggcacttatgaaacttgaaactttattttactgttaggaagattttggctgcaagaaatataaaaaccaatgctaagtggtttaaatcataagaacacttaacacttcatggatgaatatgaaaatatggtggttcaggattagttgaattagtagttcaataatggcctcaaagactcaggatcttcctatctttctcttttgccattcttttaaatcgattttattaaggcataatttatatataattcaattttaagtgtataactagaggaattttgacaaatgtataataatgtatctattaccacagtaaagaaatttaacatttgcaacgtttcagctccttgcagtcaatcccagctcttcgatttcgaataaattattatattatatatactcctttgtgtcttcttttacatagcattgtgtttttgatattcatccagcttgttgactgtattggtgctttgctcctttttattgctgagtgatagttcattgtatagtagatatagtataatttgcttattcattcaccagttgatggaaatttatttccagttttggctatcacatatgaagctgctctaaagattcccctacaagtctttgtgtggatacaggtttagatttatcttgggtaaatatgcgaatgctgggttgtatgttaattatatgtttgacactataagaacctgccaaactgttttccagagtggctgtaccatcaacagcaatataagagagttccaagttgttccaaatccttggtaacttattagtattttttgaaaagcaaaagtttttcattttgatgaagttaaattgtcaatttcttcttttaggtttccagcttttaaattttttatactttataagtgcacacatttaaagattatatagagtttctgctaggttttctctaaaaagtttgagatttagatcttgtatttagatttagctgtatgatcagtttcaagtaaatttttacatggggtgtgaattaagggttgaggtttctttctttcttcttttttttgtatatatggatgtctagctgttctaacatttgttgaatattctgccattcctggggctttagattagtactttttcccatctttgtggtcacacgatgactgcagccattttaaccatcacatcagagactatctcttccaagaatgtgtccagcaaacttcttttcacctcgttacctagactcagcacatgcttattttgtactgtctaaaccaatcatgggaattggaatggggccagcatggttcatttattcattgaagaaggaaatggttgcccatatcctttctaggggttggggatacagtagtgacgaaaacaggcaaaaatgttgcctgacctcatgaaacatacaatttactgaaaaagattgtcttttgtcaaaataaataataaactgtataatatattgctgtatagcagtaggtactgggaaaaatacagggaaagaggctacgaaatattgtgggtgagctgaaatttcagataggatgtttaggaaaggtctcactgaactgacttttaaataaagacctgaaggaagtgatggagcagtctatacggataccaggttggagagtggtccaggtggcagtaaatgcgaaaagttcttgagaacagcaggccactgtggttgaagagagtaataggacattggggagtgggagtgcataataggtagatcagtgttcttttcaacgactggcaattttggcaaaatttcgtcatgttgggggatattttggttgttaacttgtgtgggagggagtgctgaggagaccagggatactgctaaatatcctacaatgcacaggacagcctatctctcaatcctcctccttctcccaaacccccaacaaagaattatccaggctgactgtcaatagtgcccaggttgagaaatgctgtttaaagtcatagcgaagactggctaattgtgagtaaattggaataacactgaattgttttaagctcagtaattatttaagcgttaaggatcatgtggctgcttgctgtgaacagactaaagggataagagggtataaaacatttaggagggtaatacaattacctagagaaaaaatatggtttgggccagaatgcaggtaagggtgctaagtgatagatgctggatgtattttgaaggttgagccaacaggatttactaacactggatacatgcctgtagggagaggaaccacctacaagtaatctgctgtggttgctactggagttgtttcttctcaaaagggagccggggaagtggtggaaagctaaacaaatttggaaaggaggaaagagtacccaatatggatattaggattattatgcatctgttacataaatatctgtaattatgcatctgttatataaatatcttaagaaaataagaaaggacactgttggaccagtgaatgactaagggcacaattattctatggactgtttctttaaaaatacttttttgtttgtttttagaaacgtcttctcatgccatctttcattttggtgacagtctgaaagatgtagggagccccaattccttattctatcaaagtcattaaagggctctaattttcctttcagtatttgtatcccaaccaattattggtggttactatgtagaatgctgacgtattaataatctttgtctaagcatttgtttggtttagtctaaaatataagcttactatgagtcttttttttctttccttcgagactgagtttccctcttgctgcccaggctggggtgcagtggcgcgctctctgctcactgcaatctctgcttcctgggttcaagcgcttctcctacctcagcctgccgagtagctgggattacaggcgtccgccaccacgcctggctaattttttgtatttttagtagagatagggtttcaccatgttggccaggctggtctcaaactcctgacctcagatgatccacccgcctcggcctcccaacgtgctgggagtacaggcgtgagccaccgcacctggccactatgagtctttatgtattagaaaactgcttaataaagtcctcaccttattgtcataatcttataaccaataaccttataatctaacaacaagggttatttccatttcacagacaaaaaaacctgaagtttgttaattacggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccggtcagtctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaagtgggtggagtttctctttttgccggtgcagagagaacttgtggcgggaagttggggcgcggggttggccgtaggtccccggcgtgctaagggcggacggaccaggcggctgggccgcgctgcttctcgttaccttccgcagggtcaggggccgcggcggggttggaggtcagcccaggcacatgttaacccctgggtaccagtttgctcggaaactcgtgttgaggactcatcttagccctgggaaggtacccagaagccgaagggacacccctgacagggacgggccctgagaggctgtcgtttcccttggcagatgaactcgggactcgcccccaggatgtacatttcgtagagtctcccttaccgcctcaagccctgaggccgctgccttgccccaaagtgtatttatcttttttataattatttagaatttattccttaatcagtagtttacactttggagactttaagttttaaatcagtaaatctgtaataggcaccagcctatataatgtactggtcaagggaaacctccacaaaaacttttcctgctttatgatacaatcaatgctctaggcatagttcaccatccaaattcccagcccttgtgtgcctatcaggaggaaggtgaatattgttaaagatacacgcagcgactctacctgggacaatactgctaagtaaaaaagcagttaagtgaaggaggaaaaacccgttaaaggaaaaacagatactttcttttatggaagctaggaagattatattaagaaaactttacatttacgtatatacgtttttaattaactttcatgtcagaaactcttaatagttttaaatacttagaggatcatggttaccttcacatttaaattattttcaggcatgtatgctggcatatgtattttcccctaagaaattttctcttttaactcagaatttcccattgagaaatttgctaacctatgtacaattataattagttgattaaagttgcatggctgtgctgtggagattatgcttttgttgttggtggcacagttgtaatctctaaggcaggactgttttcactgtgataaactgagaaagagggtaagaagacaaaatgctgagaatattttggcagcccgagaactgatggcctagtattctgctaagttacatatccgtgaaaatccctggctcatttaacaaatgtttactgagtacctagtatcacggtggtgagatgtccattgccattgtctgtgtcttcccaatccaatcctgtgttcttttctagtgactgaagaccttctcacttttaacattttacattctcagtgacagcaatatttccatgtacatgaaatttattttctttcttcattggaaattgttaatttcgtgtttcttaaggtgtgtcctgcactgttaatatgtgctatagaaccccgaaatgaattttggatgaaatttggttagtttgcttctgtttttttaaaatatctatacctcttagatctcagtattgtaatgtatgtgaatttctaatttgaatataatgtgtgggcttttccaaactgaattaactttagaatcctaatttctgggaacctgggaaagttccctattgaagacattttgggaagtgtattttaagagttttgtttgtttgtttttctttttacccatttatctcaccccttctgccaacagaagtgatgccaccaaaaagaaatgaaaaatacaaacttcctattccatttccagaaggcaaggttctggatgatatggaaggcaatcagtgggtactgggcaagaagattggctctggaggatttggattgatatatttaggtaaagtaaaaccttaaattaacaattattcttatatctgtgactgtaaccgtgattacttagtggtattttaagaatggaaatatggaattcatatgtgtactttattaaaattcatgattgtactcgattaagtaataatagagtacagtgtctaggttcaagacatcactgacccactccttgttgtccatgtttttctgagtaaatcttagaagtctttttagagcataattatacaatctgccagacaaaatgctaactttctttttttttgagagcttgttttcttagaaacatgcttttttcagatgagaaaccacaactgtatagataaaaacactttctgtttgtgaatcttaatcaatatttaggcaatacaagagtctagtcatttcttaattgggctctactggagaattcatagataaaacttaaggcatctattctgtgaaatgaattaacttctctctcgtgcatctagagtggtccctagggatgtgccattcttgggataattgaaaaaataaacactcaaaattattttctgtgatctgtggtacaggtaaggaaccatgggctggataggcctttacattgcatttaagcatttaaaaattacactgaactttaatggatcattgagttggaatgaggaggggatatccattaaaagattgattaataaaataaggaaaatagtagtgatttttaaaaatataccctcaaggataaattctcctaaatgtactcacttgagacttgagatcacatctatttctataggagattaaggagttgataaaatacctccgttgagggaatcttgggttctcatcacatatttccagaaaaacatgcttcatggatcctgaaatataaaagatcctcttctgataaaattaagattgtagttttgaatgaatgaatgaatgaagtttggtcaataaatatctgcttattaaatacttaagtgtctattctagttggaaagacaagatcagcacaaaaaattgtatgagtcaagtaaaggacccatttaaagggtttgaacttgcttgaaattgcttgaaaaaatactatggttattaagtgctagattgaatgacatagtcaacactgttcaatagaaatgtaatacaagttacatatgtagtttaaaattttctaggagccacattaaaatacgttaaaagaaacaggtgaaattattttaataatatttaatctagtatatcaaaaatattatttcaatatgctctcaacataaacaaatgaaatattttacttttttaaatgaaagtcttcaaaatccaaggtgtatctagtctcaagagcccagttagcccatgtggctcatatgctcagtaactacatgtggctgctgtatagaatagtgcaaataaagactatgtgaggataagtattgtttgaaacttgaacttagtgaattctcttttacagcaaagagttaagatctctagtatactgtcttgactcaaggttgagatatagtgttgaataaattatttctgatgtggctgagctatagccttgaattccatagcttatcacttttggttttctaatatttgtattatttgagtaatttcaaagaactagagaaaagtattgatgtgttgattttatctctttgattttcttgaaatgtaaatattatatgtatttaaattcaagtgaatgtttaagattaaatagtgtatgtctgtatacctgtatgtatctatgtgtacacatagtcactattgttactgttatgataaaggaatatacttgcataggcatgtgacttacttgtccctattcaaatgcagaaaaatatttgcttctttcagtctagtacagtgtcacatatttttactttttttttttttgagacagagtctcgctctgtcacccaggctggagtgcagtggctcaatctcggcccactgcaacctccacctcctaggttcaagcaattctcatgcctcaacctcccaagcatctgggactacaggcacctgccaccctgcctggctaatttttgtatttttagtagaaacggggttttgccatattggccaggatggtctcgaactcctgacctcaggtgatctgcccacctcggcctcccgaagtgttgggattacagacgtgagccactgtgcccagcctacttatttttttttattaccaaaataatactgtttgttttacaatatattttcagggttcaatatgtaagggaacattctctagtatctgaactttagaacctggaccctacctaggaagattagcaagtacacaccactgaggaaggactttaaagaaatatttagctattttcagaaaaaaggctccagtacttcagaatttataataaagatgtgtgttccaaatgttgtaactgttccattaaaagtgatgctaatgaatcatagaatcagtttaatttcactaaacttagtttttactattttcaaagctatacaaacaaatcaatatgaaattacatcatgtttttgcattttatcatggttctcatcacttcctctatataaatgaagagaagaagcagtaaaattcaaattttcctgaatacttttgtgtccagtgacattcatttcgattctttccagataccctctttcagcagacacttgatcagcgtttactgcctaaggctgagaagaaactagctgctctgtctagctcattgtacatgtacaactgtcctctagctttgagatcagtagccagggcctttcggtaatcagcagcttacagttaaggggaaggggcagagaagtttggtatttactcttgacttggagaaataatgtgcctctagcattaataagaaatagctaaaagagtgaaaagaaaagtctgaatacaagaacaaagtcaaagttctttctttgaatatgaaaagagaaggggaggaaaaaggaagaaaggaaactggtttaggggatgggaaaaattgctgtcattttagtatcaaatgaatgaaaaagttttttaaatatcaggaaggagagaaaactgagggttagaattttactataatgctgggtataacacagaaccaagtaaattacgggagaattgcataaataatagcagaggttttggcattaggcatatctgacctgaatcctgacctgatgaagccacttattcatctagttacttaatcctttgggttgtttctattctgcataattgtgataataataattgtgaggagaattaaatgagatttttttaaggaacttggtaagcatttaataaatgtaatttagttatttatttccatagactttcccattcttaatactggtgccatagtggggccaggcacagtggctcatgccagtaatcctagcactttggaaggcccaggcgggtggattgcctgagctccatccagcctgggcaacttggtgaaaccccatctctactaaaacacaaaaaattagctggttgtggtaatgtgtgtgtgtagtcccagtactcaggaggctgtggcatgagaattgcttgaacctgggaggaggaggttgcagtgagccaagattgcaccactgcattctagcttaggtgacggagtgagactgtctcaaaaaaaaaaaaaaaaaaatgctgccatagtggattaagatgatgacaaagaactccattggaagggtggattttctatttattctactatgaattttggtggatttaactactaatgtggtaaaactgagaacatagagaatgtcagcataagactttatgacattttactaactgataaaagctccccctaaaatttgctatagtagtgaaaagttctcatataagctgtatttaatctgcctcagatattaaagctattggtttcagaaattattcaaaattgagaataacagaattacaggataaactttagccacattcttttgaaggctgattatgtaagtaaaagatatgatttatctgtagcagttttagttttttgaaggtggcatagtgatgaccatttagcatctttggagtgtcaagcacagaatagatgttcaacagttatttgcctgagaaattgagactgagattggagtacttaacccacacaagctagtttgctttgttctcttccataattatagatgtcactcttcgatctactgcagattagtatccttagtcaccaggaaagttgagacaaggcacctatcatgacatcatctaaaagaatgtgcatgtgctttattgacaggacatcagtagcaatatcttttataaagatactatctcaaagcttttataaagaataacacattattataactaaagttaactgtggtgaagcctgaaaatcagatcatttatccatggacagatgtttaaatttcatcaaagtgactgccagacatttttggatcatgttgtcggattagcctaattttgtacttcagaaacatagaaggaatcttttgttggcggataggtttttagaaattaccaaagtttaaatcatttattttactgataaggaaacatttatatttaaaacaagtaaatataaaccacatacatagaatgtttttacttcttcataaaataattttttattttctttataaatagtgagctataatagattgattttaaggtatgcagaataaagtttagaagagcccagtgataatactagcaacaaagtagtgtgttggaatacatattgcttcattacatattacattattaagtgttattttggtagtgtttatagagagctttgagataaatagccttatctgacacaatgcaacgttgtggtgccactgcaattgttattaggcaattttgcaaatgatactgtgggagtgaagagaagaattgaataaatgtgaaaatgagaataatttggactagaaactatagtgtttatgataaattagtctccagaaggtataaataataggtaatataaactcaaaacagggaaggaatcacttggagttttgtaaatttaatacgtttgttggacttacagacaagaaataaaagtctctataagatgtattttaattttgtttatatttaaattttgagtttttaaagagatagcagtacccagttatctatcagttaagaaatctgggtgtttaagaaagtttgggttccttccattaaaagggagatttataagacttggcttttgcttggctttttcatttttttaaatatccatttttaagcatattttatattatggttcttctttattttcaacattttactgtcaaattcttttgccttaagggaagatttataaaatactctattcttcagtgcatttatatattatgtctcttccactggacctgttactatcttgtaactgtttacagtggtcaaggttttttttttttaatttgaaacatattgctgtggggaaatttcttcttcctgaaatgagctcacctctattgccacacaataaaagaattctcagcttttgagagctctggcttccttatgaaatatggatagacttctgcttctgaagtgttttaggtttttttctttagataaggaagaagaggaataaatagtatgaggtgtgtttcttcttttaagacacaggaatatctatatcagataaatgagaagaaaattaagaaactttaaagctctaaatgagagagctcattagaaattagctacttggatgatgaaaatttcttcatcatctacacttaaaggcatttatggtttttatactacttagatacttgattttgcaattagtatttctttagaatgtttgtccctgatagctccatcacatggactgttattcctgaacactctgttgtattctccatgaaaaaatattttaggagaaaagatagaaaactcagcaattatttcaagataattgttgaggacttcccttgtttcttttaaaagcatagccttttgttagccaggtagatttatcttttctttaacatcttcgatcaagtaatacttgagggaaatattctgtagaaagacatccattgaaggccagaaacatctacagatgcaatgtgatcccaagcaatgaagcatgtggcccttcattggcattatatgataacaggaggatcttctggcagaagaagtgacttttgctgcgttctgcatgctgcccctccaaacccatctttgattggcacctatgccctattgaaactggcatcacaccttctgaatgggcacagtgccaggctagcagatgggtatgggcaaaagcatgccagaaacccagtatgtgaatcaagtttaagtatcaggggcccaaattcccatccagggatataaaaactacagtctgttgagagctttttgtgcttaaggttaaaggacatgccatttctactccaacttagaagttgattaattttgaaagtcaaacagcagctcctgtggctgtgtcaggcaaaatcctgtctttggtgaatgagaattactacttcgtgtagggaagagaaagtattgtaatgaagtttccaatgagagttactctcctgcaagtgcctccagcacttaagcagcatgcattcagtggagatgaatatttctgttctccagcagagccaggtgcaatcaaagccagatcttcaacctgctgcagtaaagaaccctaaatttagaaagggcaggcaaagtttagaagaactccttggtggcaggcagctcttttcactatgagctgatgaagcttcacaaaattgtataaaggagatgaagggaaaactccaaataaaagaccttcagaaaatttcatccagaaacagaaagatttttaacaaaccaaaggaaaaagtttagtcctttctcctcaatgcagaaaatcttctgagttttctatcaataaaaacttagttaaccaaaatgttagaaccaacttaatgcataagtgacaaaactttctatttttacatttatttcattgcatgtctatcatgtatataaactttgcttcttgaataatggattttgcataaaattgagaactctaaacatcatatttccttctgattgtctcacacccactacagaactcccctcccccaccccctaaaagagggcacgcttccttctgatcactttaatcatatcttctaaatgctctaaaatttacaggaatgcctgtaagaccagctgtggccaagagaagcttttcctaatcgccttatagccgttgcttttgctttttcactgtgtaaactttatctatggaacagattccatgagaccgttgtgaatacttcaacgtattcaaaacatataactgccacaaattaaactactaaaactaaagctggtgcattgtaactgccaagtaaaactggcacgtccctctgtcagactgcaggagagtgtgccatacagtcctcggaaaacacaattcatccagaagcactcttgtcacttgctctgatattaaaccagagaaagtgacattaattaaagaagtgacatgagccaacaaaggcaatgaattctcagctttggctcatgtgcagaccttaatccaacctgttctgcttaggtagtgtggctatttctgaagagtaactagtgtggctactcaccccacttcctctcatcttcccattctgcatcacgtgtttgaggaactaacattttatatccagggttggactggttaattggtacactggtagtcattgcagggcttcccaaaatagtagtgtggtggcatgtgatgcttttattgtacttggtaatagtgtgagatgtacaactagaggtagaggagagttggtctaacgaaaaggcaagcaacagccaaacagcagaatacctagacttggtagactggaagcgaggagggtctgctgctaggactggttgtggaaacaaatggtggcttggtaggctttatgaaaattctgaaatgctaaagaggcatgctggggagtgttcataacttctctctttctttgttccgatggtgtgctttcacacaatgctcacctcattatttcagacggtcactattttgtatgctgtctttttaacctgtttcccccaacatgtgtgcacacagacactacattataaactgctttcaggcagtcactcacagtgcttaatatggccttgcatgttatagttcttaaaaaatgatgtgttaaattaactctagaactgttctattatgattttcccaataaataggttgtatgagacaaaaaaattccatgctctatcctatatgtgacctgcgtgtaaggcactgtactttcagatttagataaattcttttgtatcttttggggagtttgaagggataaaagtatgtgtttattctcttttcaagtatatttttaaaatacaagaagctgtgtacttaatccatagattgtagaatttattgtgaagagtctactctgttaaagcatagtatggagaggggactaaaaaatggacattgtgttaagacaaatcagttttctctttctaataaaacagttcttctgagtagtatttaattgaagtagacctaatagcaagtataaacgtttgtggggaaaagcatggtgtttactataaaatggattgacttatgtatgtatgcatgtaacatgcataagaaatcaacttttcaaagaatgtaagcacaacgttaacagaaaataaattattgggatttcttttaatccaagtctgtgaaaggtttgattaagggttttgtacatagtcagaagcttttgttatggtttctgggcaggggtattttatgtttgaggtcgggaattttctatccacataattagtcatgaggtttaatgtacattttttttttgtatcaggcagacaatgtcttcaaagagacagcagtgctgcaaaggagcaagaaaagaaggccaaagttgacacacagagaggcaaaacagtgtaggaaaaatcaacacgttttgcaaaatcaatcattgaaaatgtgtcagcattcaggagactgtctttaatttgcaatccaagtgaaatagagtatttaaatatgagaggcagtattattgagcccagcatgcctgctaccacttgtttgactagctcagaatagaacactgagaggcaagggctcaaagttaaatgaacatttatacattttaaaatcaaatgaaagattcagagtatattcatgaattaattttttttcaaaaccctaaatttaatcagctggaattactttaaaagtgtcattctatttaacttttgggaatgatgaatttgccttttaatagggatgctgtattttatcatgaagatgaaacaaactgtcttttgttaattattccccagagacactggccatttttctctctccaatgcttagtgtggagtaaaggcagcttcccgcaaatttatttcaagcaagagcaatcggaagcttcgacatgtgtgaaagaggcgcatagagaacatagcttccatttcaggtattctgagtgccacctaatgaacctcttagacataatgttaccaaagtctcactgatgaggccatgaacatagaacacagaaaagtaaaaaagaatgaaagaagagtctggtaaagagtagtagatgtgtcagatgtgtctgtagtatctgataaatgctgggactagtttttgaattctttttttttaggaaattatcatatttattataaagtactaaaatccttcacttagtgtgtgccaagctctgtgttaagtgcattgcatgaattatttcattgaatcctctcagcagcttaactaaggaagacattgaggcctaaagaggatacgtaaattacctcctggccacaatttaaaaaatgtctcttctatatttggactctggtccctgccctactgatgtcccttgtccaagaacacttgaatttattgttagccagataaaatagtgacaagtggcatgcttataacaagctcatttctaaagtaacagcaaaatatgtaactgatagtattggcagctaatttaagaaatctgttagtgatgatgctaataatggtgtcattttcattcagattgacaaggcatagagcatcagtgatatgtttttgatattattaagatctcaaaatctgtgaaagaacatctgatatttatagtaaacctaatgttaggcactggaacaattacattaaaaatgtaccatacctcaaacaatatttttatggaaaaaattgcgaatagtcatccaatagttcatgcaatctgatgagaaagatttgttggattttcatgcctttgcaaaactgaatacatttgtctagttttatacattttatacatttgttttgagtcaaataagcaacaggaagatctaaatagacctgtttaaatctctgtgatatgattttaataagcaccatataaaaatagatacctttataaatattgaatgattcttgactatattttttcattggataataatttaaagatacactgcttagaaaagtaggccttttaaagagtaaaacaaacagaaaatacttaagataaataggatcgtgttaacatatccctttatggaatttgtttcagataccactatattttagttataataaaagtctaggttttggaaaattatttttaaataactaaaattagttatttcaagatattatacagtagtaatgattattatatactcaagggtgatttcatgaaaaagttagaacatttcatgtagtggtaaacctttgggtgtttataatagacaacagatagttattagctattacaatgcaagattttatactagaatacttttttatttggtgtatatatatttagcaaggaaaagaatgaacaaacacaagttactacattaaatacatgttcttgagcagttacagggatatgggattattaatgtcaaattctggagaatgtaaagaaaagctattcattatacttgatcttgtttctattaaaaaatcatgtattacagttctatcttacatctccaatgtcaaatgtattataattgagaatggagaattagttatgtaaaccttttatcttacacagtgtaaggaggatagtagaagaaaaagtagtaaaaccaacaacaacaacaaaaaaatcccacacaagacacttcaagaaaagtgagaagaaaacaaaacaaacctgtatagctaacaggtaaatgttgctgtgtgatgaaaagaggaagaaaaaattgcctagtcttccagaataatcagaatgtctactctagcagaaagcttttgagcaagataaatcttctgaaattaactagtttaatgtagattgactataataaagaactgctgtaaaaaataagtatttttttggggaggggagcacttttaagttccttctgactgtgaaaacctgttaaatcctgaaagagggagttaaatttataaatgatctgttgatattggcacatggatagaggccttaaggcaataatggatgcagctggtaaagaagcagatctcagtcacagaaaaatgagataaagagaccatcaagaagaaaaaataatggttctattatctgtttatgtagtatatctttggatagttaagaatatcacatgaaaatgtaaagacatgcaaaataaagaccataatgaaaaacgtgagaaagatttcccttatttacagcctaatttcagcataaagattagaaagtgcttcaaaagagcagggctaaagattcttacatactaggtttttaaacctaaattacagaatttacagtattatttaaggaagggaggtcaactacttcagctctcacttcatacactttgaaaataggatttatgatggctaagaaaaataatagctctcattctattgtatggccaaattgaatgtctcttaggaggtagaaggaaacatttgaggtcttagtaaacctgaaatcatttcttaatagattatcgctaaaataggcttgaaaggagtgtatgattgaaaatgacttacaagagataaatgagttaaaatattaagaaaagatttgatgatataaagcaaaaccagtttagtaaaacttgggggattttttttaagaactgtaagttatgaatgtagagtttcataacaaaattcaaatttctaaattaaattgatgaactgtggttcagaattatagggttaacagttaagttacatatcaaccctttagggaagctcaaaatgtatttagttaataataataaaaacagctaagttagagtttattagtgttaatgtttgagaaatagataaatgggttggaagatataatttgtggtaaaatgaaataagtatgtaatatataccacaaccagtaagtaactggccaaagacagcaaagaaaaataacaattatatacattagtgtattataataaaattgtcagttaactacattggaaaaaaagtctgtaagcctcaattaaagaagatcagtgacagaacttcataatcggttgccaaaaaagcaatacttaaaatgataagatataaagacactaaaaggttaaggtttttcatgcacatgtaagtaaacagtaaagcaatagcaggatctgttgttattttatattccacagtaaaaatcattaagagagctaaacaaggatgtatatagggtaaaaggttagtagaacaaagtgaaaatgtaatgatagaatataatataatgagaatgctattgtttatttttatccttgaagagaaagcagaccttcaataagaaattgtaaatatgactggagatattataaataaattcagaaaatgacaaaccagttaccactaagtcttcacactggtctgtatggaacccaggtgtagaggtgaaaggggtaagggttctggtctcctgtcccatgtttcaaccttagcatttctgctttatctgttgcatattcaggcttaccttgtcttattgcacatcactttattgtgctttgcagatactgtgtttttttacacactgaaggttgtggcaaccctgcatcaaccaaatctattagtgctatttttccagcagcgtgggcttcatgcatgtctctatgtcacattttggtcattttgacaatatttcaaacttttttgttattatatctgttacggtgatctgtgatcagtgatctttcttgtgactatcataattgctttgaggaatcatgaactgcacccatacaagacggtgaatttaattggtaaatgtagcacatggcctgactgcaccactcaccagccatgctcccatcattctccctttcctcagacctctctattctctgtgatacagcaattttgaaattaggccaattaataaccctaacgtggcctttaagtattcaagtgaaagaaagagttatgcatctctcactttaaatcaaaagctagaaataattaagcttagtgaggaaggcatgtcgaaagctcagataggttaaaggctaggcctcttaaacaccagttagcccaattgtgaatgcaaaggaaaagttcttaaaagaaattaaaagtgctaaagtgaagcagccttactgctgataaggagaaagtttcagtggtctggatagaagatcaaaccagccacaacattcccttaagccaaagcctaatccagagcaagctcctaactctcttccattctgggaaagctgagagaggtgaggaagctgcagaagaaacgtttgaagctagcaaaggttggttcatgaggttttaaggaaagaagtcatctccaaaacataaaaatggaaggtgaagtggcaagtgctgatgtagaagctgcagcaagttatccagaagttctagctgagatcaatgatgaaggtggttacactaaataacaaattttcagtgtaaatgaaacagccttctattggaagaagatactgtgtaggacattcattgctagagagaagtcaatgcctgggttcaaagcttctaaggacaggatgcctctcttcttatgggctagtgcagatgatgactttaagtcgaagccagtgcttaccattcagaaaatcctaaggcccttaagaattatgtttactatctattctgcttgtaccctgtaaatggaacaacaaagcctggatgacagcccatctttttacagcatggtttactgatttttttttttagttttatttttcttattttaaaaattgtgtatatttaaggcatatgtcacagttttgttttttttttttttttaacatatgagtgagaacaactgtccctcacctattttgggagaagagggtagatgaagaagaagtgggttaaagggtacaaacatacagcgagctaaaaggaatgaattcagtgtttgatagcagtgtaggatgtctatacttaacaaaaatgtattgtacttgggtaatgggcaccctgaataccctgacttggtcactatggttgtatgcatgtaacagattttctcatgtaccccatacatttgcatgaataatagagtttactgaatattttaagcctgctgttgaaacctacttctcagaaacaaaaaaattgctttcaaaacattactgcttgttgacaatgcactttagttacccaagagctctgatggagatgtacaaggagattaatgttgttttcatgcctgctaacatagtgtcccttctgtagctcatggatcaaaggagtgactttaactttcaagttcttactatttaagaaatacatttcgtaaggcttcagctgccatagataatgattcctcagatggatctgggcaaaatgaatggaaagtcttctggaaatgattcaccatccagatgccattaacagcattcatgattcagggaaggagataaaaatagcagtgttaacaagagtttggaagaagttgtttccaacccttgtgggtgactttgcggggttcaagccttcagtgaagaagcaactatagatgtgacagaaattgcaagagaactggagttagagctgaaaactgaagatgtgactgaactgctcaatctcatgataacatttaattcatgaggagttgcttcttaagaatgaacaaagagagtggtttcctgagatagaatctatcctggtaaagatgccataaacattgttgaaatgacagcagagttttagagtattacataaatttagctgataaagcagtagcatggtttgagaggattgtcttcaattttgaaaggtctgttgtagataaaatgctaacaaacaacattgtgggctacagagaaatcttttgtgagagcgagagtcaattgatgtggcaaacttcattgctatctttagaaattgccacagtcaccgcagtcttcagcacccactaccctgatcagtcagcagctatccacatcaagaccctccacaagcaaaaagataacttgctaaaagttcagatgattgctaaaatttttttagcaataaaatatttttaaattaaggcatgtacgttgttttttaaaagatactgctgttgtacccttaataaactacagtatagtgtaaatataacttttatatgtactgggcaaccaaaaaattcacactacttgcttcatggcaatattcattttattgcattgttgtggaaccgaacctgcagtatctccaaaatatcaggattccaagaaacattccattactaaaagagtttgaagataactgattgtgctataataataagttataaagtgaaatatgtaataggaaaagttttaatttggagggtttttaacagtgttacagataatacacttttttttcaagtatacaagaatttattttaaaaatatgtgtgattaagaaaacataaacatttttaacatgtcatagttttggaatctaatccaggaaacaaataccagtatcactttgcttgttctgtttttctctttatcacttaccttctttctcatttctgcatattcagtttgtgctcatttcaagtccaccttcccttgaagcctactgcttttctttgtgcattttctaccacagttttacattgtgtatttattttctgcaatatttttgcttctattttataactaagcatattctattttgtattatgattatgtacttgtatcttttttcttatttataaaaataaagagaaaaaaatctttgtacatttctgtgaattttaacacacccaccaacataattaggatacaggacagattcatcaccctaaaatcttcctcatactatccctttgtgaccataacctccttttacccctaatctctggcagccattgatctattctgcatcactatagatgtggcttttggggaatgtatgggattactataaatggaatcatgtaatatgtgtcatttgtgattttttttccacttagtgtaatgcctttgagattgacccaagttgttgtgtgtgtcagcagttttttattgtcaagtagtagtctgttgtatgaatgtatcacagtttgtgtattctaccattgaaggacatttgggtagtgtgattccttcaactttttcttcaaaattgttttagctattttaattcctttgcttttccatatacataattaatttatatttccagaacaacgacaacaaaaattgctgggattttaattgatattgagctaaatctattgataaatttggggaaaattaacatttctactatgtaaagtcatccaaaccataagtacagcatgtgtcctcatttctttaggtcttccctgatttcttatatcagctttttgtagttattagcatactagtcctatacatgtattgttgggtatatattgatatatacattttttggagctattgaaaatgttcttggtttttaaattttagtttccatttgtacattagtagtatattagtagtatgttgtgtgttgtgtgttgtgtgttgaccttacatgctatgaatttggtaaacccagttattctaggattgggttttcttttgtggcagattctttgggaatttccacgtacacaatcacatcatctggagatagggacaccttcctttccaaatgtgtgcttttcatttatattcttaacttcctgcgctggctaggacttacagtgatttattgaatagaaatagcgagagtgctcatttttgacttgttctcatttttagggagaatgtattcagcttctcactattcagtgtgatgttaactgtaggttttcatacctgctctttatcaagttaagcatactgagttttgatcataaaagggtgttgaattttgtcaattgccttttctacttcaattgatatgatcaggtggttcttctttagattattaatatggtagatgacattgatttttgaatattgaaacattcttgcattcctcaaattaatttgattatggtgtattatttttatgtatttctggattccatttgcttatattttgagaatctttccatctttgttaaggaggactattagtgtatacttttatttatttatttatttcccctaccatctttgtctaattttgtatcagggtaatcctggcctcataaaatgagttctgaagtattctttcttttgttttctggaagtgagtgtgtagaattaagtgttactcatttttaaaatgttttgtatagttatacagtgaagctaactgggtttagaaatatctttttcagaaaggcattcttttaaaaaaaatggtttcactttctttagtggttatttaggactaatctggttatttgttttaggtaacttagtagttcatggtttttaaggaattgctccatttgtcatcagttgtgatggttaatattgtcaacttgattggattgaaggatgtgaagtattatccctggatatgtctgtgagggtgttgccaaagcagattaacatttgagtcagtggattgggagaggtagacccaccctcaacctgagtgggcagcatctaatcagcttccagtgagactagaacaaagcatgcagaagaaggtggaaagagcagacttgctgagtgttccaaccctcatctttctctcctgctggatgcttcctgctcttgaagattgactgacataaagactgcaggttcttcagcttttggactcctggactcacaccagtggtttttcaggggctctcgggccttcagccacagattgaaggctgcactgttggcttccctgcatttgaggttttgggactcagactggctttgttgcttctaagcttgcagacggcctgttgtgagacttcaccttgtgatcatgtgaatccttaatacactccttaataaactccccttcatatatacatctatatacatctattaattctgtccctctagagaaccctgactaatacagttgtcaaatttatgggtatagaattgttaatatttattatatttaaatgtaattaggttttatagtgatagtctctcatttttgatgttgctctttcaaatcatgttttcttttttgtcttgatacaagtttatagattttattgatcatttcagagaaatagctcttggtttcatttactctattccatttcattgacttctggttattttctttataatttttttccattaagtcctgcttaggctatatctcacagatttttaaatattgtggttgtcttgtgtattatatctccattcattgaaaatcccttcagttcatgttacatgttttgctccgtctgttaaatatattttgaagaactgaagaagagacacacaatctattacattttcccagttattgatcatgttttctcttcctttattcctaatattccaaatttccttgtgtaacttttctttttcctcaatatctttttttcttttcttttcttttcttttctttcttttttgtttttgttttgtttttttttgaaacagagtatcgctttgtcacccagcctggagtgcagtggcacaatcttggctcactgcagcctgcacctcctgggttcaagcaattcccctgcctcagcctctcaagtagctggcactacaggtgtatgctacgacgcccagctaatttttctatttttagtagagatgaggtttcaccatgttgcccaggctggtctcaaactcctaacctcaagtgatctgtccaccttggcctcccaaagtgctgggattacaggcttttgtacttcaatatctttctttagaaattcttaacacagcaagtctgctgaccattaattctctttagttttcttcacctgagaatgtcttcatttagtttcttttccaaaaggtatttttgctggatgttggattgataatttttttcccatcttcatcatttctgatgataaatttgcagtcatttgagccattgttcccctatacataatgcattgttcactctggctgctttcaagatttttctttgtttttagatttcagatttgactataatgtgtctgggcattgatttctttgggtttatcctattgggggttctttgacattattgagtctgtaggcttatgtgtatataaaacttggaacatttcagtccttatttcatcaaatgttttttcagtatcacaagcttccttctcttctgggattctacatgttcaatgttttgttactgcctataagtttctaaggtggtgttcaattttttcatagtttatctctctgttgtttaggttggatcattttcctttgatctatcatcaagttcagtgactttttcttatgtcatctccctaattgtattgcaccccctcaggaaaaaaaaaaaaaaaaaacaaaaactcggttatgtatcttttagtttcaaaaacatcatttgattcttttttgtattttctgtctttgttgcatttttctgtttttccctttgtttcaaaagtgtttgtctttatttattgaaacatttttataatggttgctttaaagtctgtcagataatttcaacatccctgtcattttgtcattattatctattcattgtcttttcatatatgagtttttttctgcttctttgtatgcctagtaactctgaattatttcatggatatgttgaatattatgttgtaagaatttgggtctcttatttctaacagagaatactgatattttgttttagcagatagtcttcctggttgcattcaggcttcaagttttaacaggtctgtgtttggggtacagtgttcgtttagttttcaatagcaaaagtattgttcaggtcatgtgtgttccattcagtgaccagcctgggacttgggtattggtagtttacttatcgaagtctgtatatgctgtttaatgttagctccacgtatacacagcttgtgagtgagtccaggagtttataaacaacttgttgtggtgacgttcccaagctctctccctccatggtctccttggtacttattctctgggatctcctttttaggttctctgaccagaaatctgggcttttatttaccgtgccttgccatgcacctgtgtctgcggaaaatggcaagagggtgtagagtataaaaagttattagataccactctcttttgggaccacaactcatttgattggagaggaaagtttccttccttgagagtttcagatctctgtgtgtccctgctgctgccgccactgtcatcaccacagaattgtttgggtgctgggatgggaaagaaccgaaaggtgaaaaataggaaaaaagaataatgacattttctgcactctccgacttaggatattcatttcctactcttcttaactagagagcttctactggggcattttttgtttgccccagtgtcaactttcaaggtttgggcttccttgagttctgaccgaaggataccagaggggaagaaatggaatatctgattcaagtatgatactactgtgaattgtgaccttttctcataatctacctgctattgtattatttttaatcaggagactcttagagcaatttcaggtttgtggaaaactgagcagatagtacagaattctcatatactacctctttctcccactgttgttatagttttctttattactaacaacttgaattagtgtggtaaatatgttataatttattaaacaatattgatacattattattcactaaagtccataatttaaactagatctcattagttgtgttgtataatttttttgttgttatttgttttttcttgagatggagtcttggtgtgttacccatgctggtcttgaactcctaggctcaagtgatcctcccacatcaacctctcaagtagttggggttacagacgtgcaccactgtgcccaggttttatgttatatagttttatgggttttggtatatgcataatatcatgtgtccaccattacagtctcatacagactaatttcactgccttgaaattgccttgtgctacacctgtttattcgtcttcctccctgcccctaaacctcaggcaaccacttctctttctctttttactgtttctgtagttttgccattttcagaatggcatatagttagaatcctacactatgtaaccttttcagactagcttctttcacaaaactatatgtttttaagattcctccatatctttttgtggcttgatagcacatttctttttatggctaaataataatatcacagtttgtttatccattcacctgttgaagtatgtctgggggtggattccagtttttgtcagttgtgagtaaagcggatataaatgttttatgtgcggatttttgtgtgaacatagctttcaactcatttgggtaaatacccaggagtgcagttcctggattgtatactaagactgtgtttagctttgtaagaaactgctaaactgtctttcaaagtggctgtactattttatattcccaccagcaatgaatgagaattcctgttgtgctgcatccttgccagcatttagcattgtctgtgtttttggattttagccattctaatagatgtgtagttgtatctcattgttttaatttgcaatttcctggttatatatgatgttaagcatcttttcgtatgtttattttacacctttacatctttttttagaagtttctgttaaatattttgctcattttaaaatgagttgttcattttttattgttgagttttaagaatattttgtatatttttgatatgtcttgtcagatgttttgcaaatatctcctcccagactgtgatttatcttattattttcttaacagtgtctttgacagagcagaaaatttttaatgttaatgaagtccaatttaacagttcttttcttgcatggattatgcttttggtattatatctgtaaaaactcattacccttaggtcacccagattttcatctgtgttatcttccagaagtttatcgtttttgcattgtacatttaggtttatgatccattttgagttaatttttatgaaagatcagtgtctagattcacatttttgcatgtgagtgtccagtcctagtaccatttactgaaaagactacacttcgtctattgaattgcctttgcttttttgtaaagattgactgcctatttatatttgactatatcgggtctatttctaggctatctattacattgatctatttgtctattttttttgcagtaccacattttcttaattattgtttatagaaagctttgaacttgaatagtgcaagtcctctgactttgttcttcagtattgtgtttgctgttctggatcttttgcctttatgtacaaactttagaatcaatttgttgatatccacaacataacttgtgtttttattagtattgctttgactttatatatcaagttgaggagactgacatcttaagaatatgagtgagtcttcctatttatgaacatgatgtatctctccatatcatgatgaagattttctttcatcagatgtttgtagttttcctcatttgtatgtattttgttatatttataactaagtgttaatatttcttttttggtgctaatttaaatggtattgtgtttaatttcagattccagttgctcattgatgttatttaagaaaaaaactgacttttgtgtattaaatttgtattctgcaactttgccatactgatgtattaagtccaggagttttttctttgattcttctggattttcaatgtataagatcatgtcatatgtgaacaaagatggttttatttcttcctttgcaatctgtttaccttttacttccttttcttgttttattgtattagctaggactttcagtatgatattgaatagaagtgagaggagacatccttgctttgttcccagtcttaagatgaaagcatctagtttctcagcagtaagtttaattttagctatggttttatttgtagattttttttatcgagttgagaaagtttctatctatttctagtattactgtgaatttttatgatgaattagattttgccaaatggttttgttttttaatgtgatcatatgatgtttcttttgtagcttattaatgtgttggattatgttaattgatttttgaatgctgaaccagccttgtatacctggaataaatcccattaagttgtggtgtttaaatctttttatgcattgatggatttgatttgctaatgttttgttgaggatttttttatccatctttatgagagatattgatttgtagttttttttcttttaatgtttttatctggttttgttattagggtgatgctggttttatagaattagttgaatgttcctttgcttctgttttctaggagagattgtagagaattggtattatttcttctttaaatgtttgtagaattcacccattagcccatctaggcccacccatctagattttctactatgtaagtttagataatttattttagatctttctcctaatcagatatatgtattcaatgctataaatttccctttaagcactacttctgctgcatccctacatttttagaaattatgttttcattttcgtttagtttgaaatactttttaaaatgtactttgagtttttggatccatgtgttatttagacatatattgtttaaattccacgtattttgacttttagtcattaatttctaatttaattccattttggtctgagaacatactttgtatgatttctattcttttaaatttgctgaggtatgttttttggcccagaatgttttctgtcttagtgaatatactatgtgagcttgataagaatgtatattctgctgttgttggatgaggtattctgtaaataccagttaaattcattgattggtggtgctgtcagttcaaccgtattcttattaactttttgcctgctgcatctgtcaattactgatggaagtgtgtttaagtctccggctataacagtggatttgtctgtttttccttccagttctcttagttttcacctcatgtattttaacattctgttggtagtatatacacactaaggattattatgtcttcctgaagaattgacccctttattattatttaatatccctctttattcctgattgtttttctggttctaagtctgctgtattaggcttctatagaggggcagaactaataggattatatatatatatatatttatatttatatttatatttatatttatataaaagggaatttataaaggagtattaaactcacatgatcacaaggtcccacaataggccatctgcaaactgaggagcaaggaaaccagtctgagtcccaaagctgaagaacttgaagttggatgttcgagggcaggaagcatccagcatgggagaatgatgtaggctgggaggctaagacagtctaatcttttcacattcttctgcctgcttttatcctagccaccttggcagctgattagattgggcccacccagattaagggtggacctgcctttcccagcccacgactcaaatgctaatctcctttggcaacaccctcacagacaggtcccggataaatactttctatccttcaatccaatcaaggtgacattcagtattaaccatcacatctgctttgtttgatattagtatagctactgtagctttcttttgatttgtgttagcatgatagatctttctttgtccctttacttttaatttatctgcgtttttatatttaaagtgggtttcctatagacatcatatagttgtcttattttttcaatctactctgtcactatctgtcttttaattggtgtatttagatcattaacatttaaagtgattgttagtatatttgcattattatctgctgtatttgtaactgttttctatttgttatgcttgttctttcttggttttttatctgttttttttgccttctctgtttttaattgagcattttgtatgactccgttttctctcctttcttggagtatcaattcttctttagaaatttttagtggttgatttagagtttgcagggcaacatttacaactagtcaaagtttactttcaaataacactatactacttcacaattagtgcaggtaccttataattattctctcctgtctcttgctgtaattcatttcacttattcataagctataataactcaacacatggttattttgaataaactttttgccaattaaaataaaaaaataagcttttattttaccttcatttatttcctctctggcacggttcatttcttttgcagatgtgagtaataacaggtatattattttccttcactctcaagagctttttaaaaacatttcttgcaaggtgggtctactgttgatgtgctggtaaggtgtgggagaatatgagaccttttataatcttacgactaaatctgctttttatttttattatttagtttctttcctattttattttaagttcaagtggtacatggcaggtttgttacatgggtaaattgtgcgtcatgggagtttggtatacggataattttgtcacctaggtaatcagcatattaggtagtttttcagtgctcacccttctcctaccctatacccttaagtaggcgccgttgtcttttgttcccttctttgtgtccatgtgtactcagtgttttccttctgcttataagtgaggacatgcagtatctagttttctattcctgtgttaatttgcttaggacaatggcctccagctccatccatgttgcggcaaaggacacgatctgattcttttttatggctgtgtagtattccgtagtgtatatgtaccacactttctttatatagttcaccattgatggacatctaggttgatctttgctattgtgaatggtgctgcaatgaacattcatgtgcatgggtctttttggtaaagcaatttatattcttttgggtatatactcaacaatgggattgctgggttgaatagtatttctattttaagttcttcgagagtctttcaactgttttccacaatggctgaactgatttgcattcccaccagcagtgtataaatgttcccttatctctgaaacctcgccaacatctattgttttttgactttttaataatagtcatcctgactggtacaagatggtatcttgtgtttttgatttggatttacctaatgataagtataaacctatttttttggtggggggcctatgccccaggatgtgaccttcaccagtatttctcagcttcctgtaccctacttaggtgagataggaaagctagaagaggctggagtggttatttttcttctcccatgttgattaggttctggcaaagtagtttcccttcccctgctggaaacaggagatttttctgatattcactgtgagaacatggagggcttatagtaaaactctgccccaataagatgtgattctctgtattcacttgtctttccagtttttgggcactgatttgccttgtaacctcagttctctgatggattaaagaaaagctgttgattttcagattgttcagtttttttcttttttctcccccttaagaagacaggagtaaggacctccaagctcttaatatgttgagtggaaacctctctttactttttaagagccttctaatagctactgtcttcttttttttttttttttttggtctatattttatagctgttttcagtgggagagctacagttgagtgttcctactccatcttatctgtacagatgctccttacagtggggttatgtcctcataagtccatcataaattgaaattattgtaagtcagtaaggcatttaatacatctagcctactaaacatcatagtttaccctagcctaccttaaatgtgctcagaacacttttattagcctacaattgggcaaaatcatctaacacaaagcctattttctaataaagtgttgagtatctcttgtaagagtatcatacctcatatcactagcttgagaaaagttcaaaatttaaaaattcgaagtatgatttctactgaatgcacagtgctttttcaccattgtaaagtagaaaaaccctgttgaccattgtaagttgaggactgtctacatttttttgaaatactgatttgtttcctttaatgattatatttctatttaggttttttattttttgaattattttggtaaattatatttttttctaggaaattgtcattttttctaagtttttaagtttacagatgatagtgtttatcattagtttttttcaaaatctcatgcacatctatggttttgctctctttccagtactcgcacaattttgtaagaggattgttacctttttaaagagaaatcttgaatatcacctattttgtttgtttttatactttaaaattttattttgtaacttttaatttttaaattttaaagagcttgcaaaaaaagaatgtttccatattctctactcgactgccctaaatggtgatatattataaaatagcacatagtacattacatagttatcaacaccagaaaattagcattgatacaatactattaacctatttatatacttcattaaaattttgccagttctcctactaatgtccttttttggttcaaaatccaagatgacacaatatgtgtagttatcattgtctctgtaactccctttgggaaaattcttcaatctttttttgtcttttatgagcttagcgctcttttttttctcctctaaattatttattgaaatattttctttataggctttaaataccttagtgtaagcagaacttgaaatacaaaggacaaacattgtgtagaacctagaacaccctatcagttcattgaatcatgatttcctccacacaagtcctcggattcttaatttgttgaattgatcctaggcctttgttgtctcaggatatttttcctaaatcctaattgattgaccagtcttatctgaagaattcctgccccctacccacaatctgtgtaggtgagttattcttctgtctcttagaaaaagttagactaggctgcaaagaacctatacctctaagcgtctcctccattttttttttaaccttctttaaatatatttttgggtgtttaaatgggattagaagtgtcatctggcccccaaaagtgaccactcttaaactaaagatatttccataataatcaaagcatagtaattttctgggagacttctcacttcatcacatccttccataccctctctggcagttctcttgaacttatcctagtgattcttcttcctattgaaaaataatgtgcgtactgccacaatttactgtagagttctgttgttagtgggataaggccaacaataccatgtagaattctgttgctcttccttcttcatgcatggaaatttgtctaagtattgttaactccctagatgtctctatacttccagcaaagagatagctggcaacatagttttgtcatttcttggacagaactctttttcttctcaggccaatgtgatagcttcttagcttgccctctttcagaatccttgtctttggtagcccgtaaggctgcagaatttttaaaactgtgtttgtatatacagttcagtagtgttaagtatattcacattgttgtgcagcagatctccagaatgttcccattttgcagtactgaaactctatattcattaaacagtaattctccattttcctcttttcccagcacctggaaaccagcattctacttttttgtttctatgaatttaactactctagatacctcataaatgtagaatcatatagtatttgtctttttgtgtgtggtgtggcttattttacttagcctaatgtcctcaaggttcatttatgttgtagcatgtgacatgatttccttctttttaaaggttgattaatgttccattccaagtatatgccaccttttgtttaattatctgtccatggccatttgggttgcttctacttttggctaattgtctgtaatgctgctatgagcatgggtgtgcatgtatttcttcaggatcttacttttaattattttcaatacatacccagaaatgggattgctagatcatatggtaattttatttatttttttgaggagccgccataccattttttatagtgatggggtaattttatgatcccatcaacggtgcacaagagttccaatttctgtgcatccttgccagcatctgttattttcaaaatttaaaacaaattttgtttgtttttatagtagccatcctaatggatagggggtgatattgtggttttgatttgcgtttttctaatgattagtggtgttgagcatgttttcatatgcaagttggccactcgtatgtatctttagagaaatagctgttcaagtattttgcccattttttattattttagagaaagggtaactctgtgttgcccaaactggtcttaaactcctgggctcaggcagtctgcctgcctcggcctcccaagtgcttggattacaggcatgagccactgcactgagctgattttgcccatttttaaactggacttttgttgatgttgggttataggagttatttatatattctgtatatttacctcttaggtgatttgcaaagaggttgacacttttgaagagtaccagctagtattttgtagaatgtccttcaatttgggtttgctttaaattcagattatgtgttatttagtaagaatatcatagaaatgatattttgcttctcccagtactatcagtaggtgcatgatttattgtatatcattattagtgacattaactttgatcccttttaataattaaagtgatatttgccaggttagcctgccataaattcattattttccatttacaattaataagtgtcttgtgggaagacattgaatgtatttgcattatgttgcttttaatcatccatttgcctatctgttttaatatctattaacgacttgccccaattattacttgccccaattattactgtgacatttgccaaatgatgattttctatttttatcatttcttctacatatcttaatttatatttattaatttatttcagctgcaggaaagagctgtatcaactctctcatttatttgtttatttatttacttaaatcagtagacaatggattttttttcctatgggttacagttcattagtattaggatggcacaaaagcagtcatgattactttcaatggcaaaaccgtgattacttttgcaccaacttaatattataaattttattgcttaatttgcttagttttattttctctgtctcaactctggaatcagccatttctccaaggagccctgattcatttcattgaaaatgatatttagaagccataatatggttgctaggtgtcctcatttctactgagagattattcctgtaggccttttcagtttcttattaatttctatttatgtcatcatttttctaagttattaaggggagcacttagctcactaattttttagttttcttaaaatcaaaatatttagtgctataaatttttctccaggtaacttttttatttgttaatttattcaccaaatatttaatacatgcctgaggctctattttaggtgcttggaacacatctgaataaagcaaaaatatttctttatttgtggagtttacattctagcagaggaagacaagtaataaaaacacattttaactgcattctaactagtttttatatgatatttttagtattcagtcctatctattttctgatttccattgtgatttcctttttccccagagaacgtagctttaataatatgccttggtatttgttgagacttgttttctgggtgaaaatatggacagtttaaaaaaatattttagatgggtttgaaaagaatgtttttaattattagtgtttttaaaaatctggcatgtagagaaaaaacttaattgcattgtttcaatgtatttattgtctgcttgcctatacattatgggactgtattaaaatctttcactatttttgttgcaatgttgttaattttttttcctgttattctgctagtttttgacatgtattttgaattacatttttagatgatttcaagttcataattattatctttctgttgcaccattccttttgtgattaggttagactaagttcatatctaatcattcttttttcctgagatttatttggttttgaaaatatttgttctagtcttttaaagttagtttgtacttattaatttattttctatatttttactttgttcctctgcatcactagattctaggtttgtctcttataaatacatttatatttttagcagtctgacagtttatttcttcagctggtgaacttagtgtatttaagtttattaaatttattataattactgacatatgtaatcaaatctaagatattatgtacatatgtgcagcccatattagatgcttaaaaaattcagaattgttacttcctcttgtgtaatttcttttgtgtttctgtaggacctgatttagatctaatacctaatgctgcccattaaactatgacagaatacccttaaactttgtcttacttaaggaactcagaatactcaattgttgcagtcatatcttaataaacatttttttcattgatatcaaattcatggcctgctgctctgttttggtctggttaattaccttttctacatacacaagaatttttcttctcagtgccaaatcattaagttaaactccacatgtaatactatcagctatgtacataactcagttaagtaaagacaaatggacagacaggattgagtgtgtgtgtgcataagcaataaaaactgtgtcataactgtgtgtgttcaacagcagctgtaagatgtcatcacttttaagatgcattcagatttcagagatgttaacatatgaaaaaatgtatggctaaaaattgatttattctggtattttaaattttatcatattttgtatttttttatttattctaactgtgttttctttttctttaaacctttttttcttgccatctattaaattgtttagatgttctttgttatcttctttgctcctctactgattttggagttatgaacctctgttattttagcatttacccttaaaatttcaaggtattcattctatttaacaaactgtaaggttaatcactttcctacttttttggataactcaagggcattatagcattttaactctgattatgttttttctacattgtgtattgtttttgtcaatgttttcagtctaccgtattctagattgcagttttacatttgtgtatgagtatttgatgaacatgtatttaatgatgcatcttataatccaagacatcttagatttctccaccagacagcaaaagcatataccatgtccgtgtgtgtgtgtgtgtgtgtgtgtgtgtgtgtgtgtgtgtgtttcgtcatttaatttcactagctataatggggcttggcttacagtagaaaataattgttttattaattgaatatttattctactataaaaagacccccgtggtaaccagaacaatctctttgttcatatgaagcacccgtctctaagagctttctagtctattgattttagacttagaccctccaatataatctgacttggaagcttatagagaatattgtgtagctatcaagtgatgaccgtagagattttcaggtatgtgtcaacacatgattatgttcattcaaaatgtgaaaggaaaattcagattataaagtattagggatataatgattgaaataggcaaggagtcaggccttggactggttggacatcttttttttccagtggtaacataatctgttatttatctttttgaaactcccaattttcttctgtactttttagctcattacattctgttgggcttaaagatttatttgctgctgtggtcacttgcttttagacaagaggcaaaactttctactgacatctacctcaggtagcaaagacaagtgcctaaagtaggtactgttttatgtgggccaaggttggaacaggatatttctccttagccttggaaaccatactagtaaaatagtttgtcatagggtgggaacaaaggttttctcaccacttcttctataccaagactggactctgtcccctgtgtatactttcttaagttttcttcttggaagaaagtagatctggctaatccactcttcctgcagtttccttgggactattgcatgggtaaaaatgaaataacttaacatgaatgaaggcgaaaagataattttaagtgctataagtaagtttagtttctttgttattgtaaagaggtctgggtttacaatttaatattagctagaactgaaataatactttcttcaactggttagtagcattactgataattaaaaactggagaatggttaaaaaattgtgtatgattggctcaactgtaatgtacaatttatatattttaataaaatttgtgacatatttatatctaagatgtgaattaatggaaaaaagagaacagctgacagaattagaagaaagaaaaggacaatgttaataataggacacagcattttaataaatatattgaatatataaaaatatattgtatctcaagaatttgatcctgttctcaagtctgtttcttactgattttcaattgtagtcaatactagttccaccttttttcctttccctttccttcagatatcatccagacacttaacacagtgcctggcatattctagcttcttgataaatattttagctatttaaatgagtaaaggaatgaatggatggagagtgaacaaatgaacaaatgacgaagttttagtcttttgcagtacaaataaatatacatgtaaatttattgagatttgaaaacaatcttttaataatttaggtaatgtagaggaaaagattaatttgttttaaaatgtgaacactggagtttttaaaagtagggttataccatctgaacaacaaatggaaaataagaattaaatgaagtaaggtaacttgaaatgaatttatgagatatgtattctttaatgtaaaagtaattgattagcaggttcagaagaaatttttaaagactttattctcattttaaccttgcttgttctagaattttgtcaagtataaattgttttgaactttctacttaaattgaatcgatttttatttctgaatcattatgagttctaatttagtgcaattgaatcaatggattttactgtgtattatatattggctttaatgccatatatctataaaatatttccccccacattttggatctatatgattcatattgtctattgattctgtatttaaatatttaaatatggtttatgatcaagtgtatgggctgtgatgtcaggcagatttgagtttctgtctctaatatattacctcttagtgagcaatttattcaacgtctcaaacttcagtagcatcttgtataaaatggagatgattgattcctactaccataaaaggttgttgggatgacataataaacttacatatgtaaaatgcttagcatagtgtttgggatatggtaggtattcagtaattgggaataactatttttctccattgtgtgttttttttgtctgcagctttccccacaaataaaccagagaaagatgcaagacatgtagtaaaagtggtaagtgttgctcatagatttgtatttcacatatatttgactttttccttttctgctttaagaatgtttttcacgttaatttttgtaactattgccttatcagtaaacctaatgttatcatctgttttgacgttgttaaaacattaaaactggagaacctttgtttttctgtattgccagctattaccctggtgtgttatctatctagctattctttctctttccctcccaaatgccctcccaccctctccacctctctaatcaagatggtaaggtccttaaaggcaagcatagggttttatttctttttggtgtcccctgtacctagtataatgaatgaaatatagtagaccattcagtaaaggtatcatgtgtgagtggaccacaaggagagtttgctgtgtatcacctggatgtatatgttggtatacagtgagtgttgtatatgtttatgtatacagttctcagtgcttctagtaagtgttctctgtaagaaaactacttttatgtgtaagactgtatagggatagtggtacaatatgtcgtttaaaaattagattcttcaagtttatttagtgttttctgagatttttagtggaaatctggtgcctatgttttataaaaagtgattcaagtactattatatactacatatatatgttcatattttcacagttgaaataacaattccatctttgggattatttttttctagtaaaattaattattcttttttttataggaatatcaagaaaatggcccgttattttcagaacttaaattttatcagagagttgcaaaaaaagactgtagtaagtaaaattagcaaagcaagctacttccatatatgtgcttgctaaagtgagtgttgatattttggtctttttctggccttctggaaaattcttttcaatagaaattttattgtaaagtgatacagttaactgttacaacatataaaagcaagacagatggtatacaaatcttgacatgacatacataatgggttatatattttaagtcaaagttgtttctactactttacataaaatgttaggttgttaatctaagctaccaagagttccctaagtgtaaaagatagtagaatgaaattatttcttttacagtaaaccatttggataggacggctataaggaaaaaacattaaaatgggaagtagatatatgtataaaaaaagaacgattgtagaatggattggggcaaggtgtgtggaaatgtgaaaatgattaaactttaagatgtttaagaaaatgttagaaacttgaatgctggaaaattaattggagctggataccaagtgtaagaatgaccagttagaagacttgaatgggaaatgaatataagcagagaggaaaaataacagcattttataaatgtgatatagatgggctaagaaaaacattaaagaagtagacaggagtaatgactgtatagtcaaggtcctttacatcatgtttaagaataagagtgatgggtctgacctcaatatttaacttagtttttcttaataaagtcttctaaacattaagactgtaatctttactaattgcttaaactatgtcacagtgacaaatagaatccattaaacttgattgtttatcagtagagctgtcttaaacataaaaaacataggctagagtcatgaaaaaaatgatgaaagttaactttatttaagtggatttgattttttgtaaactaatcaaaaccagtttttgtataaagtaatttcaaagtaagatggtttttctgcccaatttctgctttttttttcttttttttttttttttggtccattatggttttaaatcttgaagtaatagggaagaaaaagccatctctctactgatcttttggtggttaacatatgttatatttagaaatttagctagtatataagataatgaattctttttatagattgaaacattaatatatatggtatcaatatacaaagcctatgacttgtttttattgatttaatttaaaaatttctaattttttgttaattatagtggtaacagtttgaggccattagatagagatgtttgattgaaaaaaaattatcttctaggaagatctaattacttttttggttagctaaataaatttgtctgtagaaaggtgacaagtatcttttcaaataacatgaatctttttaaaaataaatttgtctttgtagtcaaaaagtggatagaacgcaaacaacttgattatttaggaattcctctgttttatggatctggtctgactgaattcaagggaagaaggtaaaatggaattattataatcaaatatttctttataactattccttatgtggtctatgagttaactattgccatgtaacaaattaccaaaacatattggcatataaccacaaacttgtattgtcttagtttctgtgagtgaggagactgcaagtggcttatctgtatgattctagatcaggatctctaataaggatatgtagtcagctgtctgctgggttacattcatttcaaggctcatctggggaagtatttgttttcagggttcctcatgtggctactggtaggcctaagaagatctacttctaatttacttatgtgattgttggcaggccttcttacttcctgatcatgtgggtctttgcataagctacctgagtgttatgaaaaatagctggctttctctagagcaattaattgggggacggggagagcatgcacacaagtgcattcaagaaggaagtcatcgttttttgtaatctaatcttaaaagggatattatcgcttctgctttattctctttgctagaagctagtcactagatagatccattggtcctgagagaggagaattcagttctatctcttgaggagaagcacaacaaataagttatagaaatatctttaaaaccaccaaatatggctagtcctatatataatttattaatagtgtttgaaaaaagaaaaaaagtgtgtcattttatatttacccttttgtgccagagacttttatatactttatcttattttgtcctttgaatagcctgttaaaataggtgatattatttttattccatagatgagagaataagctcagatgtcagtactttgttgaaatggtctctaaatgctttaaatttaaaaaaatgagcaaacagtaatcttgaagtaaaggactgccactgggggactgaatggctgattgaatcatgatacatccatatcatgtcatatgtagcccattaaagaagtccattagagctatactagttgccttagaaggattttgatgagatactattgaaaaaagtaagatggagaaaatacttataatatgatcacatttttgtaaaacaaattcctaagtgtgtgtgtttgtgtatgcatgcatagatatagaataggggctgatgtggatatataaatgaagggaaggaaagaaggtatggaaggtgccaaacagaacagaaaaggaagaagtgcacttaaagacatgtttataaatgtatagagacggtatatatgatcttatcaagaaacaaacaaatataaaattcatgtggctgggcacggtggctcatgcctgtaatcccagcactttgagaggctaaggcaggcggatcatgaggtcaagaggtcgagaccatcctggccaacatggtgaaaccccgtctctactaaaaatacaaaaattagctgggtgtggtggtgcatgcctgcagtcccagctacttgggaggctgaggcaggagaatcgcttgaacctgggaggtggaggttgcagtgagctgagattgcaccactgcactccagcctggtgacagagcgggactctgtctcaaaaaaaaaatcaagtgtgtacaataatttgttcaaggccatatggcaagaaagtcatggagtcaaaatgaattgcattcagtactatctaatttagaaagattttttcattatgtaaaacagtgtgaatggttcagtacagcattctcttatagaaaatcagctgcaaagtaaatattgagcagtttctgcaaaagaatagcagaattatgaacgtgcattcattctctaatggtttagattgcattatacttagttgttaggttgagcgtaatttttcttgtttcaaattaaatagacagtttcaagcattactttctcaggatgatctctttttgatgcttttttcttacagttacagatttatggtaatggaaagactaggaatagatttacagaagatctcaggccagaatggtacctttaaaaagtcaactgtcctgcaattaggtatccgaatggtaagaattacttatttcgcatgctccatttccaaattgtttacttcttgcaatatagaaatcttttccctttgtggaattattagagaatgaaggattattgccctagagacatcagttattaggagtagaggctattttggtgaaattgataacaatgggctctgtaagtgacagaatgtgctgtgtatggcactgcaaactcaattaggctttggttctccagtctgatcttctttttccttagagctttgttttacataccagaacaagctttcattgctgtaagaataacctttcttttgtcagttataacaatgcaaattatggcaaaatatattgtcagacattttaaacatgtgatggtaggggggtgctatgaagtttttattatgagtttgggatggtggcaataattagttgtgacaatgaataaaatatactttgccaaagcagaagcaacgaactcttaatagcactcaggcacacatttgtttatactacatatttgtcttatatgtttgtatttggtttgtttaagtctcattttttcacttttgagtagcatgaagctgcttatgccagattggaatgcagcaaatagaatgcattaattttctcatttatccatcctcgaagccagcaaatgtttattgagtactaagtgtatgtaacatgcaaggctgaagggctttagagatgaagctaaggagttttctattaccatacagaggaagaatacctttccctttgctcatggacatggcattttgttctgagattctcaaggcttgatttataattattgcttaggtgaggaattgctgagtgggcttcaagattatttcaccatagatctctgattttatgctatgtttttcctctttgtgcagtgcggtttggctactgggctatcaggaattaggcataagcatttttgaatcttgattttcttcctttggaacttcaactaaaatacttgatttttgaggatcattttacttttttctaggatgagcaaccagaagatgtgatattttagaataattaaccagtaattgtgaaatacatcgctttgtcaatgttaatatgaaaaaacccatgttattctatattcaaaatgttgaaattgatcatgagttctaaatagcagtaaaccttattttatctatttattttcacagttggatgtactggaatatatacatgaaaatgaatatgttcatggtgatataaaagcagcaaatctacttttgggttacaaaaatccagaccaggtaaatacatacttttgcttttaataaaggtctttaatgtatgaaactgaaacattcagaaaacaaacttctaacccagaagagtttacaaatgagggcgtaacatgatgaatgttgtaatttatcttacctgcttatctaatttaatctttgtaccaaactaatgagtaattaggatgagaaactgagagtcagaggggttaaataatatgttaatgggcacacagttaagaagtggctgagcaggaatttgaatttctgagcaaatatagataagcaaagaaccatcaaaatccagtgggagtagagatggatttatgtagaggttaaaacactgtcatattagttcatcatttcctactgtataaccaattaagttttaagcagagaggccgggcgcggtggctcatgcctgtaatcccagcactttgagaggccgaggtgagtggatcacctgaggacaggagtttgagaccagcctggccaacatggtgaaaccctgtctctactaaaaatacaaaaattagctgggtgtggtggtgggtgcctgtaatcccagctactcaggaggctgaggcaggagaattgcttgaacccaggaggcggatgttgcagtgagctgagatggtgccattgcactccatccagcctgggcaacaagagagaaactccatctcaaaaaaaaaaaaaaaaaaaaagttttaagcaagcttttccattaaaattttgtgtaatgatgaaaatattctgtttgactgtccaatatggtagccattagcagtatgtggctaagtacttaaaacgtggtcagtacagtaccaactgctgatgagtatttggagtaacaggaactctcatttgttgctcatggaaatttgttgctaatggaaatgcaaaatgatacagccactttggaagacagttgggcagttacttagaaagctagacactcttaacataccaagcagcagttgtgctcattagtatttacccaaatgagttgaaaacttacatccacacaaaaacctgcacgtgaatgcttgtagtcggtttattcatactcgtcaaaacattgaagtaaccaagatgtctttgagtaggtgaatggataaactgatacatccagataatggaatattattcattgctaaatagaaatgaacttttcagccatgaaaaaacatggaagaaacctaaatgtattttactatgtaaaagaagccaatctgaaaaggctagttactatacaatttcaactatatgacattctggaaaaggcaaaactatagagacagtaaaaagatcaattttttactatctccataggttagaagggagaggaaggatgaatgagtgaagcacagtggatttttaggtcagtgaaactattctgcatgataccataatggtgaatacatgtcatcatttggttgttaagatccatagaatggacaagaccaagagtgaacataatgtaaactgtggcttttggatgataaggattgtcattcttggttcattcactataaaaaatgtgctactctagtgagggatgttgatagcggagagactttgtgtgggcttgaggtatatgggaactcactgtattttccactcagttttacctacattgctctaaatttacctaaatcaaacctaaaacttctctaaaaaatatagtctgtttaaaaaatgtagattatatttttaatattaaaatattaatattgacaaactgaatttttaatttaacttaatttaaacttaaataacaatatacctagttgttactgtattatcacgtttaaagagttaaatgattgagtctataaaaaattagaaaaaatgtaattgaatatttgatctctgcattggttaaatttcttaataaaaattttttcaaaatgaaaggtgaatgagaaactgggaaatagatagataacaaatatttgagaatatctagccggtactaaaaaaaaaattaagaaaaacactaaataccttgttaaagcgatgatcgaaaagaatgaataaacagaacagagaaggaatatgactgtcctagaaacaggaaaaaaggctacctttgtgaaaaatgagaagataaggagaccaaaacagcgaggcaccctttttaaaggacttatcaaattggagaggtctaaaataatagtctgataatattgaggctgataaaggtaccagcacttttagaatgccctttgggaatgtaaattaaatggtataagaaagttagtggaagggaatttggcaatatctgcatacttttcaaagattaggttttttgagatataatttacaaacagtaaatgtcacgcttttaaatgtacagtttgatatcttttgacagatgtatgtatcatgtaaccactactgccaccaagatgtagaacatttctttcattcccaaaagttctctcattcctgtttagagtcagtccccttctcctggcattgctcccagccccaggagatgatttctgtccctatatttttacattttcaggaatggtatataagtggaattgtaaggtatgtactgttttgggtctgttttccttcacttaacataatgcttttgagatttatctttgtaggtcattagtagttcattcctttttattgctgagtagtattctattgaaaactgctacaatttctgttcacctgttgatggctatctgggttgttttcagtttttgacagttataaataaagttgctataagctaagcattcacatacagccttttgtggagacatatgtttcactttcttttgagtaaataactaggagtggaatttctgggtcatatgaaagtgtatgtttcacatggaaactgccaagttgttttctggagtgactgtaccattaaacattcccatcagcaatgtgtgatatttcatttgctccacctggtttcatttttttttccatactttaagttctagggtacatgtgcacaaagtgcaggtttgttatatatgtatacatgtgccatgttggtgtgctgcgcccatgaacttgtcatttatattaggtatatctcctaatgctatccctccctcttcccccgaccccatgacaggccccggtgtgtgttgttccccttcctatgtccaagtgttctcattgttcaattcccacctatgagtaagaacatgcggtgtttggttttttgttcttgcgatagtttcctgagaatgatggtttccagcttcatccatgtccctacaaaggacatgaactcatccttttttatggctgcatagtattccatggtatatatgtgccacattttcttaatccagtctatcattgatgcacatttgggttggttacaagtctttgctattgtgaatagtgctgcaataaacatacatgtgcatgtgtctttatagcagcatgatttataatcctttgagtatatacccagtaatgggatggctgggtcaaatggtgtttctagttctagatccctgaggaatcgccacaccgacttccacaatggttgaactagtttacagtcccaccaacagtgtaaaagtgttcctatttctccacatcctctccagcgcctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttctttgtagattctggatattagtcctttgtcagatgagtaggttgcggaaatgttctcccattttgtaggttgcctgttcactctgatggtagtttcttttgctgtgcagaagctctttagtttaattagatcccatttgtcaattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaagtgtaaggaagggatccagtttcagcttcctacatatggctagccagttttcccagcaccatttattaaatagggaatcctttccccatttcttgtttttgtcaggtttctcaaagatcagatggttgtagatgtgtgatattatttctgagggctctgttctgttccattggtctatatctctgttttggtaccagtaccatgctgttttggttactgtagccttgtagtatagtttgaagtcaggtagcctgatgcctccagctttgttcttttgtcttaggattgtcttggcaatgcaggcccttttttggttccatatgaactttagagtagttttttccaattctgtgaagaaagtcattggtagcttgatggggatggcattgaatctataaattaccttgggcagtatggccattctgatgatattgattcttcctatccatgagcatggaatgttcttccatttgtttgtgtcctcttttattccattgagcagtggtttgtagttctccttgaagaggtccttcacatcccttgtaagttggattcctaggtattttattctctttgaagcagttgtgaatgggagttcactcatgatttggttctctgtttgctgttggtgtataagaatgcttgtgatttttgcacattgattttgtatcctgagactttgctgaagttgtttatcagcttaaggagattttgggctgagacgatggggttttctaaataatcatgtcatctgcaaacagggacaatttgacttcctcttttcctaattgagtaccctttattttttaaacttaaagctctcttattcattacagtttattataagtggttttccagttgttccaacactatttattttaaaatatctttgcttcagtaatattagttgttacttttgtcatatactcagtttcctcatgtacttggttttatttctgtactttctgttgaatcacactgatttgtctatttatataacaatactagccataaatacttttgcattaatttctgaagctttataatgtaatttaacattggattggactagtagttccctgtagttctccgttttcagtgttatcttagctatttatactggattttctgtattattttgtttagtttcatttaaaaggaatacttgtgctgggcgcggtggctcacgcctgtaatctcagcactttgggaggctgaggcaggtggatcacgaggtcaggagatagagaccatcctggctaacatggtgaaaccccacctctactaaaaatacaaaaattatccgggcgtggtggcaggtgcctgtagtcccagccactcgggaggctgaggcaggagaatggcgtgaacccgggaggcggagcttgcagtgagccaagattgcgccactgcactccagcctgggtgacagagcgagactccgtctcaaaaaaaaaaaaaaaaaaatacttgttggcattttcattgaaattatgttaagttttaaaattgatttgggggagacctcacatctgtatgatgtatagatgttcatatatgaacaaggaatgtttctgtttttcatcaattttgcattaggtcattaggattattttaaagctttcctcttactagttttgcatatttcttattatgtttgtttcaaaatattatacctttttgttgatattgtcagtggatttattctattatttcttattatttttgtttatatatatgaagaatttttatttccatgcattaattttatatcctgttaatttacggaattatttgtggttcagagtggttttagtaatggttctttagagttttcttagaaaactgtcatatgcaagtagatacagtagtttttcttcttttacagttcttgtatttaatttgtcttgtctaattgcattgtctaatacattcaatacagtattaaatagtaagaaatgtaatcatcttttactcttcttaatcttattggaaatgcctgaagtattaccccattaaatgtgatgatggctttaggactaaggtttgtgtatatgtttgtgaatatatgtgtgaatatgagtgtgtgtgtatctgtttataaagtcaagaaaatatctgtcagcgcttatgttcttgaatgtgttttatttttatggaatgggtattgaattttttcagagtcttgtttaacatctatagaagtaatcatatttgtctcaaatattttaatatggtataatatattgctgagcttctaatattgaaccaaccttttaaggaataaatcttgatgtgttatggcataatattagtgtaatgttgaagttcattaatattttatgatgtgatttcatattgatattcgtaagtgatattgatccatagttttctaattttgttctgtttttatcatattttggtgccaatatatttggttcataaaaagaatttggaggttttattttctgtgttttagaactatttctgttacattggaaccatctggtctttgaatgtgaaactatttgattcttttgcttttctgcgtggtagttctttgtgattctctacttttttcagaaattggttcgattctttatctctatttgagtgtctgttttagttgttattcatgttatctgttttttcaattttatttgtgcggtggtctgcattgtagttttttatgacttaaatttttcgtacttcagtgattgtttctctctagttattttaaactttattttgctttctccctttttctatccttatgaaggtggccagtagtagtcccttttgttaatttttcaacaaagttcaattttgactcattaatgagattttttcttttttcttattattaatttctgactttttctttatcttgtcttcatatatactcttttagttttacctttctcttctttttctagttctccaattggatgtccctccataagagtttaaggctatgaattttcctcccttattgttttatattatatctaattgattttgatatgtaatgtttttgttctctttattctttggaaagtttgtatttttctttcaccaaaaaagtagttcagtaggaaattcttaaatttttatgtggaagggcctttaaatattgtttttattaatgcctagacttatcacaatattattatgatattgtttataataagtttactctttggaatgcactgatgctttaattgtgacttaaaagctgatcagtttttgtcagtcttccatgtttgcttgagaaaaaggtagtcttattttcagagtgtaaaatgcagcaaaaatccaaaagatctaccttattcactgtattgtttatgtcatctatatctttatttactttttgtccacctaagctgttttgtactaagagtggtgtttaaacgtctactcttattagtgtttctctctgtctccttgttctcctatagtttttttttaaataaaaattattgctgttatttggtatacatttgtcactatatttgttgtgttttcatcttgttttatgtgtttttttaaatctttcaagttgtttagggggagagggactatttatgaaagtttgtaatttttattgtagtacttgctacaacaacagtagttgtatcatatttagcagaggaaatgtagtttgtcccctgtactgtttggttaaaaatgtaaattaaaaattaaaatttaaaattaaattatacagtcatgtaccatattatgatgttttagtcagcaacggaccacatatacaacagtggtcctgtaagattatattggagctggaaagtttctattgcctagtaatatcacagccatagtaatgccatagggcaacacattactcatgtgtttgcagtaatgctggtataaacaaacctgtgctgctctttgtatgaaagtatagcacgtaacaattatgtacactatatagtacttgataatgataataaacaactatgttactagtttatatgtttatttattatactattattattttagagtatattccttctacttatataaaaaaaaagttaactgtaaaacagcctcacacaggcccttcagaaggtattccagaagattgtttgttatcatcggagaggacagctccatgcatgttattgcccctgaagaccttccagggggatgagatgtggcagacagtgatattcatgatcttcaccatgtgtaggtctaggctaatgggtgtgtgattgtgtcttattttttaacaaaaagatttaaaaaaataaaaaagaaaataaatatagaaaaagcctacagaataaggatataaagtatttttgtatagctatacaatgtttgtttaaagctaagtgttatgacaaaagagtcaaaaagttttaaaaaaataaatagtttataaagtatggtatggtaagctaaggttaatttattattgcagaaagaaaaaaactgtaaacacatttaatgtagcctacgtgtacagtgttttataagtctacagtagcatacagtaatgtcctaggccttcacattcactcaccactcactcactgactcatctagagtaacttccagtcttgtaagttccattcgtggtaaatgccctatacagctataccattttcaaatcttttatatggtacttttaatatacctttttatgtttagatatatttagatacacaaatgctattgtgttacagttgtctgcagtatttactatagtaacatgctgtataggtttgtagcctaggagctataagttgtaccatatagcctaggtgtgtagaaggctgtactatcaggggttgtgtaagtacactctaggatgttcatacaatgatgaaattacctaacaatacatttcttagaacatatccctgtcattaagcaatgcatgactatattaagaaacatgtacttacagaagtgatacgtcttaagaaaagacaataaaaatccattttaactaactttttggtcatttattgtgttaggcattatgttgtatgctttaataatattatgtttataattacaaatttgtgcttcattgataggtaggtagatattatcctcttggaccacctaacctaaatttttaagctctctttgaaaccttgctgattttggaatatgatatggtgttgcacaatcgataactagaacagtggccttataagggctgatctagtatttggaaaacaaatgtatccttctggtttccttacttataatggaattatcaaaaatgatagtggtgtttcgagtaatgcccacttgcctatatctcccagtgtcacttggaggaagttgatgcagtttgagattacaacttttatttcagtggtgcagatgctcacatctggaaaggcacctctttgtttatcagagacatattcttttcatgcaacagtttatatgaagcctttcttaatgattctagtctatactgagcttttcctttttctaatttcctatagctcctaatgtatattttaagcctgtgagtgctcaggtctcacttgccttcgtgttgtcttacattctgaactagaatgaactcctgagatatacttcttttatattcctcgcagcatgtgtatttgtattcctttcctataaccctttaagaaatactttattgactgcttaaggcatgaggccagtcttgatgcaatatctgtcatctcagtgccaggaataccttgattgtagagctccttgccccattatgctgcatgtgtttctgttctcaagctgcctactaggtcaaagaggatggccctcacaggtagagaataattcttcatgtcaacatgtgaatgttagtatacctgtgttctttaaaaacacttgtcacagtgccttcttgattcctggcgattgtggtggactaagagtcaagagactaggttctagtttcagcactgccattaagcagaattgcaaatcacttaacctgtataggttttggctttctagtgtataaaatatgagatttcaactaagtgatctcaaaggttccttctagctctaaaattctatgattttatgaaaatgtgttctccaaatacttaaagctcattgcagaaggtaatgtttcttatagtgtttccaaagtgtcttgcctattgttgtacagttaaggaagttgaaaagtagaaaaaaatttagtgatctggaagaaggagttgtaatacctgacctgtatctggtggcaaaatacttactttcaaagttcctaggatattcatagggcagggtcataagcctcattaaatccgcttgtttactgtttgctgaagggaattctaacacaatccatttatcaatccaggttgcttgtaaaatggagtgtgaatgtgtttgtaagaattttgcatggaatgtgcacataatatggtcactatttagaagtagtgtttcttgtgttcaccatctataaaatttagttttaatcacttctatatataaacaatataaaatttacttactgtaatatctgtatttcattatctccagaatagtgttatatattttagcttaatgatactataatattactaggtggtatagctggtgagactcctttaaagtggatagggtttatgtggatagcattatagtatagattaacatgcatgttattctttccttccttgtgaggttctgctgtatattttcagataagcaaagagactttggaaatagttcctgtgattttaattatttggacttttaaaattaatattttatgagttttacattaataggattattttaaaattatatactttcacttaatttttctttgtctcagtataactatcatatgaatacattgtttttgaactttgataatttgctatatatctagattttgtggatcagttctataaactgttttaaggttctctcagtattatttttcaaagaaaaataaactctatgctaaattttatttccatctaactttgtgtaatgtgttaatactgctattttactaaacatcaatttgtttattaaagtattttaaaattgtttaatcaaatgcattttttaggtgaatagtgttcctattgtccaaataaattcttaacatgggccaaaccagattagagccatattaaaaaattcttgttttgaaatcctatgtaaatgatagctatctgaatatgggctactagagtcttattattattggagggtagtgatggatggaaaatattgaagaaaacagcataataattatgatttagaatccatggtttcgatatttaaaatattttgtgaggcttcttttccagtgctcgtaagattccaaggcaagtaagaagctgttacatatataattttccctgcagaacaatgtgattttttcagttttttattttgaaaatttttaaacatactgaaaaatagagaactccatatgactatcacttttaaattttttatctattttagatggaaatattttaaagtaaattatagatatcattacattttacttaaatactttagtatgtatgcatctccaaaaactaaggacaattcactatattatcagaatgtgattactactcttaacaaacttcacagtcattccttaacgtcaggtacagttttatcttccattttcttctttatcctaaaatatgagaatatagaaatacagattaattattctaattgtacttaagctctctttttctttttttgtgactttttttagtggacttctctgtgccacactttctctttctataaatccagcagcctagatcatgtgatttctttggtcccttttatctctcatagcctctgtctgactcactgggtagaactggttgttagctaaaatctgatttaggaaactgctggtgtagaaccaggtgaatgtgatctctttgatatatatgtacatcaggagagcatgtttcttatcttataaataggaaaacagggattgtgtttatttcaacttatatttccagaagctgttatagagcatgaaacataataagcattcaataagtgatgagggcacaatgagaaattaaatagattaatgcataaatgaatttgttaatcaatgttcaggagtaacaggtcaagccaaccaagtagagctggatatactgtatatagccaggtatagtaactaagtcatttgtagatttcttaaattcccattgggaaagatctacccaatgtgtcaaaagatctttactatttaatatagccattatgattatttccttgcagaaaactcttttagcacattcacatagagaaactgacaatgggaactgctgtgggttgaattgtaccttctcaaaagctgttaaagcatcatgaggaaaaagccctcacatattaatattaaccttgaatataaatggattaaatactccaattaaaatacacagattgccagaatggattttttttaaaaaatgaaccaactatatactagttacaagaaactcaccttgctggtaaagacacttatagattgaaggccaagggattgaaaaagatattccacccaagcagaaaccaaaagcaagcaggagtagccatgcttgtatcagataaaacaggctttaaatcaaaaacagttaaaaaaaaaaaaaaagacaaaggaggttattatataatgataaaacaattcaacaagaggctataccagtcgtaaatatacatgccctgaactcaggagcagccagattcataaaacaatattacgagacctaaataaagagatagcaatacaataataatgggagacttcaacaccccactcacagcaccagacagatcattgagacagaaaatcagcaaggaaactagacttaattgaacattagatcaaaaggatgaaacagatattccaagagctgcagaatatacattttactcatcatcacagggaacattctccaagatagactgtatgttaggccacaaaactagcctcaatacattttaaaaaatcaaaatcatatcaagtgtcatgtcagaccacagtggaataaaactagaaattaataccatgagtaattattgaaactatacaaatacatggaaattaaacaacacattcctcgctgatctttggatcaatgatgaaattcagataaaaatttttaaatttttgaaatgaatgaaaatggagacacaacataccaaagcctttgggatacagaaaaaagcactgctaacagggaagtttatatctttaagtgtgtacttcaaaaaaagaaatcacaaattaaccaaacatcacatctcaaaaaaatagaaaaacaagaacaaaccatacccatagctagcagaagaaaataaatagcaaagatcagagcaggactaagtgaaattgagaccaaaaattaaataaataaataaaaattaaaataaaaaaatcaacaaaatgaaaagtttgttctttaaaaagaaaaactaaattgataaactactggctacactaaccaagaatagagaagttccaaatacacataatcagaaattaaaaaggagacattacaactactaccacagaaatgcaagagatcatcagagacttctgtgaacaactatatgcttataaactagaaaacctagaggaaatggatacattcctagaaacatacaacctctcaagattgaaccaggaagaaatagaaatcctgaagagaccaatacgaaagtagcgagatagaatcggtaatagaaaaatcttaacaaacaaaaaaagccagtaaccaaatggattaattgccaaattctaccaaaagtacaaagaagaactggtaccaatcctactgaaactgttccaaaaaatcaaggaagaggaaattctccctagttcattctacaaagccagtgtgacccttataccaaagctaaacaaggacaaaacaaaaaagaaaacgttggatcaatatccctgatgaccatagatgcaaagtcctcaacaaaaactagcaaaccaaatcccacagtgcattaaaaagataatacaccatgatcaaataggtttcattccagggatgcaagtattcttgtgatgtgattcatcacataagcagaattaaaaacaaaaaccatatgattatacatgcagaaaaaaagcatgtgataaaattcagcatctcttcatgatagaaaccctctacaaaccagacgtagaaggaacatacctcaaaataacaaaggccatatatgccaacatcatactaaatgggggaaggttgaaagcaatctccctacaaactggaataagacaagaatgcccacttttaccactcctatttatcatagtagtggatagcctagctagagcattcatgcaagagaaagaaatgaaatacatccagattgcaaaagaagaaatcgaattatctctatttgccaacaatatgatcttatatttagaaaaccctaaaaactcctgcaaaaaactcttaattttgttaaatgaatttagcaaagtttgaggatataaaatcaatgtataaaaatcagtagtatttctatacaccaataacagtgaagctaagaaccaaatcgaaaaggcaattttatttacagtaactaaaaaaatgaaataaaatacctaagaatatatttaaccaagaaagtgaaagatctctacaaggaaaactacaaaacagtggtgaaataaattgtagatgacacaaacaaatggaaaaacattccatgcttatagatcagaagaattgttaaaatgagcacagtgcccaaaacaatctgcagattcagtgcaatctctatccaaatacaagcatcatttttcacagaattagacaaaaccatcctgaaattcacatagaactgaaaagggggcctgaatagccaaagcaaccctaagcccaaagaacaaagctggaggcatcacattacctgaccacaaattatactgcaaggctatagtaaccaaaacagcatggttctggtatcaaaatagacacatagatcagtggaacagaatagagaaccaataaataaagctacatatctacacccaagtgattgttgatagagtcaacaaaaatgcacactggggaaaggacaccctgttcaataaattgtgctgggaaaattggattgccatatacagaataatgaaaatggacccctatctctcaccatatacaacagtcaactcaagatggattaaagacctaaatgtaagggctgaaactataaaaaatactagaagtaaaacaagggaaagctcttgtggacattggtctaggtaaataattatagactaagacctgaaaagcttaagcaacaaaaatagacaagtgggatttaattaaactgaaaaacctctgcacagcaagagaaacaatcaaccaagtgaacagacaacctgcagagtggaagaaaatatttgcaaacaatgcatatgacaaagggctaatatccagaatctataaggaacttgacaagaaaaaaaaataaccccattaaaagatgggcaaaagacatgaacagatattgtttaaaataagacataaaaatagccaataaatatatggaaaaaatgctcaacatcactaatcatcagagaaatgcaaattaaaaccaactgagatatcatcttatgccagtcagagtagctattatgagaaagacaaaaaataacatgttttctaaaacccagatgcatacatgaccaaagagcaatttatgaccaaaatatttgagcatcctgcttcacaaactgttacatataggcttttttttttcagttagtgtgggaaaatggcatttctgaattttgaattactccttgaactgtgtaaattaaatgaattaacaggtgcccttttttagtggctcttaaaaatcatggaactccaaggggctatgcaggtagcactattgctagcgacctcaaatactatctttgaatttaatagaatatgtagttagtgtaaaccaagtaggctacttccaatgctggttagttgtgttttatgtagacacagcctatgtatgttgaacctttttataatataccaatgacagtcaaattatatcagctaacattttgtgagtgtctgctgtttacagatataccaagctctgataatgcttactgatatactgaaaagtcttgattaggttcagatttgaatcagacaaagaggaagaccattaagccaatgcaatccagatttccctcttccattgcttttttaattttgttaatatacacacacaggttgtgtgtcttgattagattggaaattgagagtatcataggttttttcttataatccttgagaacttgtgtcaaaaggacaagttggaaatagactgtaattggaaagattttctataataggtgaaggtatttttagtaaagaggcaactgctagcctatgaactattgagggaattttccccagaagtctggaaagcctgttaagtcacagtcctatttaatcaaacaggctttgatgttttgctaaaagaaccaggttagaatagaaaagcagatcatgaggtcaaaatgctattatcatttataatattactaaatatacatcaaggttttgttttgatactttaatttatggcagtatttaaggcagtcatagtcttggtcctaatggggcagtagatggaatgacgcagtaatagaggcacagcttttctggtggttatccaatataatgacttcatgagcatgtcattaagtctttcactctcaaaaaatatgaaaggataaaattttcagtttgtaaatatgaatagatagttataagatctaggaggaaaaaatgatccaacatacaaagcagattatttttaaggataagcacatgttgcttccatcaaaacagaaactgctttttacagctcactaaaagataaaagataaactatagttttgaaaactatatcttcatgcttattctaataaacctcatatttgaaaagtaagccagcacctctttaaggttctgttactttgtctacatggaattgtgataaagcactagtatcatttgtagggttttattattggcaaacaaggcagggaaattgaggagaaacaaaaaagtactgtatgataatacaaaacacaaatttgcatcaaaacatagtagcatctttgaggctacatccatgttttaacagatatgagtgattcttgtgaacataaacatgttgctgcttcatttgtcatatagtggtttcataagtatgcatgtaatttattgtgaagatttttgccttatggtatcttgtggaaagataggaaaatattattccctattcaaataagataaatgatggctttttgttttaaagaaaagctttaaagttgctgaatacatatatatactcttcccagtgggtttttcttttttattgattgaagaccttttattttttttgtaaaacagctaactacaatgctgttcatactgcaaagtaactggcctttttcagtttcttgtgaatccattcagtttcaaggtcttctctctttacgcatgatattttctggaacaatttatgaagtttaaaaagtggtgtctagcttgccatttttaatagtcatgaatagtgactttcttcctagtataattttcatcagtctctcattatgagactttaatggacacatttctcattacagcaaggtgtgctaattaagaagatttaattgtacaaaattgtctaaattataaggtggtatattgtacaacaggaaaaattagtttacttaatattgttcttcataagagacctcattttgagagctgtgtatgcatctattctctcatgtgaatcttcattgtggacataaaatagtaaacaaatgtgatttaatgtgtggtcacatcccagtggacagtgacatttgttcacattagtgtcctgcttctttctctgccagctccaaatgtttttctccctgtcttcagcttacattctcctacttcttatatcaacgtcgtatcaagcattgagaaatgcttccatttgagccagtctggctgcttgctactcaggattctcggttgcgtgagaagcaggaaagcagcagattttacccttgttgggaaagaggccctttacgtctttccatcaacttttactctgtcactcagtcctccataaacggacaaaccaggaactagttggattagggtgttagtcaccagtcagctagtttgcttttggtacagaagtgattgagtcattttcttaccaaatctctccttcctcttcttactctctttttctctatttattgaatcatcacttactcagccagttacactgttttcagagttgtctttgactctctttctctcaaccctcttatccagtaactcgtggatctcttctttgtctcccttctgctcaccactgtcctagtccgagttcctgttgattgcctgtattgttatattctcctaaatggactctctgcatccatttcctccttatgatgctgccagtgctgatattattattctttgccagaaaaatccttccgtgacatctatttgcttacaaaaattgtgccccaccttcttagcatggtttccaaggctctctggaaactgatgcaaacctttctttctttctttctttttttttcctggcttgtgttgtgtttccaccaacttctccgccctcaacacacactgacacatgctctggttgccctcttgtatgtttcttcttccctgtctccatctgtggaagtcttagaaattattcagtacccaacttaaatgttgcttctttctctgagtctccctgttagaaatagcctttccttgctgtaaaatttcatagacttttatgcttttgtcagagtatatgttacctctaggcctgtagatgtgcttatgccatctccctttctgctatgtgaggcacatggaaaataactcagaacttctggtcagattgatttaggttcaaatctcagctttgccagttactagaatttatttgttttacatagatcacctacccttactcatccttttttctcattctcaaaagatcttaaaataacttcttagggtcatgaggattaaatgatttgacttatgtaaagtacttaatgctcttacagcaagtatttgataagtatgcattcatttttctttttcttttttgaagtgtatatttcctgtttattatgcttggcactcaggtatctgttaagcttggcactcaggtatctgttaaaaaaatttagttcagtttgtctaattattatcaattaaatcaattaaaatttattcaaaccaactgtgcagaaggccttagagtaggtgctgttatggatacaaaaatgtatatatgacattatcccagtccctcaacccctaggagcctacagcctttaactgtggagccaaagcataaatttaaaaaagctaaataactttgtacattgttaaaatagcagattcatgtggacaaggtgaaaacccagtaaattgccttgtgcttaaaaggatctgtagtagtccattcccatactgctatgaaaaaaaaaaaaatacccaaaactgggtaatttataaagaaaagaggtttaattgactcacagttctgcatggctggggaggccccaggtaactgctatcatggcagaaggggaagcaaatatgtccttcttcacatgctggcaagagagaagtgctgagggaaagggtgaaaagccccttataaaaccatcagatctcaggagaattcactcactatcacaagaacagcatgcgggaaccgcccccatgatctaatcacttcccaggggtccttccctcaacacatgggaattacaattcagattacaattcaagatgagattttgggtggagacacagccaaaccatttcaggttctacatataaaggccattctcttataactcaccagagagaggatttcacagggttctttctttctgtatgtaaatatatatatatatttggagatggggtcttactctgttgcccacaaaatcagagggttctttttaatcattagctttacccatccatctggaaaaataaagcggtgtaaaagcctacaagcatcaggaagcaaagaagactggaagtacaggcttaactaagtgtagaacttgggaatatggcatacctgtgtacaaatctggccaagtgaaataggaaggtgatctggccaggtgaaatatgaaggtgattttctagacggactgcttagtatatgaaacttgtgtttttcatgatcatactcaaaggctaatttgcttttcatcttcattccattctttaatcaaggctgtgatttattgacccctctgtcataaattggggagaacatgtatatacatgtatgtagcaactttaaaggcttttcttcaaaacagaaagcaatcatttattttaatagggcataatatattcctattttttcaataacataccataatgcaaaaatcttaacaataaatcaaatgcatatttacgaaaataactatatgacaaaaagggaatgaagcatggaatgaagcagcagcatgtttatgttcacaagaatcattcatatctgttaaaaaatatatgtagcctcacagatgctactgtgttttgatacaaatttgtgctttgtattattatacagtacttttttgtttctcctcaatttccttaccttgtttgccaagaatggggttcttggggaggctaatactgagatagaattaggagggcaagggctttttggaggcaggaaatctaatgcccatgtaagataaaaggggaggaagcaggattgaacagggaaggcttccagagcgggatgttgatctgacacttgtgaaaggaaagggaaccagaggcagaattgaggagggagagcttcagacatgatgcagatctgacaaaatctcagtgcccactcccgacattggggagctccagagcaaagcttgcctattaggagagaccccagctatgtagaaatagtcacaccctctccatgatcaactgcccaggaagagtgtggccttggtgcacacgctgtggtaggacccagtggtcctgcccctagtggatgtcgacttattgcattccttacaagtaaagggccgcttctttcttgatgggattacacctcagtggctgcaacactacattttcaatcacaaagtatcaaaatggaaagcctgtaaaagcgttagttaaaattagttgtttattggaggagtcgagaagttcactaaaataacaaaacccttggacaggctggccttagtgagtgttgagtggcttacgttgtttgggaatatatttttcatctgttaaatgttgataatgacatccatcttccctatctacctcacaaagttataaaaaaaagtaatgtctaagaaaggcaagaaaatcatgtgagagtcaatacagtgtaatagaaaaatctctgtgtcaaggtgaagggaagcaggtaaggctgtccctcgtactcatggagaagggaaatgatggctacattcagaaaaagtgcataaaaggacaatcatttgaaatgcattaaggagtctgggcgtggcagctcacgcctgtaacccaccattttgggaagctgaagcaggaggattgcttgagcccaggagttcaagaccagcccaggcaaaaaagtgagaccccatctctattttaaaaatataaaaataaatgcatagggagtaactatttatatattcctgtggctagtcttactacaacgcaaataatcacacctacctgatcctggtataaatcttgagttccacagacaggcctgtttaaaactaggggtattacacatatttacaattaaaatgaaaaatattagccgtttgtttttgatttcacagaaaaaaaaaggtaatatataaaaaactttgaaccaaaacaagttttattttagattatagattggcaactttttctgtaaagagccagaaagcaaatattttaggcttttatgagctctgtgggtcacatatggttctctgttacattttcttctctttttctttccctttacaattctataaaatgtaaaaattattcttagctttagggtgtataaaaataggacctagactgtgacccctactatagatttagttctgcacaaactcatttttgacttcaacataatttcagaagttgacagaacccttaattctatattgtatttttgaaaaaagagaatggaatttggaagtcatatcagccaggattcgaatcctgctttcatcctttacaagctctgtgacttgggcaagttatttaactgctgggatgctcagctttcttatatgtaaaataaaaccagtgctaccaggctggatgtgtttgtctagatttaatgaaataatttgagaaaggtactttgcccagtgattattagataatagaacctcaaaagatattacttcatttcttcccttcctttacttatttgatggtattttctagccttccctcccccacatctcctttgttctagcaaaattctagactgtctttctctactgagttatcttagtagaactctcagtgtgacctaattgtagtctgtaggggtggatagaaaacttctcttccacgcttctctgaagggtcactggaatgagctgacagtatagtaacaggaaaaaaaaaaaaggcctacaaatttattatgtacatggacacgggagtcctgaaaatatgagactcaaagaaggtccagatggttgaggcttaaataccctcttcatatggaagagggaagtggggaagtatatgcaattttagaagcaaatgacttttaggggaagtgaatgagcccaaacaacagactactggcctcggacaaagttgttctgagctctgggggacattgcagcacattgtgggaagctgaagggtggaacttcattatgaacacaagttgtcttaatatgtagataaagtcttttaggtaatctcttggaactgccctcagaagaataaaagcctgtctgggtgtggttatgacttttagtcttttctttggtgactaatctttcctggttatttgatgagattcctggggaaggagttttaagacaattgcatttctaggccaggcacagtggctcacgcctgtaatcccagcactttgggaggccaagggaggcagatcatgaggtcaggagttccagactagcctggccaacatggtgaaaccccgtctctactaaaaatacaaaaattagctgggcgtggtggcacacggctgtaatcccagctactcaggaggctgcggcaggagactcacatgaacccgggaggcggaggttgcagtgagctgagactgtgccactgcaccactcctacctgggcaacaggagcgaaactccgtctcaaaaaaaaaaaaaaaaaagacagttgcgtttcttctggaagaacttcccttaatcagatgatggaacttcagagagagcccctcctgctgcttctggaaagaaagaggaccatagagactttcatgcgggtccgtgtgaagagaccaccaaacaggctttgtgtgagcaatatggctgtttatttcacctgggtgcaggtgggctgagtccaaaaagagagtcagcgaagggagataggggtgggaccgttttataggatttgggaaggtaatggaaaattacagtcaaagggggttgttctctggtgggcaggggcggggtcacaaggtgctcagtgggggagcttctgagccaggagaaggaaattcacacggttaatcacttagttaaggtggggcaggaacaaatcacaatggtggaatgtcatcagttaaggcggggcagggccttttcacttttgtgattcttcagttacttaggccatctgggcgtatacctgcaactcacaggggatgcgacggcttggcttgggctcagaggcctgacattcctgcttccttatattaataagaaaaataaaacaaaatagtgttgaagtgttggggcggcgaaaatttttgggggtggtatggagagagaatgggcgatgtttctcagggctgcttcaacaggattaggggcagtgtgggaacctagagtgggagagattaagctgaagggaggtcttgtggtaaggggtgatattgtggggttgttagaagaaacatttgtcatatagaatgattggtgatggcctggatacggttttgtatgaattgaaaaactaaatggaataagagaaggagaaaaacaggtataaaaagtctaagaattgggagagctaggacatctgattagagagtgcctaaggagattcaccatagtcctgccagcaaagattatttatttacttcaagagtttagagtggcagtttggggatagcaccaggagataccagctgtgatggcttggagaaacagtgtaaaccagcagtgtaaacaagagcagggcatgtatgagtagttgagaatggtgaataggagtatgactagacaaaagatagtagggatgacaagtttttttggggcacagtctaagttggtctggtgtccaatgagactggggcctaataaaaaggagcgtctatacaggagcttaaatgggctgtaccttgtagcattctgaggacaggcctgaattctgagaagcgaaagtggtaaaagtattgtccagtcctttttaagttggtggctgagcttggtgaggtgtgtttttaaaagacctttagtccgttctacttttcttgaagacggaggaccataagggatataaaggtttcactgaatactgagagcctgaaaaactgcttggctgatttgactaataaaggctggtctgttatcagactgtatagaggtgggaaggctaaactgaggaattatgtctgacagaagggaagaaatgactgtggtggccttctcagaccctgtaggaaaggccattacttattcagtgaaagcgtctatttagactaagagctattttagtttcctgactcgggacatgttgagtaaagctaatttgcccgtcctgggtgggggcaaatcctggagcttgatgtgtagggaagggagggggcctgaataatccctgaggagtagtagaatagcagatggaacactgagaagttatttccttgaggatagatttccacgatggaaaggaaatgagaggttctgagaggcgggctagtggctcgtactatagcatagcctgcctttgctggtgtgtggcgattaggcctggtggaactgccatcaataaaccaagtgtgttcagggtgagggacaggaaagaaggaaatatggggaaatggggtgaatatcaggtggatcagagagatacagtcatgggggtcaggtgtggtatcaggaataatgtgggaggccagattgaagtccgggccagaaacaatggtagttgtgggacttaaagagtgagttcagctgaaggagctggggagcagaaagtatatgcgtcaggtatgaggaagaaaatagattttggaagttacgagaaatgtagagagtgagttgagcatagtttgtgattttttagggcctctaacagtattaaagcagcggcagccgctgcatgcagacatgagggctaggctaagacagtaaggtcaatttgtttggacagaaaggctacacggtgtggtcctggctcttgtgtaagaattctgaccacactaaccatgcctaggaaggaaaggagttgttgttttgtaagggattgaggttttggagattaattggacatgatcagcagggagagcacctgtgtttttatgagaattatgccaagataggtaacagatgaggatgaaatttgggcttgactgaagtaacgggggctgtctgtgaagccttgcggcagtacagcccaggtaatttgctgagcctaatgtgtgtcagggtcagtctaagtgaaggcaaagagaggctgggatgaagggtgcaaaggaatagtaaagaaagcatgtttgagatccagaacagaataatggattgtagacggaggttttgaggataggagagtatatgggtttggcaccacggggtggataggcaaaacaatttggttgataaggcgcagattctgaactaacttttaagccttgtctggttttaggacaggtaaaatgggggaatggtaaggagagtttataggttttagaagcccatgctgtagcaggcgagtgataacaggctttaatccttttaaagcatgctgtgggatgggatattggcattgagtggggtgagggtgattaggttttaatgagatggtaaggggtgcgtgatcggtcgccaaggagggagtagaggtatcttatacttgtgggttaaggtgggggaatacaaaaggaggacgcaaaggaggctttggattgggaagaacggcagcaatgagatgcggctatagtccgggaatagtcagggaagcagataatttggttaaaatatctcggcctaataagggaactgggcaggtggggataactaaaaaagagtgcttaaaagagtattgtctaagttggcaccagagttggggagttttaagaggtttagaagcctggctgtcaatacccacaacagttatggaggcaagggaaacaggcccttgaaaagaaggtaatgtggagtgggtagccttcgtattgattaagaaggggacggacttaccctccactctgagagttacctaaagctcagcatccgtgatggtctatggggcttccgaggcaatcagacagcatcagtcttcagccgctaagccaagaaggagtcagtcagagagccttgggccagagttccaggggctctgggagtggctgccaggtgagttgaacagtccgatttcccatggggtcccgcacagatgggacacggcttaggaggaatcctgggctgcaggcattccttggcctggtggccagatttctggcacttgtagcaagctcctgggggaggaggttctggaggaacgcctggctgctgcggttcaggcgtttggaagttcttgtgtgctggagatgtggctggggtttgtctcacagtggaggcaaggagttgcaactttttttttattattgtacaccttgaaggtaaggttaagtcctgttgtggggtttgagggccagattctaatttttggagttttatttaatgtcgggagcagattgggtaataaaatgtatattgagaataagatggccttttgaccttttagggtctagggctgtaaagcatctcagggttgctgccacacaagccatgaactgggctgggtttttatatttgatgaaaaagagcctaaacgcttctgatttgggataaagaaaaatgagcattaaccttgactatgcctttggctccagtcacctttttaagagtaaattgctgggcaggttggggagggctagtcacagaaggaaactgtaagccggaccaggtgtgaggaggggaggcgataaaaagattacagggtggaggagcagaggctgaggaagaattgggacctagcttggcctggtgaggaggggagaggtcacatgggtctatagaaaaggaagattagaaagactcagcgacgcttggggttgggactgaggggacaggcgggagggaaagaaggaagatttgggatgagttgcactgggcacagagactaggaagggactgatgtgtaaaagaatgcctggacgtcaggcacctcagaccatttgccccttttacgacaagaattatttagatcttgtaggatggaaaaattgaaagtgccattttccggtgtttggaactactgtcaagtttgtattggggtcaagcggcattgcagaagaaaataagacgcttagattttaggtcagtgaaagttggagaggttttaagttcttaagaatataggctaagggagaaggaggaggaatgtaaggtggaatcttgcccatagtgaaggaggcaagcccagagaaaagagtagagacacagagaaggggtaggggttccttgccctccagaaaagcagagaaagggttggggcatggaaataaggaattggggcacagagataagaggttggggagcggaaataagggattgggggttcttgccccctagaaaagtgggacttgctgctaagggtgaaggagaaggggttgaggggtacttgcccctcccccagaaaagtgggacttgccactaagggtgaaggagaaggggttgaggggttcttgcccctcccccagaaaagcagagaaggggtagagacaaggagagaaggggttggggtacttgccccttccccagaaaagcgggacttgccgctaagggtgaaggaccaaggcaggtgtccctgcgtggtctgacacctttgaaacgtgggtgaataatcagagaggtgtccctgcaatgattaaacatcaagggaaggctgccgtcccagtccgtgaccggcaccggagttttgggtccatggataaaacgtgtctcctttgtctctaccagaaaatgaaaggaattgaaattaagagaagggagagattgaagtgtggtgccaagattgaaaggagaaagaggttgagggatagtgagggaagctggagaagatagtaaaaagaggccgcttaccggatttgaaattggtgagatgtttcttgggctggtcagtctgaggacctgaggtcgtaggtggatctttctcatggagcaaagagcaggaggacaggggattgatctcccaagggaggtcccccgatccgagtcatggcaccaaatttcatgtgtgtccgtgtgaagagactaccaaacaggctttgtgtgagcagcatggctgtttatttcacctgggtgcaggcggttgagtccgaaaagagagtcagcgaagggagataggggtggggccgttttataggatttgggaaggtaatggaaaattacagtcaaaggaggttgttctctggtgggcaggggcgggggtcacaaggtgctcagtggggtagcttctgagccaggagaaggaaattcacagggttaatcactcagttaaggtggggcaggaacaaatcacagtggtggaatgtcatcagttaaggcggggcagggccttttcacttcttttgtgattcttcagttacttcaggccatctgggcatatatgtgcaagtcacaggggatgcgatggcttggcttgggctcagaggcctaacagagacagcgagcagaagtacagagagagatcttggttctgaggcttatttctgaggcctttcagtttcctttaatttaaagttctggctgggcgcagtggctcacgcctgtaatcccagcactttgggagaccaaggtgggtggatcacttcaggtcaggagttcgagaccagcctggctaacatggtgaaaccccatctctactaaaaatacaaaaaaaaaaaaaaaattagccaggcatggggctgaggcaggagaaactctggaacttgggaggcggaggttgcagtgagccgagatcgcgccactgcactccaacctgggtgacagagtgagactccatctcaaaaaaaaaaaaaaaaaagcttttagcatgccaaagtgctgtaatttggaatattattttctgagccccaacaggtcaaattaatttgtcaacattttgattactcgggacagattagtgacttgacttcttcttatgtatagtttctactcaccaaaggcagtcattcctagatctctttggtagtgccccataatctatattttaaaaatatattaatatatactagtaacaaaacttccatgagaatcttagagaatatttcgtagaattttctacaggatatttatattattttatatttatatttatatttgtataaatattttgaaccgtatgctaagctagtggataaaagtccaaactaggaaaaaaaggtttatatgaaggttgagggtggggatggatggttgttcattttgctaaaggagtctcaactctgctgttttcttcaatagcttttcgtgattatttgaatcctacctgtaacttcctatgaagacctccaagaacatttctcattggttggaaaacagcaagtgttgttggagagatttctttcttagagtgcatgctcctcaaggttgcacccatgcatgttgtaaaatgtttttaggtctgaaatactcatggactgaaacagtcagtaaatagctaatgtatgtctactttgtattgttagctttttgtctatttttttttcttttcttttttttttttttttttttttttgagacagagtcttgctctgttgcccaggctggagtgcagtggcacaatcttcggctcactcaatctcagccttttgagtttaagcaattctcctgcctcagcttcctgagtagctcggattacaaatgtgcaccaccatgcctggctaatttttgtatttttagtagagatggggtttcaccatgttggccaggctggtcttgaactcctgacctcaagtgatctgcctaccttggcctcccaaagtggtgggattacaagcatgagccaccatgcctggccaggttttcatctttatattaaatgtaaaccctatactgcccttcaaggtttgagcaacctagcacaacccagaggcctgtagcttagtgatgacaaagacagccttaatattccccttagcttgacacaacttgacagtcttcttcctgactgtaggcccctgacgtctcttttcttagagcattaacttaagaatacttgaaattaaaaattcttttctttccctttgagatacaagttttctatcagccacctgccagttgtataacccaagatggtcattcctttgcaggatattagtcattgtgggaggtaggagccttagtaccaattagcaaacatagatggcgtgatcacattgaccagccttgctgtaacatcctctggtacttttctactgtctcaccccagtgctttaaaactcccaccttttgtttcactgaagtttagttcaaactctcatctatattgcactcgcctctctcctattgcagtagtctcgaataaagtcttatgtttttaacttgactggtactattgccctttgacagtgattgagagtaaaagctctagagtcagaattgccatagattcctgacttcattttactacacaagccacataacctcactaaacttcagtttccagatgaataaaatggagataaggggacttacagcatcagcggatgtaaggcacttagcatactgcttggtgcatagtaggcacctcataaaatttaagtcttatttctttgtgctagtgagtacataaaacagcttcttgatagctcttttttaaaatagtaaactattatattaaaatacaattccatttgtgtaattatcagtatgttcatttttctgatatctgctttgtaatgtgaagcctgtttagttcttgaaataaagacaaaaatgcatcagacacagtgaaagcaagcaacctgttccatatctgatcctgatatgtctagttaagttagggcagagagatcaattacttctgaggccatgttaagaaacagcatctgtgggaaagagagacaaactgaaatatttgttttcagacagccttgcaagttactccaacaaatgaagaaaactctgtgctgtttatattttaaagtttaaaatatctcttactgagcctatcctaaaaccaaaaacttaaactaaaattcaaatgcagaatttcctcttaatagatacattttaaagtgcagattgtatggtaaatactctattgtcttgaagctgcattatgaaatactgcctaaatcccttaattttaaagaaatgtgtatgaaatgatacattttccaagttgaaactgctttctttttctggggagggggaatggtaaccacagttgggaactactattttctgactacatgtcacagtaaatgtctagtcaaaacacttctccattcagtatatggtctgtctgtaaaactacttctcccccttccttttctctccaaaagtaatctgaggtaaattcacttgaattgctatctgacttttaacaatctgtattctgtttggagaccctgcttgcaattctaactgacttagaaaggtaacagtgataatatggattcatatgaaaggtcaaaagttctgcattgatgttccattcataaatacagataaaatagtggtgtttcttgtgttttggttgagtcattacctcttacagtctcttcactatcattatgtttcctgttaaaggagactcataacattaggtttacagttgacctatgacaatgccagggttaggggtgctgacccccactcccctgcacagtcaaaaatttgcataattttaatttttgactccaaaaacgttactaatagtctactgtttaccagaagccttcctgataacataaacaatcgagtaatacatattctatagttacatgtattatacataccgtattcttacaataaagtaagctaaagaaaagaaaatgttaagaaaatcataaggaagagaaaatatatttactgtttattaagtggaagtggatcatcatgaaggtcttcatcgtcttcacgttgagtacgctgaggaaggaggggttggtcttgccatctcaggtatggcagaagcagcacaaaatccacatataagtggacctgtgcagttcaaacccatgttgttcaagaatcaactttatctttttagaatgtttgctcttatctccccttcctgcttgaaatagttttatgtttcagggaggggttacaggaaaaagcagagcctcctcaactgtgtgaatacagataaaaagacatattgtggtttatgatgtctagatgcccacctggagggaagggaatttaggagcaaaataaaaagattaaaaatctaagtcaactcagaaataagatatgccaatgatgaagaaaggatttaagttggaaagttagttgttatggcccccagttgtacatattttatcctaaggcaccatttggtttaataaaatgtagatctgaggctgttcttaacctatcagtttcttaagacttaattataaaggttatgttttcagaggacaaaggcattattcatttgtctgtgcttgtcttccaggtttatcttgcagattatggactttcctacagatattgtcccaatgggaaccacaaacagtatcaggaaaatcctagaaaaggccataatgggacaatagagtttaccagcttggatgcccacaagggagtaggtgggtttcttttttctttttcttatttttatttcagaagaatgattagagacaagggtaatgaggctgcatgaaatgacctttgcatagtcagtttgaagcataagagcactggtgaggtttttatcaaaagtaatgaattcctgttatgccaatgaatatttcttctaacagtggaaagaaatttagactgtgacaagtggtgaaggagcaaaagtgtgtcaagtaagcaaaacttgctgctcattttagccagaaagccacagtttgtataggtaaaacttggaggtcagcagtgaatgtttatactgaagtgaatattacagatttggtaaagttgcatgtgggccaggtgcagtggctcacacctataatcccagcactttgggaggctgaggcaggaggatcgcttgagtctaggagttcaagaccagtttgggcaacatggtgaaaccccatctctacaaaaaaatacaaaagggttggcacttgcctgtagtcccagctgcttgtgaggctgaggtgggaggaggatcacttgagccaaggaggttgaggctgcagtgagccataatcacaccactgctccccaacctgggcgacagagcaagacccctcagaaaaaaaaaaaaaagttgcacatacgaacaattattcctgtttttccattgtacctttaccaaagctttagaagatacatctctcagcagtaaggttattttttctgaaaccataaagtgttaatttgtggaaatctctcccagtcgcctttcatatatcttacttatttaaactcactttgatggtattggaaacacatttgcaggtaaattacatacatagtccttttattggatattgattgtactgccttgcattccaaggcagacttaattcaacaattccctaattagttaaagtcataacctatgtcttgtattcatttaccattaattaaaccttagctgtttattacactgcagtccaaatccaatagccgacccagaaagccatggaaaaggaagtaggaggtcaatattgaaaatatatggtgccgagtcccactgatggttgctttgttcacaatcaatatggtcaatgcaactgtactttcttagttgctctgtcagcaacacaaaaagtcaattctaatgttatgctagtgaaaaaatggtgattattgaaaaactttggctttcaaaattatattctttgtaaactttgtttataaaagtattttcaaatatgctaaaccaaacaatttttaaacagttttgaaaggaccacatttttactaaaagacaattagatatttgcacttcttaatggttgttgaactgttaccctaaactgatgccttctaacaagttttagttggtgaagacaactgtatattattgccttttctattaaaaggaccattgaccatgtaatgtagagggtcttgatcattttgcagggcattaaaacccatactagcttaaggtaggccaatgcaaaagtaaaacaagtataacttcttcctttcagaaagattcataggcttgattttctgaaacggaaattatcttttatattcctgatcaaagtaaaagaaatgactacattttttttcaagtatagtttggttagaaaagtaataatcagtaagaaattttgtagtgttgtgtgatttttcagtattcatattgttaataaattagtgagaatttaaagataatatgggacgtatcttacattaagaaatgagaattaaatgctcaagaaatgtaagaattaaatattttattctgttacacctaatagaatttttagaaacagtaagtacttttttgataatggtataactggaaattcatcatacaggttcttaagcattggcccagttatattaataatgataccaacttatgtttgagtcatttatttcaactggtagctctaaactgctctgatctagttttgagtagtggaattgctaagaaatcactgtgattgtggaaagagaagtagagtttttttgtgttggtatggtcagtgtttggactgtggtaaatctgaaagacctattcaattaatttcattgtttagggtgtcgttttcattgtgttgtcttcttgaaagatttgaacacatttttattttttagtctacttatattttttattctaaaatcttaatacatgttgaatatgttggtaagatttcaccaccctcggtctttggggagaagactgaactgagaatgatcacagaatgatcacagaaagatggtgttacatccctgggggaggtatattcagggaagaacctacattaaatatttttgggatttgctgaaaagttatatgatagaatgaacattcatttttatcaaaggttttaccagattcttataaaatagtagatttccttaatgcattttaaataggatttacactaaaattctaggcatattgatatatatatatgtagatacagatataaatatagatatacacattacatatatatgcacatatgtacacatatatacacacatatatagatatatacacccacatatatatttgctgacattttaatgtgaagttttagtctgggatataaaatggaatgtatgacatcctcaaatgtctgaatactgttcactcctatgttttacatttaattttccaaagcaaaacatttcagttgaggattttattagaaaataaataatcatttagccatatctagaaaccagaataaacaatgccataaagcctataggaaaatgcaggtcagattcataaatattcatgtgtttactttcagtacagccactatgtaatctcagaaaaatctttttttcagtccaactatgagatcaaatactgaggaaaaatagtgcaaaataaagtacaaaaagcaaaaaaaaaaaagtcactaggatatagaacttctaggtgccagagcatttgccaagtgtcaggtctatttcttggtcaggccaagagacctgaagagaaatactcaagcttcaatgtaaaactgacttatgagttagccactcaatagagactgctattagcctgatcagactgtctgttctgtgctactttttgtagcaggttatttaaaaactcaagctaaatctcatttttctatggattgagtttttataatgaaggaacttgtataagctgccattcagtcattacatctaagcattttctaattcaaatttacataaaaggagagtagttgaaagggaaaaaaattagctattatgttattaccaaaagatatgcatggagatgtatcgtgatggatggacagatggatgaatggatggataactattcctagaactcctgtacatctgcatatctgtatgtttttttaaaaattgtgtttattcttccaaactcaattctcttgtgtgacctacaggtattttgtaagtggctaaagtgcatcatttagtataaaattagagtaatatatgttgggcttatttcttctataatttttttattctttataaaaactaacatgtataaacactgacatattttgggcttattgtctgataattaaagagaattatatttgtgtcaaatatagtattttaaaattggttacattcttagtaatgttaaaaagcaatatttgaatcaatgtgtggtatagatttttgtagatttttctactcactgaggcatgcagtcaatacctaatttctctagagatatactgcatttaacatattgagcttttttaaatacttcagacctgtgcattgagtctgtaatacctatcttaatttgacatctttgatgaccataaaatatgatatctaaattgtattttaaatgtccatttatctaatatgtttagtatcaaagaaataaatatattgcatacttttttttaatttttgccaattgctacggtatgtgaaatccaagtcttgtgttatttctttcatggtttcatttcactctaatctagcactccaacttacaaaatatatgtgaaataaactgagaatgtattttcgtgctaccaaacttggggaaatgacatggtttacgcaatacttatgtcttggccttttgattgggttaagaatacttacattggccaagtctaagatacatttgctctattgaatgacttttcctaagtttcacacacacaaaactagggcttaatttaaaaggtactgaaaaaataagagaggcctgggtttaatattttatctgaaatatgacacattgcatcctaatatttcctgatatcctttttgaaattgcagtaagtcatggtcaccataaaatattctggatctttatacatcagaattgacaaaatactgaattacataggttaccagttggaaaactaagaatagactttaaatttgttctgcagatagtcaccattcactttgtcaggtgaacatcttattcagatgttttctgctttcttattgtctttctgagcacacatattaatattttgggcatttgaactctgcttgatgcagaaattttcaagttcacttcattatttcctaccgaaccctgtttttcttcatactccataatgttactcggtataagaaataaacagaaaacactttaggcaaacagggagataaatcttggaattaatacttagacttttctttttctcccaattcctctttcagtccatttggtgaattgggctagttaattttattccagtttgtctttaaaccaaggactagttcgctaagataacttatctgttgttcttataccagtttagaaggaccgtttgtcactttataattaaatattttaactaaagatccttctttattggaatgaaataacttgaaagaaatagtttcatgaaaggatagtaacatgaaaaatttggtcagtgctgcagcttagatatccagatcttccactcatttattccttgccaaaacaactatttttgtgtcagtatgtcttggtgctttaagtttaaatgcctgcttcaaataccttcctcactatggaagtcctgtgtgtaatgttgtttgaatggtattaaaactaatgatggaggcaaagtaattattatttttttttctgagatggagtctcgctctgttgtccaggctggaggacagtggtgctatctcggctcaccacaacctccacttcctgggttcaagcaattctcctgcctctgcctcctgagtagctgggattacaggtgtgtgccacaaagccccgctaatttttgtatttttagtagagatggggtttcgccatgttggccgggctggtcttaaactcttgacctcaggtgatctgcccacctcagcctcccaaagtactgggattacaggtatgagccaccgcgcctggcaacaaagtaattgcaagattgagcacgggctttggtttttgaaagacttggatttcagtgctgagctctattaatttttgctctgtgatattgaccaaattatttaacctctctgagactccatattgttacttgtcaatagggctaatacttactttaaattgtttgaaagatgagatgaaataataaaaagcaggtagagtgccaggcatagtagcggctctccataaatcacatcaattgtttttattttaattatgcgttctactatcagccatttctaaaattttctttctagttaaatagaatttaaatcctcacctgtgcctatttctttctaattgtttttactttggcaatactttataatttagaaatgtagaacatttgagaataccacaggctttcaacaaaaagagtgatgtatattactgcatattggtaagctcaatataagttagatgctattaataatatttagaaactaacttgagaaagtttagaaatctaaactaaatctcattacagttccaagcaataataagtaaacacttcattttaggacatctgcatgaaaatatactgtccataattacattaattaccaaatgccactgaagaaccctatgtattacaataaattgtgcaaatacatgactcagaaacaaaacagtgcataatgtattttctattcaaatgaatgaaaatatattaaaaagaaatacattgcacagtatcatctgattttagagctgaaaatgtaaaatattagtggcagggatagaattggatctcattcctagtccagagctctatttactgcttcacttaatatgttttaaaatgaatttgaaaattgtataattaaagaagcaactttcaaattaaaaaaaaatttttatagttagacattaatagtctcagactataatcaattctttgtgtaaactatacatgcatacatagattttaatattgtcatctagaacatttgtttttaattaatttaacaggtattaaaattactcctctgtgtacagtagatggaaagaagacaatcattggcaaagtctaagattttaacttcactaaacattcaaacttttcaatttgcttttctgagagggaatttcaggtagaggtatgtagtcagaaacatttttagtcactcttcagtgtggggaaaggaaagggtgactattgggtgttctttttatcactgcatgcatttatgcaggacttatcagaaacagtggcaaaacattcacctaacggtagttattaataccgatgtgcaaaaaagaaaataaaagattgaaaaatgtgataatgtattttaattaggtaagaccaaactataatagtgaagtaaagttaactctcaaagggctatttcaaatgaagaccagtttatgaaagattggcttcagaaatctaaatgacttgtcattacttacagcttcatatcaattaatccctcaattggggggtagggggaaatggctaggaaggttcaatctattttaattctgattatttttcctcaaagggcctcttgtgtgtagcttatatcatccaaacactgtgccagaatatcattttttgaaaattagaggatatgagattttttaagtgatggtaatcaggaattgccataatagaaaggagacttgtgaacacatctgtacaagtggaaccattccattattaatgggagatttattactgaagaaatcactacagaacactgtggtagagattgtgtttttattttaatatgagagccaagtcttgcattaggacattgttgaagcttgtgcagaaagtaaatggcacccatgggactgtagcattctgctagattgaagggcctttaataatccaatacgctaatagcagttagagtgtaagagctaatcatgtcttctgcttttataataacttatacatggtaaccaaaagtagttacgatgtgttggcatcattgttcttagtagatgactttttaaattaaaaactaagttcactgagtaacttttcagagtttatttcatgaaagataataaaataggatacctgtttatagcaggtttaacagccacttactgctcttaggagattatatatccctacacagatgaacattcgagtaatgacagaaatgtaaataccagcctattgttttataacaattttgaatgactacaaaaatgagtttattttacgggtatttgctgatgttttaataattatttcagtggtttgttaatatgtatcagttatatttcatacatttcctaggtttcattgtccatcttcttatataaggtacttataaatatatataaattatgaaattagactacagcatttaataggttgatataaaatgatacaagggcctgaaaatgtgcttttaacgtactttttaggaaaaggcatcttattctaaattttgaaggcctctatttggctctccccccagcctctgataccattgcctccgttttatatagatatgggaccagaattttagcctgctgctgcttatatctaaaaataatatttgtaaaattatccaaagcagtagatatatttttattgtattttcatgtgattgaaaaatcttcagaaagaccctttttttaatactgcacactagatggcagttttgtcatattcttccaacttcaaatgctgctagtgtgagtggaacaggaaaggccatcaatgtttagtctgcactcagagggtctctgcatgaccaatgcagaccctatggacttcctggaacatatgttagtaatttagctgcagacatttatttctttgttttactgcttggctctttgagaaagtgttggtgctgggttatgggttgtctggatcatgtcagaggccatggggatcaagttcatgtgacaggccagactaaggaaagatgaagttggaggaggtgaggaaactgacccttactttcaacagcaaccagtcactgcctgtctgtggactggggccaaatgcttgggcgtttaagttttattccagctgaacaaataaaacattttgcctatttggctttttcatatttcatcagtagtagttcaaccaaagatttctccatttctcaaggacttgcttatcccttatctttctctctaatgcttactcctatagccttgtccagacgaagtgacgttgagatcctcggctactgcatgctgcggtggttgtgtgggaaacttccctgggaacagaacctgaaggaccctgtggctgtgcagactgctaaaacaaagtacaaattttcaagtatttcatcatgtactgcaccaggtctgaagggatacattaaagggagctaacaacacagagaagattggcattcacccaacatgacaaccaaagcaaatttctttagtttgaaaaatatgttttaaaaaaaccaaacaactaacacataaaatccattaaggtaacattgtaaaaagacatgtatttgaattacagtgcaaaatataaagtgaaatatctgttcttttacatggtatttccaaagcttagattctaggtggtagtgttttcaaggaagaatattttcaaattagcattgtacaagtatgttgaagtagtctgagcttggtacgattgatattaactgtgtaaaacagcactatgaaatgggacaaatagggcttatatttttcaagtgagagcaacatacctcttatttctgtcttggaggaagtatgttttctttcttaagaaacaaaatttttacatgagctatttatatgagataatcttgtagccacataaacatttttaatattctacattcagtttttattacctggattcggctagcataaaaattaggtcagactaagaacagggtgtgttactgttttacaattctctcactgatcaggcctaagaaaaagtcaattgcatagagcacagaatagccagtttttcattatataccaagatatgctcaacagtagttatccacaggtagcaaaagcagcagctaagctaagttttaagtaggaaaatcacaacagaagagtacaaagccaggggaaaattagctgattcatagaaatctatctttaaattcagtgtggcatcagttcttaatactgagaaagattagcctgcagattcagaaaaatacatattacatttgtaaatactgacatatatgaaacatttctccactcagaattttgatcatcctagtcccttacccaaaactaaaacatttatataaatctatattagaactaaatcagttatttactgcagtgattgatgtgtccatattaactttcatgtaacatttcgaaatatgggtcaagtcaaaacacagtgatgtataaacagtttttgtatttaattttccaactagtttacctaattagaatactgtaataaagtaatgatgctattttaaaaaactaacattttaattctaatgattatatatttgttttttgataagactaatatgacttgctttaactttttatcaatatgcatatacagatacattcattataggtatctataatgaatatacctgcttatgcatatttataataggatgtcatataaaattattattttacatgtataatgctaataaatcaagcataacttctatttacattttggggactcttacatatgttaatatcttcattttgacttgattaataatgtaaacctatagactagtaaagccaatatcatattatgaagtttataattcagataaaccatagacattttcaaacttattatagtacataatacataatcataatttattcaacttgctgagaaggtatgacactgaaattccccataagggtgtgattgtatattcagccaagacactgtatctcccttatgccttttattttcctgacatagcatgctgctggatcaatgtgtgtattgttgctactctgcctatgccagaggtggtgactcactcacacatataaataattttagttgaatgtttttataggttgtgtattccttacttgaaaggcttgggaccagaagtgttgcagatttcagatatttttagattttggaatatttgcattatacttaccagttgagcatcccacaaacctgtttaatcatgggacagcataaaatattgcccagtggagaacaatgcacatatatacttagatacaatgtttgcgtgaattttttattgttgtttttgagaaaaaaaatcatggtaaatattactacttctgtgtttctgcatacataaactttgagttaaagcatttatattataattcctgtaattccatcttgtttagtattggggcccagagagcaataccccaaagtgtgatgctttggcatgctgagacctttgaactgaaagagactggatggccccagaagccacctcagaagccaagtctcactctgaccttctcctgccctcttgtttcccatcccttctcctcccaagaagagagtcatagaaaccagaattcctcttccccaaagcgggttatagaaactagaacccctgtaccccaagcaaggcattaaacttaggaaggtcaccctctcccttctccctttaagaccctcattccaaaggggtcctgccccatccccaggaggaataaatgctacatacatcaagaatatggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaatatggacaggctttgctggatccccccgccccagttcagtaccattagaacatacccttttgtccagtcacattcctacacagctgtctattcttcatcaaacctaagcataaagatagacttccttgggtctttggtcttcatttctcaagtcgtgtcatataaaactttaattaaataaatttgttatactttctcctgttaactggtcttttgttataggaatgttggctgcaacccttatggtgggtgagaaaagagatcacacctttctgcccctacgttagtctaggttattgatataaaattagtttgtgggcattgagggttctcctctacttctgcttactttcctatccattatagttgggtgacaaaaaaaaaagcattgaaagtcacaattttggtgacctaccaacacatagagtgttttgttttctagtcaaaataatcacagggttgaaaacatgttcattgtgcattaccttattttgttttagtctgttggacgagctcccccagtcagtgcttaaatgggctccttctggaagcagttgctgtaagtcaaataataacttcaaccttctcttacgatttacaggttgccacatttgtcgttatcgtttggtagcttttgcttaacccacttgctcctattcccatcagggtgggaaggagggaactcttcatgttgcaaataagttgctaaagaacacaatgtttaaatcatctttaacattagaacacaaaaaacctcaaaagaagatattgaggtggaaaattctaggttctgcttagtgcttttttttttttttttaagatctctattttgagaatcatgcacaggcttaatagtcaaccgtatctggtatttctagagttaagacttcctggttttgttcctctatatattgttgaaagaagataaagttgacctaaggaaaaactacttttcatcagtcatttaaaaaaccaaatcagtaaacactgaatgctgtttagaccagaattatgctgactgaactgccagcaaaaaaaaatttttattagcaaaggcatatgattttgggatttggaggtatatttcatattttcaagttagtatacaatggaatttttaattgacaatgttatcaatacatattgtataaaatagcacgtcaactagtaattacccacattcctgtcattttatgtgcatacacaacatgttattcaacactaatttaacaattgagttagactgtcttatacgaaaaagccagtgcccactatcagtcttgctttttttcagagacagataatcagagtgaatcttgttttctgtttacactggacaatctcaaagttagctttgagctgacttctgaaagtagatatgtacactgacctctctagctaaggtctaatagcatctgtttccatctggttgagaattagagagttaagtcatcttaaacttacattcacagcctttctttcactggaaaccaaaattttcatttgtggaggaaaggaaagaataagccagttctacttcccctctccatttgcaagtccaataagcctatccccacatgagtcttttgttttcccctttctctagtacttttcatcggattgagggagccacacaggagagatcctcattgtgggaatgggttgcaagatgaaatttttgttttcataattgtcaataacttggtcaaaatggcagtactcctttatggctaatattcttaatggcattttttttttttttgagacagagtctcgctctgtcacccaggctggagtgcagtggcacgatctcggctcagtgcaacctccccttcctaggttcaagcgattcttctgcctcagcttcccaagtagctgtgactacagacacgtgccacgatgcccagctactttttgtatttttagtagagacagggtttcaccatattggccaggcctggtctcaaactcctgacctcgtgatcccccccaccttgccctcccaaagtgctgggattacaggtgtgggccactgcgcctggcccttattggcacttttaccaagttgtatagttcatcttttaatcaactggacagaaagatgggaagatgtcattaacatatatatatatcatatatatgtgtatatatatcatatatatgtgtatatatatcatatatgtgtgtatatatatcatatatattatatcatatatatgtgtatatatatcatatattatatcatatatatgtgtatatatatcatatatatatcatatatgtgtatatatcatatatattatatatcatatatgtgtatatatatcatatattatatatcatatatatgtgtatatatcatatatattatatatatctcatatgtgtatatatatcatatataatatatatgtgtatatatcatatatcatatataacatatatatgtgtatatatcatatatataacatatatcatatatgtgtatatatcatatatcatatatatcatgtgtttatatatatcatatatcatatatatcatatatgatacatatatatctcatatatgatacatatatatcatatgatacatatatatcatatatatgatatatatgatatatatgtgtttgtatatatatctcttacctttcttgtcaatcctgcagaaaaaggaactgttcagtttagggtaagaaagcccagatgccctgaattgtacaagacaaatgcttgtgggcagtgtatattatgtcatactctattgttaaagatttgagtcagatgagtaatctagatgggagacaagcccagtttttgtttcttagcacaaaccattttattgaatccatactattatttataaaatgcagatttctgtttctaaagcaaaaagtgttgaaactttaatattacatgaaggtctcttaaattaggaggttgtgcttaggaagaacacaaccatgaaaatgaaggaactgatttacaaaagtttattaccgaaacattttatgaaataaaacagccagaagtttgcagcatacatgtccaactaagcataataataatagtttcaaaagtttctatctcttgatagtaatgatacttaatacttcactggcttaaaaagcagatgattaaaaaaatcataatttcatactaaaggcattttgctttatagttctggcaatatgctagtaaattttaaaatgtacttaataaatccagatcttgaaagactaacatttaaaccagtattacatcacaatatctacgcttcaggtttgtaataataaatttataatggaaatggctctttttattttctccccctcctacctcactggtacctcatttttccaaaccccagtcccatgaaggctttgcagcacagctgctatcagttggtggagtgccaggagttttccattgtcttgtaacagtgatttgttcccagcacattcaactctcttcctcattttggatattctggttaatggaattgtaatatgtaccaaacttggcttaccaatcttcacaggaccataaaacaaaaatatttatattaaaatagtagtgaatgtaatttaattttttaatcatccctttagaaattggatacccccgagcccttgtgaaggggctgcatgaagcatcagttataaatatggtgataaaatagcagcacttgctagttaacagagatctggttgaccgaatgctagataacagaatttgataaaaatagatgaaaaaaacaggttgcataattgctacagtgtcaaggaagaaaagcccagaaccaagagtttacattttaaccacgttagcttcatgttcccaggaaatagctctgtactatatggtgaaagtggtcactcttaactttaatagggggaaagcgatgatgactattccttttgaaatttttctctatagggagtgaaacccagtgcctctgcagttttcctttcttttgagtggaggtaggcctagaggggaagtgaaggattaggaagtcactcctgccaacgcatgaagtttcccaggttttcccaccatggatataagcaactaagtgagaaagtaagaagtacttgagtttgagtcagtaatatatttttgaaagggaaaggcatatctaaacatctctgtgaacaaatgaaaacatgccagtttttaaatagtatttggtattatcaccacttctattccaattttaggttgaacctcaacatgaaacagaaatgcaagctacaaatattttaatgcagtgatgtttgtaactgttggttactaattctgtttgtatttaaaagttggtagttcctaacctttttggggaaagggggtttactatgtagttctaggggaacatttctttacactagagaaaaaataaaagatggcaactcctcctcccactgctctaaaatcaaaaacacgaggctgtgtaccaggctagctaggtatggaggacatgagggaggtttcatacattctaaattcaatcttagctaacaacatggaattcaaggtcctttctaaatatacggttataatcccaaaatcaaagccttaattaaaatttgcagtttttttccttagaaataaagaggtttataataagtaacactttaactgaatttttagaagttcagcataaagtgtgaagtatggtcagttgtattatttatgtagtccttaatagttgcacctcataaatcaaaatcactataattattacaatatacttcctctcataagatcagtgaattataagcgtatcaacaaaaatatgttaaaaacattactagtttgtctcatcaattctgtaggtcactatatttcagtcatttttgaatatcatttaaaaagttattttcattgaattgttcatttttagtttcttcaggagatgtaaatgtgtaaaagacaaagataacaaagattttgagattactggagtcttgacaattcttgccaattgtgaatgacatgtaaaaaatttaataattcacaggtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagtaagtaacataatccctgctatcctatgattaccttctatgatacttttctatcgaatgaaattgttttaggtctcaaaatgagtctgacagctttcttcttccttatatttaactcccattttgcctaactcagcaccaagaaagtttgttccaagttcttttgacctgttgtctcacagagaaaaataggatctgtggcctactatgtactatgaaagaaagcagtcactactgtcatagagatgtgactagggtaaaggctaatctgatgttactcatgagaaagccatcatttgcttcttttctccaggttttctttagatattgccctgtgtttttgcctaccaatttggccataatttggtgataacagtcttcgatttaaccaggttatttgtatgtgctgatatttcaatccatggaaacagttctttacagaaaataaaagagtttatgccagagatctaggttaaaaaaaatcattttttaaaagttacacctcttcttttagtctgccatcttcccaaagaccaacaccaacttaaaaaaaaaattaagatttcgagcatttttaagcgggtggtggaaatcttagactgccgttattagcaagaatagtggacaggcaactcagcatccatgtcttccttgaccactatccgtatgcacaaatagagtgtggagggcatttttttcctgatgcatgtacagtaagatagggtcaggatgctattcatttttaatatttcttatgaactttggatcatcacacgtgttcatgagccaagaatgcgggatgcaaactaatgtgactgataggctgctagatgaatggtgagtcaagtatcagtgcacagatggttctgatttgctgaattttgtagttgctgcaactgaagacataaaatatccttctagtcataaattagctctttggaagcaaaaccttggcaccagagctttacaaccttcaattagtaggaaaagaagtatttgaatgactgtggtattgacatctgtaggcctgcatagtaatcattcctaatagaagagaatatctgtttgaggaggttttgcatggctaattaactaccagtgagaatatgtaattttttcatgatctcctgattgtcacctttctctcatgatacaattagattttattgtagcaagtgcctcacaaaccaattgtcagcactatttacgtattgcagaaggcagaacaagagttcatgtttaataaaaagccactggattttgatcttggtaattactgagacttgttttaacagttttattgacttttgtgtttttatcacttttgcaacaaaacaaagagccatttccttgacgtagtattttcgttgcaataatggtcaccacttaatctatgctaatttaagtagatttttccctttttgtagtttttcagtttcataaacttaattgaaatataaaagaagccattttaaaaactgatagctatatcctctgatataaaattctgattattatccaccagaattttcagtttcatcaaattaaagggtgtttgttgtgaaaccatttttatatgtagagaatagaacataaaacactttttccaatgagcctccatcaagaatattttatcccttttgattattttgattatgagtaaaaaaagcacttaaaaataatacatgcttttaagacctacgctaatttctgttaagaaatgtatgtgatcagcctggatgtatagacagtaagatgatttggggatatattttgcagcagatcaatatttatttatttattatagtattttaagtgcatacatatatttaataatgatagcataagatatgggctcaccatatgtggctaaactttaagtatcttaattttcaaagtttacagattttgcagtgctacaaaaaccaaacctgaaaatgttcaaatgcaaggtatgacagtataaaccgtcctgttcccagttcccctgaatgatgcacgtataggatgatttccacaatagattgcttccataacaaaaatcattccaaaatgcatatcaatcacatggctccaaatttctttttagtcacagacagaatgctcttattagtaactaaaatcgtttcttgttactttataaatgggtttatagttatatgtagttaagtatttagttatagagctgtttaacagagtagtgaatgaattctggactaatacattttttggacaaagatattttaaaagaagacattggaccagaaaaggtatacataaataaataaaatgttaccatcattcagtattcaagggaaaaaagttgtaactgtttacatttttaaatgttattttgctaataacaaatgaaacttatacagagggaagtaacagtatttttaagaaaaacatattttgattaggtattagaaggtagcacattaccctaagaatctcaccaaacttacatcacctttttgcaaaagaaaaagttttttttttttttccaatactggattttactagacattataaactgttctctgtaaacctggacagagaattcctcaaatattgttattggagttaaattggaaatgaatttttgtcaagagagtagtgatattgatatttttttcatgaaaaacaaatcttttggggtatttgcctgaatcaaaatgagggatgtaaaactgaagtcacttgctagtagttctgggggctcctgagttagcaccgccaatcaaattagaagactgtctcatcaagaccatcacagtctctttatgccacccactaggatttaatttccaaaattcactgaaagaaacaatatttcaataagaatgcttattgaggtgagctaaagctctagaattcccagataagaatgttaaagccaagatggaaaacagcgttactaaaggccccattacgacccttgaataagctatttttcaagaaccagaggatccttttaatcgtttatcaatgactcccaccttattatggtgcttgaatcatatatacaatatacagtaatatactataatatgttagtatattgtaatagtgtagacacttgggcataatgagccctcccatccttcctaaatgctttagctaggcagagaagtagctgcaggtcagagctaaaaggttgtcccttcattcaccttaaatctgaggctcccatagcatatccagagttgaatatattattattggtagtagtagtatttgtatagaatttaacggtttacaaaattttttcctaagctttaagtctcaaaataattctatgaacttctctttattttctgtatatgaggatagtgaaatacagattcttaattagaagcacatttttggtttattaatttttaggagtccaaaggtattcttgattttatagaacagtgtgaagttccaatggaaaattaaataaaaactacctcattttcatacctactttcttgaaaatatcacacatttgtgtagtatccttctattataagggatgcccagggtgttttctgtatttttctatctttgagaaaaagtttcactgtgttcactatcatctacttcactcttacaataaaagtttccttagaaataagattttccattaattggctatcattttgtttagtagctagaagtgcccacggcagtgcagcctaaccattcagccaactaaaagcaaatccaggaggcatcatctcttccaggaactttcacagaggagtgaatatattatactgaattttgcttatacgtcagaggctcccagggcaaaaactcttaaacctaaaatgcctagcatataggaagcactaaaaacttcaatatcttagctaaaaataaaactgccagcaaccttgcttctgggtatgtatccaagggaaataaaaccagatgtcaaagaggtatctgcactcccatgttcattgcaacactattcacaataatcaagatacagcacaacctaagtgtgtgtcaatgggtgaatggataaagtgtggtccgtaaccacaatattatttgtggttatagaacacattttctttatccacaaagtgtattttattcatatatattgtgtctgtttgtgtatatatgtatatacatatatatgtatatatgcacacatatatacacatacatatatacatatacacatatatatatacatatatacacacacacacacaatggaatattattcagccataaaaaggaaatcctgacatttgcaacatcatggatgaatctggaggacattatgctaagtgaaataagccagacacgggacaaatactgtatgatctcatttataggtggaatctaaaaaaaataataaacttatgaaagcagagcatagaacagtatttgtcgggatgagacctggggaaaatggggagatgctagtcaaaaggtacaaactttcagttataagatgaatgagttctggggatctgatgtacagcatggtgactgtagttagtaatactgtgttgtattcttgaaatctgctaagagagtagatcttaagtattctcacacaaagaaatggtgactaacgtgaggtgatgtgttaataacttgattgttgtattcattttgcaatgtatacatgtatcaaaacatcacattgtataccttatatatttttattgtcaaacatatctcaataaagctgggagggcaaatctcaccctttataacatggaacacattttcacaagaattggtaagccaatgttttaataggataaaacagtacgcaagaaccatgggagaccctttgtttcacactaatggtatcaggtacatttattaccaagatgacttcagcagaaagtggctcagaagatggtgacataaattttcccagtagtttgggaaggttgagtggtgaaaataaagaattcctgcatgattaagaaacatttccaactttcaggttactgaaaggcagtggttttgagctgggatcctggaggagggtagaatagagtggtgttgtgacaatttaggcttagccacaaaacaccagcatattttaaagggaaggagtgaacacacttggcgataaaagctaaaaattgagagactacaaattaaggctctgcttgcccagccaatgtaattcattctctattttggcactggctacttcactatttcccctttgtgctgttcctatcttctgccccctgtttaactcatgaaaaaaaggtgatggcactttcagctgctataaacatgaagctgctgaacaaatacttcatataaggaccttcgctgtagctttcaatcttccaacagtgttgtgggttctgcccttctgtttctgagtctacttcaaggttattgacagtcaggcatcccccagatatcatcatggtgtgaaaaagaaaccttagagacagcaagcttgttgtagaagaacttaacctctgatactggtacacagtattcgatgacatgaactgttattcatcttgctcaaaggttaaactacctgcacaaaaatgtaagcaacatcacaagctccttttatatattcacattaattaggctcacttcaatgatagaaaactaagattttaattaataagaatttaaactacaaagatatactggatacactcccagcaaaggttaataatgaattcatgtgcagctttaaaatgtgacaattttctctaaaaatgctgttttcagtaagcaagttatctgtagagataatttctaaggagtacagtgacactaattttattttttattttattttttattatactttaagttctagggtacatgtgcacaacctgcaggtttattacatatgtatatatgtgccatgttggtgtgctgcacccgttaactcatcatttacattaggtatttctcctaatgctatccctcctcccttcccccaccccatgacaggccccagtgtgtgatgttccctaccctgtgtccaagtgttctctgttcaattcccacgtatgagtgagaacatgcggtgtttggttttctgtccttgcgatagtttgctcagaatgatggtttccagcttcatccatgtccctacaaaggacatgaactcatcctttttaatggctgcatagtattccatggtgtatatgtgccacattttcttaatccagtctatcattgatgcacatttgggttggttccaagtctttgctattgtgaatagtgccgtaagaaacatacgtgtgcatgcagtgacactaattttaattggttttgtcccattgatgagaaagggtctggatcttgccaacgactatagtttttctgtaatgtccacttgctgctttcctctttatttccttttttaaagcttggcaagtttagagcttttaagaatctggacatatatgcattttttagagaaataccaaaagttttcattatatattattacttactctataccaacaggttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggtgagagggttgtttgtgtgtgttttttctaacttaatgttacattagaatatgccctttgggaataaaaacatcttattttctcctgagggccaaggttgtatggttttgttaaatgagaagggacagaaaatatcctagccagctgataaaattaaagcggccagcaccagttatcatagaaacagaatagcagtaagcacatttgcgtacagatctgatttctttattctaagaatgtaatgaagtgcacttaaatttcttttgccatctatgatccattagggactcaatgtattctatacttttacattggttcctcaagtctcacccttataatcaaatataagtgaagtgtttccctgtcaatgtggttgtattttaaaatgatgtattttttacatcactcagtcatttgggcggagagtgactcacctttagcagatgactcattcaagtaacagcaaaaatcctccctaatctaaccttttttgacaacaaggagaagcatacaatgcatttattatctgcagtgaaaaaatatttaattttgtcaaaatgaccaacattttatatgatttatacaccatcatttcccccaaatgatttgaggtagtttacagtatgaaacaggataatttaataccccaccttgtataccctacctaatcaagaaaaattgatatatcaggcagctgggatattaatcactaaactgagcactgaatttggctctgaacttcttgacagccgaggcaaaaattagaagcatagtacttatgcattcttcagccagccaacaagcctgcaagtttatccagagacagaaatgctttttttagtactaatagcaatcttttacattctttcgagtataaaatagtggcattatttgttgtttcattttaaatttatgtaaggaactacttcacttaggcatattttagttcctattggtaaaattaaagacaaatcgtgcttggtgacaaaacttagagattctaaaaatctctagttgagagattctttttcaacccttacttaagtccaccaaaatcacctggtgtacagggatagggaagcactgcgaaaatactgatgcaaagaaattgattcctttttggctgtggtggcaatgagatacgtatatatagattttatcactttggaaagtcttggttcttttccctagtcagtcctcttcccccagggaatgttctgccattttgattctcatcactagattagatttgcctcttctagaatttcataaacatgcagtcatatagtatgcattcatttgggcctggcttctttcactcagtgttttttttttttttttgagatttatccatgttcatgcatgtattagtaatttgttttttccattgctgaacagcactccattgtataactatatcatagttcacatgtccattgtgtaactacatcataattcacaaggccattctcctattaatggacatttgggctactactcatttctggccaccatgaatatagttgctacaaacattctggcacaaatccttcaatggacatgtttcatttctcctgagatgtagaattgctgggtcgtagggcaggtgtatgttcaattttataaagagctgacaaatagttcttgaaagtaccattctgtactcccaccagtaatgtacaagagttctggccattccatgtcctccccaatatttggtattgtcactctttttaattttagcctttctaacatgtgtattagtgtattattgcgtttccaattattcacctgatgtctaattaagtttgagcactttcacgtttttactgacctttcatatatctgttcttacaaagtttctttgtcgagtgttctaatttttatttggatatttgtctttttattgttaagccacaggagtccttatcagatatctgtattatggatatcctctcctagcatgcggcctgcctaatcatttaattcatagtatcttaggatgtgcagaagctttttatattatttgtttttttatttgaagttcaatttatcaatattttaatagtttttttgtcgtttgtttgtttttctgtaaagatacctaagaaacctttgcctacctcaaggtcacaaagttattttgctatatatttctatacaaggctcatggttttagctttcattgttggttctatgagccatctcaaatcaattcatgtgtattgtgtgaggtggaggttgaggttctctttttcatatagtttgcaccatcatttattgaaaagatgttcctaatgaatttctttggagcccttttcaaaagtcagctaactgtgtgtgtgagcctatttctgggctctattttcttctattctacttgtctctccttacaccaacaccacactgcatcaattactgtcgctttacagcaagttctgaaattagaatagttctttaatccttttattttctttcaaaaatgtattggccattttaggtcctagtctcctccataaaatttaagaagcagcttgttagtttccaccaaaaaatgcacaatgggatattgactgggagtacattaagtgtaaagatgagtttatggagaactggcatcccaacaatgtcgactcctccagtgcataaacctggtacttctctgcatttatgtggaacttctctgcatttatgtgcattttctttaacttctctcaacagtgttttgtagtttttagtgtagatgtctatacatcttccattaaaattatctctaaatatttttgatcccattttaagtagtaattttcaaaatttcatattccagttatttgttgctggtatatagaaatagaatttattttctatttctatatcagttatatttgatatacaatataatcatgtgtcttgggatctttctaaatgtacttattagttccaataggttttattattttttaaatagattcttaggactttctacatagttaatgatgtctgtgaatagagacagttttacctcttcctttccaatatatgccctttatttattttttatcgttgtcttattacatctgctagcagctctagtattacgttgaatagaagttgtgacagtggccatccttgcttggttcctgatcttagggggaatgcattcattctttcaccattaagttagctgttgattttttctaaatgccctttatcaggctgaggaaatttcaccatatttgttgaaaaataaatgtaaataatgaatattaaatactgttttgagatcttttgagatgatcacatgattttttccctttactagtacgatgaattacactgatttttaaatgttaaatcaaccttttatttctgggataaacctccagttaggcatgatgtgttttcctgctgaattctgtttgctgaattccaactcaattcctgctgaatttcagttccatggaaggtttttatacctagactgatgagggatactggtctgtaattttctttttcttttcttttttttttttttttttgcaaagtgaaagcaagtttattaagaaagtaaaggaataaaaggatggctacttcacagagcagctgtaattttcttttgtcgtaatatccttgtatggttttgttttcagggtcattatgaattataccagttggaagtgttgcactctgttttcagaaaatgtttttgtaagatttgcctttcttaaatgttggatagaattgagcaagaaaaccatcggggctgataatttgttgtaggaaattttttaactgcacatttactttctataatatatagagtgatcattagattttttttcttgggtcagttttatatttgtatttttcaaagaatttgtccatctcatctaagttttcaaatttatcagcactaagttaggatattctttattttccctttatcatcaccaatatctatattgatgtccctctttcagttctgataatggtaacttttggtttctttctttttttagtagtctagctaagggcttatcattttcattgatcttctcaaagaccagctttggttttttttttttagttttttttttttttcaaagaccaacctttggttttgttgatttttttaaaaaaacctaccattgatatgttttctgtttcactaattctttatcatttgcttgattctacttattttgcatttaatttattctttcaagcttcataaggtgaaagtttaaatcactaattttttccttcattttttttctaacgtatatagttaaacctataaatatgtaagctgtgctttggctgtctatttcacaaattttgatgtgttgtgttttcattattaatcagttcaatgtattttctaatgtcccttgatttatttgacccatggattatttattagtatgttatttaattcctaagtatttttaaggtttactgggtatcttttttgttattgatttctaatttaattttgctgtcatcagaacacatcctgtattattgcaatcttttaaaattcactgaaacttattttgtcaccaaggaaaaggcctagtttagtgaatgttccttgtatacttatgaagtttggggttgtttaatagtgttcaaatcttatatattcactgttttattttgtcctcgttttatcatttaatgacaaaggaatgttacaatcaccaactgtaattgtgaatttatccatttgtctcttctatacatttttgcttctatacatttttgcttcatagattttgatgctgttattaggtatatgcagatagtagttatatgttcttggttaactgtcctgttcatcattctgaaatatctttctttatatctattaaatactctatcttgagttctacttcatctgacttttaacaattccagccttcctatgattaacatttatacattgtatccatttccatcctttgtttaatccacttgtgtctttttatctgtggcttttgtaactagcatatagttgagcctcgctattttataaaatctggcaaacactatcttttatttgctccatatctatttcatgtaactatatttgctccatttccatttgaggtaactattgatatagctgggtttaatctaccattatgcagtttgctttctttttgccccatttgttctttgtccctttttacctccctcttgctttattttggactgattgagaatttttttttaactatgcttctatgcttgttttttttttttttttttttttttttttttttttttggtggtcactctagagcaaggggtcagtcagctccatagcctatgggccaaattcagccaaccacctatttttgtaaatagttttattggaacatagccatactcattcacttacatattgtatttgattgcttttgttccatagtggcagagctaactgcaacagagactgtatggtcaaaaaagcctaaaatatttactctcaggcattttacaaaacaagtttgcaaatccctgctcagcacaatcctgcctaacagaaatataatgcaagccacatatgcaatttaaaaaattctactaaccacatttcaaaaagtaaaaagaaacaggtagaatctattttaataacgtcctctgattaaaccagtatccacaatggtataatcagaataatattactgagatacttacatctttttctaaagtcttcaaaatttggtgtctattttatagtaacagcacatctcaattataactagccatatttcaagtggtcaagtcatattagacagcgtggctctagaaattaccatgtgcacatttaactgatcatattacattctatcttgacttaatgtgtaagaaccttaaaaatatatacttccctttatccctcatcctttgtgctattgttgttatacgttttgcttttacatgtgtaatatatttcagaatgcattggtattgttgctttaaggagccatttttcattttaaaaaaattaagaaaggaaaaggaaaaaaagtcttaacatatcccagtatttacagttactgaaattctttattccttcaatagatcttagtttggtataatttctcttcagcctgaacaaattcctttaacatttatcatagtatatatttcctggaatctaattctgtcacctcttgtctgtctgaaaatatttgtatttcacctgcatttttttttgtagtggtggatttatattttatttctgcatttttttaacagtttattttgaagtaactgtagactccgaaattgcaaaaatacatacagcctccctatacccttacctaccctttcacccaactcctgcaaatgaaaacattttacataaccataatataattttacaaagcaggaaattgacattcatatactaccataaaatacagaccttattaggatatcaccaattttgacatgtactcgtgcatgtctgtgttccttagatattttataacatgtatggagtaaccaccacaattatcctgcagacctgttccatgaccacgtaggaattgctcatgctatagtgacactctcttcccaatcctaatcctcagaaagcagtgggtttattctgcatcactgtaattttatcattttgagtgtatcatataaatcaaatcttatgatatgtaacttgttgagaatggctttgtttcattcgtcatcatgcccttgagatcgatccaagttttgtgtacatgagcagttcattcctttttattgctcagtagtaatctgaagtatggatataccattgaagaacatttggtttctttccagtttttgtccattcactattcagtaggttagctgtagacatttttatagatgttctgtataaagttgaggaagctcccctccatttctaatgtactaagagttttcatcatgaataggtgctgaatattgtcaaatgctttttctgtatcaattaatatgatcatgtgatttttcttctttagactgttaccatagtggatgacactggtttgtggttgaatattaaattagtcttccattccttgaatcaaccccacttcgtcattttatattattctttttatatgttgctggatttaatttgctagtattttaatgaggagttttacatctgtgctcatgagagctgatgtctgttgttatctttttattctactgtttttgttggttttggtatcagggtaatggtgaccttatgagttgagaagccttcctcctcttcttaatttctggaagaaaatgtatagaattgatcctgtttctttttcacgttttgcagaattctctagtgaaaccatctgggtctggagattcctttttagctatgaattcaatttctttagtaagactattcagatatttatttcaagagtaggcaaacttttctgtaaagagccagatggtaaaaaatttaggttttgcaggtcatatggactcttgtcacaactatttatctcttgcatttttattatttcatcttgagttagttttggtaatttgtgatttttccaggaattggtccatttcatctgagctatcaaatttttgttggtataattattcatactattcctttattcaaatcccttaaatgcctgtggggtctgtagtgatatttgtttcttcccagatactggtagtttgtgttttctttccctgttagtcttgctagtttgtcattcttattggtcatgtctcagaaccagcttttgattgatcattctgtattttttaattgccaatgttattgatttctgctctaatttctatctttctgcttgctttggatttcttttttttttaattctttttttgacaaatataattgtatatatcatatctatggggtacaatgtgatgctttgatatatgtctacattgtgggatgtttaactcacactaattaacaaatccatcatgtcacatacttgtcatttctttttataatttcttggggtgcaaacagattattaaattgggactttttgtcttttctagtacaaatatttagtattataaatttcccttctagcatgacattagctatgtcccatgttttgatatgttgtatttttatttccattcggttcaatgtattttttaattttcctggggtctctttgacccatttaaaggggtctttaaattttaaagcatttggagattttcctattatttctttccttcatcttgatcttggtgtattttcttcccttttttccagtttaggtagaagcttaggctattgatttgaacccactattttttctaatgtaagtattccatgctataagtgtcctgctaaaccctgtttgtactgcatcctgtaaatatttatacatttcaattttgttcacttcaaaatatatttccccttgagacttttaataccttatttagaaatgtgttaattcccaagtatctgaagatttttttttcagttattgatttctagtttaattatattatggtctaacaatataaatttgttagggtttgttttatggataggatatgacggtctgcctggttgaatgttccagttgcagttgaaaagaacatgtattttcctgtttgggggtgaagtagtctataaatatcagctagatcccattatcttgtgatgttactgatttattttatattcctgctgattttcactctagtagttatatcaattactgagaacagagctttctagttagggagatgtgcgatgccaactctttgctgtttaatgcacagcaggcacggtcaaaagggcaagtgcctctccagtttctgaggccagagtggagggttgctgttgctctgatgtttgctcagtgcaaggtggagaaggttggtagctctctactacggtctctacagtgtctggtggggaggaagacaggtaccacatctgcttgtgttagtgcagggaggaacaggctatatggctctgccttacagttttggtagtctcctggtgggaaggaagggggaccacctcagtagtacaggctgggaaaggttgtcagagctctatctcacaatttccctaacacccagtgggatagggtatcaccttgttagtgtgaggacggtcaacagggctctacctgtctccacagtgcttgatgggggaagggtaggtgtgctccctggttagtgtagggtgatgatactcaacaggactgtaccctccctcttcaccccacccttgccacctccccaccgcccccaccatcccccccaccccgccgccccgtttccacagcacctggagagaagtaaggtacagcttctttcatggtgttcacctagggttcagcaggtataaaaagattctgtcctgtagacctgtcctcccccagggctattggttacatagagcatgtttttcatgtttgtttttttttttttccagtctgtgcatattgctgtttccagaacgcaggctcttttatggcccaggctggggtaataggaggtactaaagtacatggcgggtggagactcaagggagggtcatttttagaattttcagtgttttgataggtgctttttgtccactctttaattaccagaataaggtgggatgcttactctttcttgtctataactggatgcccctcactttgattttgaaagcttcattgaatatggaatctattctttcagaactttaaaaaggatgtttccatcttcataggtctgtttttttttctgctaagaagttagcagttattcttattggcccatttataatgtatttctttctgtggctttcaagatttgcttgttatttttggttttgtaaggatggctgtcttttgtttattgtgctttgggttcgtagagctgcttttatctgtgggttgatatttgtcttcaaattggaaaggttttgtatgatttcatcaatttgtttcatgccttaatctctcttatttctctgagttccaaatacatgcatgttagaatactttacctttttcataggcagctaaataactatttttttaaatcagtcttttatgttgctgtacctcaggttgggtggtggtgttttttttgttttgttttgttttgttttgttttgtttttgcctgacctctagttgattgtcaaatcagctgttaaacctagccaatgaatttttcatgttataccctgtatttttcagttccacaagtatatttctttgtatgttgagattccacctcccccatatctgttcattaattatgttcaactttaattccttgaacatatttatgtagatgttttatagtccttgtttgataattgtaccatctggatcagccctgaatctctgttaattttttctcctggttatgggtcacatttcctgcatctcatttgtagtagttttattgtatactgaacattgtggatgctgtggtctttagactccagattttattgcattcctttaaagagttttgaggttagttctggcagacagttaacttactggtgactaaacctgatcattttataagttctgttcaggcttttttggcctagtctgcagtaaatcttaaattgtggcctttcttaggtctgtgttattttcccttcctgagctttgttttagatccctaagttatttcacatattttgactaattttgttttctattatttatttatgggttttcacagcagaaggggaagtctggtatcagattttcatggccagagtggaagtagtgttgctatttttcatagcttcccagtcgattctgatgtgcattcaaagttaataactattctaatgtagggtttcttgacagctgcactgttgacatttgggagctgagctgttatttgttgtgggggtgctgtcctgtgatgtaggatgtttcgcatcattcctagtacttatctactaggtgtcaatagtatctcctcctagctgtaacaacccaaaatgtctccagaaattgctaaatgtcctctgtggggcaggatcaacccaggctgagaaccaatgctctatcacagtagattattgcattgccttgagccctttgctactcaaagtggggtgtgcagaccagctgtattggcatcatctggagcttctcagaaatacagaatctcaggtcatactcctagaccttttgaatgagatctgcattttaacaagttatgatgatctgtttgctttctaatactcgaagaataatgccgtagagcaggggtcagcaaaccttttcttaaaaggccagaaagaaaatattttcagtttactttccatacagtttttgtcagaactattcaacaatgccattgtagtgcaaaagcccacatagacaatacataaacaaattgatgtggctctgttccaataaaactttattcacaaaacaggcaactagccaagccaaattttggcaactcctgttatagactatcctaatcagaccccctcagtgtactgaagacaacaggtggttaaattctttgatgagtgccttgccatatgatgtcatttgctgatgttcaagagagattaagtgtatagattacacagtagatgattctggaaattatagtagcttgacttctatccttacctaagtggagatatctcccagccttgcacatgtgagctatatgtaaatgctgctctatgatttgatagcataattattatttgtattatgctttataggcctactggaataattattcacttattttgactttagttaataaagctgacaaacttatgaaaaactgcattaatgtgacttcgttagctcagaaagagtagtttaaaatgagttatttaactctaaagtgagtcatttaactctcaagtaattttttttcataggaaagctagtagtttttaaaacatcctttgttttatgtaggactcctttctgacacttccaaaactctgtatctagaaaggggagggctgtttgtttgaagggtggcagtttaaaggttgagaaggtagtagctattctgagaatgatggacagtgaacaagcttaaagtattttgctttgttttataaatttcttctcttctaagttagttacttgataaatggtgctgagggggcatgccagatgtcaccaaagcaaagcagaaaaactcgactttcagccagttaagtggtgatcaggaaactgattcctgggactttggccaacaggaatgatgaaaacatagaagtagctcccgaaacttgcataagtaaccagttaatttgttttatattaataccacttaatttgctttatattaatatctattcggtctatactggttcgtctgtatagctttccaagagacataacactatagctacccctgaggcagttttctttggctgtgtacagcctcatcctttgcccactgtacagtggacacttctcagttgccatggaatcagaaggtaaagaaagaatcacattaatgaccaaaatatttctaattatggctatcttacccccttaagattaagcccaattttttggttttgccaagaaaattcagttttcatattctatcctatttatttttagattataaattacttaagagatggcctactgacgtggtttaaaagaaccactcaaattatatccagatttgcttgttggatgtttataaactcttaaaaagtgtaaatctttaagatctttacctaaaaattacttctcaggaaaaataacacgcaaaaacttgatcttgtataacattttatttagcattcttacacactacacaaaataaatacttggataactcacgtctaacaaactaaactatatatgtattttttccataggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaagtttcagatcacctaggaaatctagaaaaggagtttaatgtttttgatcagagaatttgaaaaatagaaatacagagaatgagtttcaaaagttttagataaactgatatactatatagatctatcttctagaacatattactgaaagctaggcacattttatgagatgtgattaacaatttgcttaccttactacaatatggacattcaccaaatatgatgttaaaactctgtctactagttagtagtcctctcagccactgcaaattttaaaagataaaggagaagcgtcagcatgattacaaattacagatactccaaatgtcattccctttgtttttaagtgcattatgtttttattccagaagacttagcttaattttgttttgcaagagtaagggatgtatttcctgagccaatagcagactattaagatgttgagtaacaagggaaatcaacatggaattgaaggcctaaaccactggtttataaccagattatgggcccctttaagaatctgataagaattacgcattttctttatccccagaatagacatacataaaaataatgcatactaagttcctggcattcatagactttccctaaatccattaatcacaaattaacaactcctgctgttaaagatactacaggctcttgaaaatttccctcttagttctggtctgaatcactaacagtgggttaattttcaacccattgattataagcatgagccagtgaatttttaaaaattaaatgaatattcataattacaaaagaaatcacatgttcccttagagtatttctgtaatttgacctgtatttctgtaatttcatgattttatataaggtaaatagatgcctctgcctaagttctccattggcaaagtacagacggcaccaactgctacctctaatcacaaaagtaaagatgtgatattaaggaagactgaaaccgaaggcaacatacaattgcaaggtgttctgtatatagttacacacagtttatcatgtatcaactaggccctaaggtgaagccaggcactaaagacaggaatgaaagtagacttcacatacagtaagtaaagtggcattgcctgagtgctgtgagactcagatcacaaaaggcattcttctcaacatgaaaagtagtagtattggatatattctattcttaaatgcagcctgaaaagtaatagatactacatagtactaatttcattttcactgtattactgccactttcaaccacctccacctcgggtaaacctatgaagcttacattgtggtaacaaggaatttatagaaagattccaatgtaccatcaatttaatttgttatgtgtcaataagctagtccatgaatatattctggatagattttctcccttggatacttcagaacatttctccactcattagtaactgtgatgaagaaatgaagcacataagcatctggaataaactggtaaaaggagttaatggcaaaagagaggatcactattgactcaacagattttagattctgtgtatttcaaacaggaatacttcctatgttgtgttagcggaaaaaagtcttgacaatatttttattttttacctcatataagcatatttgatggaaaggttgtccacactgagaattatcacacacttgatcaggaatggtaccgtcaagttgataagcataacaaattccacaatccatagtaaaatccttcaaaagaaaaatatttataaaaagcgtatgtgtctcactaacttattcgttgtacatatttgggagggtatgtgtgatattttgatacatgtatacagtgtttaatgatgacatcaggataattaagatattcatcacctcaacatttaccttttatgttgggaacattacaattcttctaactactttagaatacgaaatcatctatgtgtttaaaacacaaggtaagatcaggaagaatgttttataaatatagtttttataaaggtgactatattgctgtattataggaaatataattacattactatttaacacctagcaaagctattgtagggtgtttccttttccactcaaatatacacagctaggctaaaaaaagagattccatttttggctggcaagatgtttgggcatcagtaatattcccatatcatacattgttataatgtccctgatagtatttaaagaaaggaattgatattagctagtgattactaaacagcacaattctgtaactaaaggaaaaagaaactcactaccatttagtagtctacaaccttagcagccttgtcaaaaatcaattctattatttttgcagtatagtggtatctattcaattttgagaaactataactgcttcacaaacacttacatcaagctaatcagtatttgagccatccataaacagactatgtagaaaagccaaacatctcattagctactttggagttctccccttatttttaataaatgtctgtcattaatgacgtcactactgaagaccatgaaaaaagtatatagttgacccttgaacaacatgggtttgaactgcacaggtctacttatacacagattttttttttaaccaaatgcagatcaaaaatacagtactgacaagatgcagaacctgtgtttatgtgaaatctctgtatacagagggccgacttcttctatatatgggtcctgcagggtaactgtggaactttaatgtctgtggatttttgtatccatgggcagccctgaaatcaatccccctgttccaagagacagttgtacttaacaaccaatcaaaggtaaacaagttttttgatgcagatcagaagtctgtgttataatatttttctaattccctcctttttcagcctcatttttcactgagagaagcatttaaacttcattatgcaatactgtctggaatatcaaaacactgataaaacttacagatttttccaggatagcacgagctggaaaatcaatttctaaaacatctttcaaattttgtaacacactattttctggatccctgaaagcatggggaaaaaaattatgctgtgaactttgtaaaatcaccaaaaagtaaaaattatattgccaaggtacctaccacaaatgtatgttcctgctcagcttaattcccaggggttttaccacttcagattaaaaaaaaaaaatttaataattgcatgctctactcttggtttctaaagccacatttgatacagaatgtttcttaactacttgattagaaaatcaaaattatatgtattatgttaaaaaacaaaattatacagttcagaatgctgagacattgtcatttaaaataactatcattattgcggtgaaccgagatcgcgccattacactacatactgggcaacaagagcaaaactccgtctcagacaaaaaataaaaactaccattaatatactaatattgtctaataatttaacaatgctaggcaaggattttatgactctattaaaaaacgtttaaatctcagatgtcataccatggtcagctccaagaaagaagcactcaggaagcatagtaggatgcctggggtctacctctatatttatggaaacattattacctagaatgaaacaagattaaatcttttagaagtagaacagctcatcaaacaacccaataaaaaataaagaggtgttggtctggctacctatttcactgtatacccacggaaagattaaccaaatgttttgtagttttatgtaatggtaaatataattgaaccaaaagaagtaattttgatatgattatcattgaaaggatcttaaatttcagccagtcaacaaattgatatatttaattagattgcaattctggtcaactgtattaaagtttaaataaaaatgttctgtggagtgataaaggtctttaatatcaaaactatcacaagtcacatgtttaagaaataactatctaaattatttttcatggctttcctgaaaaagtttacatttcatagaactatggccaaatgtaaaaagaccaacaatacagtaaatggtaaaaacaaacattaaagattcaagttttataaaaatttataaaaacattttctgtattattttgctgcatgtgaaactttcccttataatttaacaaaagatttcattcacattggcaattgttcattaataaccaaaacaataagtaacctaatttcgcaagacctaagaaaattggcactaggttcttttatacattttaactgtactggactacagcgtaagtttcagaaattttacttctattttttgaaggtacatagtgtaactgcttaagatcaatttggatttcattttcatcgtaaaaatgtcttgataaattccatacactgtagaataagcctttcactaaggctggcatcaacataaatgcagttattgcatatctggcaaaaagaggtcattaacagaaaaaaatgactagccattcaatgagacaaataaaaatacaaaaagttataatctcatttggtaacacattatttactatgaacagaaatttcttattagccctcaacactgtcatctggtaatggctccagacagtactttcacgtaatatgggcatattaactaatttttccaatcacttgttcaaaacttggtcttaagaaagcaaatcatgcctggaggagaaaaaagaagctaaaaggtaaatagggaatgaattaaaaactagactatgtatgctgaatgagaaatatagtaagtatatttaatcataacctgataattactttaatggggccacgaaaataatgatttactacatttctttgaagaaaatattttcattcttagtatctacttgttcacaaatataccataatttggttaattgttccaaattaaacacagttagactttttgaaaccaggaaagtaccaatactatttgtagaactgctgtaaactatactttcttctcgtaataccacgtatgtgacattcttcccccagataatctatattatacctaggtataaagtataaaaattgctcactaacttggatgtgattcacatcagaatttcaaaatacccttgaacaacatatctatttagaaaaaaagaaatgggtatcttaaaactagctatggtatttaatgtgagcttaaatatagtttatctaaaatcttgagaaaggctgaagtcacatgttttgcttgcttataatgaaaatacacagccattttatagtcgagaacatgataacattgcacaggtatttatgattataccatatctcattcataaatttcatatacttgtgaagaaaatacttaaaactataaattctttctctgtgctttctgtttactcttcagtggcatggtctactgcaagttcttttatcttcctctgtatttctaacagaaaatattcccagatctgagcacactaatctgagaagattgtaagcttcacaaatgaagactgcattattctgacttttttcttgttctaagtaatgtaaattttgagttacctgttccacgattcctgtgctaattagcagctaattaaactctacttctgaatgttacctccattggatcatcaccttttataatgaaacacctcagtacttctccttttcacctaaaatatttacatttaaatgtgtagccaaaaaaaagtttatactagaaaattttaatagttgacttcatataaagaagtctgagtccaactgtcattgttagatttattttcataatacaaaataaaacacctaaaaacaaacccttaatcctccttgtccctacctaatgcaattctgcgtgctgttgcactccgtggaggtttttctggctcaagtacccaggtcttctcatcgatttcatccataacatcccagaatgcctttagtgattctattgctgccaaaaactgactataaatgcttattaaggagctctgtgaaaaaaatgaaagttgaataagttatatggtactctaccaatagcagataatcttttacttaaaatacactcaatttagaaattttaagctgtttcattttagctacaaagtagactccagtaaacagtagtcgactctccctgcttcacatctcttcctacagcgtttacaggattcttttttattgacagtagactatacacctgagaaagaatggttttttaaaaatcataatttttttattataatgcttgatatactacacgtatgcaatagtaatgagtacaagatgtatgtacacacaactttaataaatattaatgtacatgatatagctaacattggacctatacaaaatgtctataatattttagtatgaaaatcttaatttcatgtttgctgcagcaatcaagttaaatgcagtgctatttgtaatttagtgagattacctttaaatattattaaaaactttggagacctaattaggcagagtatgaaaaggttttacacatttttaaagaattaaaacagaaggtacaaatgatgtttttccacatttaacttttagccaatctctgaattcagcatttcatatattaatccctttataggaattagcttaaatatagtttcactaaataataagtaatgccatcactgactttaaaaatcagtttttaaacaaaggagtttctcatgaaacaatgtggtatgtttaaaagatacaactgcttactaaatacttttgatacaaaatcaaaacagtttaataagaaggatttgtttcaagtacacaaaatgtaaagtcacatactacaaacgttttcaatctgaaataactggccacaccaataatttaagaatatgatacaccctaagatgaaaagaaactagccacttccttaaacatgtattttatacctaatacttaaggaaaacccatcccattttgtcacttcagtcaaggtttacacttggatgaattcatgctcagttccactgtgctggattcaactgttctaaccttctacacatatttttttaaaaagtgggccaggtgcagtggctcaggcctgtaatcccagcactctgggaggctgaggtgcgcagatcacgaggtcaagagatagagaccatcctggccaataaggtgaaaccttgtctcttctaaaaatacaaaaattagctgggcgtagtggcacgcgcccatagtcccagctatttgggagacagaggcaggagaatcacttgaacccgggaggcagaggttgcagtgggccgagatcgcgccactgcactccagcctggtgacagagctagactccgtctcaaaaagaaaaaaaaggtgtgaagtaggaattagagcctaatacccgaaaaataacctttgaggatattgacggtataatgtctgttctcttctggtatactttacttacctgtaagtttaggtgacagaatccagaaatcagaaaattaaactcccaagaagctagttttaaaatcagtacaatagtatatctctgtttctcctttctctgtctgtttctacatgtgtatttaaaatccgtaattacctattcctttgtatacccaagataaggttaactcccctgccaaaaaaagagttataaaatattttcacagtggcatcttttatttgaagttttttccaatggcattgtccatttctcttatgcacaactgcaaataaaatcctaattgcattttgaacagaaaaatgtattcttaataagaaaatagccaaaaacaaaacatccctggaactagaagttacttggtaattacagaaaaagtgaattttaaaccctaaaagccattatacgattttactagctagccatttgaggtagatacattaaacattatttttacattccagatggggaaaagaaagatcaaaaatgtgacaagttggacatagaaacacttctcttagcaatttcaacgaacttagggggtagacatcaaaactattatatcagtaagctatgcgattaatagttttttctccaactgcttattttgtccattaaatcactaaaaacccttattttgaattttttccccaaattgaaaaaaataaattatttctaaatattaccaatggaattaaatactttatatacagcaccacaaatgccaagaaataatatggccaaaattaaaatcaaagttcagtaagtattttgcagggagatgaattctctaaaaaatatttttaaaaataaaaatagctaacattcttggtggctggcaagatggccaaacaggaacagctccagtctgcagctcccagcgagatcaaggcagaaggcaggtgatttctgcatttccaaccaaggtaccggctcacctcattgggactggttagatagtgggtgcagcccacagagggcgagccaaagcagggtgggctatcacctcactcaggaagcgcaaggggttggggagctccctcccctagccaagggaagccatgagggactgtgccatgaggagtggtgcactctggcccagatatgcttttcccacggtcttcacaacccgcagatcaggagattccctctggtgcctatttcaccagggccctgggtttcaagcacaaaactgggtggtcatttgggcagacattgagctagctacaggagttttttttttaataccccagtggcgcctgcaacaccagcaagacaaaactattcactcccctagaaagggagctgatgccagggcgccaagtggtctatctcagtggatcccaccccaagaagcccagcaagctaagatccactggcttgaaattcttgctgccagcacagcagtctgaagtagacctggggcactcaagcttggtgggggaagggacatccaccattactgaggcttgagtacgtggtttacccctcacagtgtatacaatgccacgaggaagctggaactgggcagagctcaccgcagctcagcaaagcctctgtagccagactgcctcaccagattcctcctctctgggcagggcacctctgaaagaacagcagcagccaaagtcagaggcttatagataaaactcccatctccctgggacagagcacgtggggaaaggggcggctgtgggcacagcttcagcagacttaaatgttcctgcctgctggctctgaaaagagcagcagatctcccaccacaacactcgagctctgctaagggacagactgcctcctcaagcaggggtcaaaagacaactcatacaggagagctccagctggcatctggaggatggccctctgggacgaagcttccagagaaaggaacaggcagcaaaatctttgctgttctgcaacctccactggtgatacccaggcaaacaaggtctggagtggacctccagcaaaatccagcagacctgcagcagaggggtctgttagacggaaaactaacaaacagaaagcaatagcatcaacatcaacaaaaaggacatccacaccaaaaccccatatgaaagtcaacaatatcaaagaccaaacgtagataaatccacgacgatgaggaaaaactcgcacaaaaaggaggaaaattccaaaaaccagaacaccttttctccaacggatcacaactcctcgccagcaagggaacaaaactggacagagaatgagtttgacaaactgacagaagtaggcttcagaaagtgggtaataacaaactcctctgagctaaaggagcatgttctaacccaatgcaaggaagctaagaaccttgaaaaaaagttagaggaattgctaactaaaataaccaggttatagaagaacataaatgacctgatgaagctgaaaaacacagcacgagaactttgtgaagcatacacaagtatcaattgccgaatcaatcaagcggaagaaaggatatcagagatttaagatcaacttaatgaaataaagtgtgaagacaagattagagaaaaaagaatgagaaggaa

SEQ ID NO: 209 - DNA, 44638 bp, Homo sapiens
acataagaaaacataaagaagttcatctactttgacctaatcatgtaattccccagaagcatcaaaaagatatattttggttgagtgaggatattcattgcagttttattttaatcacaaatgattgaaaacactccaaaaccccatcaattaggtgaaaaactacataatcatttaaaatgatatagaaagattttcattgacttttaaaaatggtcacagtatactgtaaatggagggggaaagcagcttaaaaatggtgcatgttggccggatacggtggcttacgcctgtaatcccagcactttgggaggccgaggcaggcggatcacaaggtcaggagtttgagaccagcctggccaatatgttgaaaccccgtctctactaaaaaatacaaaaaaaaaaaaaacttagctgggcgtggtggcaggtgcctgtaatcccagctacttgggaggctaaggaggcaggagaatcgcttgaacctgggaggcggaggttgcagtgagccgagattgcaccactgcattccagcccaggcaacagagagagaatccatctcaaaaaaaacacaaacaaacaaaccaaaaccaaaacaaaacaaaacaaaaaaacggtgcatgttggctgggcacatgcctataatcccagcactttgggaggccgaggttggaggattgcttgagcccaggagttcaagactagcgaccccattgctacaaaaaataaaaaaataaaaaattagctgggcgtggtggcacatgcctgttgtctcagatactcagaaggctgaagtgggaggatcacttgagcccagaaagtcaaggctgcagtgagcccagattgcaccactgcactctagcctgggcaacagagcaaagaccctgtgaaagatagaaaagaaaaaaagaaagaaaagaagaaaagagagggagaaggaaggaaggaaagaagaaggaaggaagggagggagggaggaagaaaggaagggagggaaggaggaaggaaggaagggagggagggagggaggggaaggaaaagaaaagaaaaggaaagaaagagagaatgtagcataagccagattttgtaaagcataatttatgtataaagactgcaagaccatgaggcaaaatgtcacaattttatctctgggtgatggccactcatgttttcgctttcttcttgcttacattttccaagttctcaaatatgtattacttttgtagtaagaaagttcacttagaaagtaagttaagtctgagttttctgcaaccagggtatccagaacttaaaaagataagcaggtagggcaggtaagaagtcagtcatgacattgtaagcattgaaataaaaataaaataagtcatagccaggcatggcctgtaatcccagcactttgggaggccgaggcaggcagatcacttgaggtcaggagttcgaggccagcctggccaacatggtgaaaccccgtctctactaaaaatacagaaattagccaggcatggtggtgggtgcctgtaatcccagctactctgcaggctgaggcaggagaatcacttgaacctaggaggcggaggttgcagtgggccgagatcgcgccattgcactccagcctgggcgacaagagcgaaactctgtctcagaaaaataaaataaaatttaaaaagtcatggcttttttccaggtcactaattgtctagtgagtctatgcattatcataatgtctgtgggtggtcaggctaaggagtgctttgccaacagtgaaaaatttttccagggagatacccgggagagatagtgaggcatctcaggaacttgagagttaaactaatttataaagttcatgcttgtgggggcaagatcagccatctggaaaagcacctcacctaagcagtaccttagacccgggtgagtgaagagtcatgagactcggtggagcccagccaatgtctggagcagaggcgtggggtggttttaactcatctgggaaggaagaggtggcagagggcagaaggatggagaaaaggtgatgagtgcagcaggtttagaatccggcatggtcagtgtttagcaggccccagtcaagggcagagggcaactctccctagggggccaccatgtcatcatcactcagagccttgcctgaggcttgtctagcatttaggacagttccggcagcataggcatcacttagagattgttagaaatgcaaaatctggccgggcatggtggctaacacctgtaatcctggctctttgggaagctgaggcaggcagatcccttggggtcaggagttcgagactagcctgggcaacatggtgaaaccccatctgtactaaaaatacaaaaatcagctgggtgtggtaatggacacctgtaatcccagctactcgggaggctgaagcaggagaatcgcttgaacctgggaggtggagattgcagtgagccaaaattgtgccattgcactccagcctgggcaacagagcgagactacgtctcaaaaaaaaaaaaaaaaaaaaaaaaagaaagaaagaaagaaagaaagaaagaaagaaagaaaaacagaaatgcaaaatctcagacccactccagacctacggaggcagaatttgcatttttacgagatccctgggagattcagagacacattcattacaagtgaagagtactgatttaggagacatacctccagtatatactccttgatgccttctgattatattcagcttcagattcataaaggctcccaaggacctgacaccttaggcagggcaacgtgaatcccagcctggggatgggcacccccggcctctgctgtgtgcagcatctgaatttgctttccaagtcacaatcccttattcaaaacatttggttccaagtgtgtttcagaattcagaatttttcataattttaggaaggtaagatgatgcatttgccaactctcccaattctcccagtgggatctggggcagtaccctatattcaaacattgatatcttgcagcttattatgaatattgacaccgaaaagaataaacatcacaagatcaggtaagttttggcaccaaatttaatggaaaaccttagttttcaggctgggtgcggtggctcacacctgtaatcccagcactttgggaggctgaggcgggtggataacagggtcgggagtgcgaaaccagcctggccaatatgatgaaaccctgtctctactaaaaatacaaaaattagccaggcgtggtggcacgtgcctgtaatcccagctactcaggggtctaaggcaggagaattgcttgaatctgggaggtggaggttgccgtgagccgagatcgtgctactgcactccagcctgggcaacagggcgaggctctgttgcaaaaaaaaaaaaaaaaagacagcaaataaactcacctaaaactttagacacagagataattgcccacacatttggattatagcttttgtctctctttacattttaaatatatattttatatattttaaaataatatatatactttatataatttcatataaaatgtcacactgtatgtagttttctagcctctgtttttcacttttcatctttttatataatcaaagagtcttctacagccttttcttcaaaatcaaggtagttttattgtattttggttgtaaaagtgataataggaaaaaacaaacatatatttgcttatatgtgcataaagtctctaaaaggatacactagttgctggtcacactgtttacctctggagggagccagatggaaggcagacagggacgagagaagaatttttattgtataatcttttagactcttgattattactttgtgaatgtattctctatttcaaaaataaaattaaaaaaactggtacatcctcactgcaaaagaaatcaagcaatatagaaaggaacaaagaagaaaataaattcatctttaaactcaatacccagatacaacactgttagtatttttgccacatttcttccaagtctttatctatgaatgtacagacatgtgtatggagatatttttaccaaaataggatgatgctgtacgatggtttttgttacctgtgtttttcatgtagggtgaatcacagacagcttccatgcagcctcattttaaacatctgcattgttattgcatgaagttagccagttaccaaaaaattaatccaggtgaactgagtccagcatctgaatacgcagtgccaggtaacaccaaccccctgatccaaagctgggattttcttttcttttcttttctttttgttttttttttgtttgtttgttttttgagacagagtcttgctctgtggcccgggctggagtgcagtggtgcgatctcagctcactgcaacctctgcctcccaggttcaagcaattctcctgcctcagcctcctgagtagctgggattacaagcatgcaccaccatgcctggctaatttttgtatttttagtagagacggggcctcaccatgttggccaggctggtctcgaattcctgacctcaagtgatcctcccaccttggcctcccaaagtgctgggattacaggcgtgagccaccgtgcccggcccaaagctgggattttcaatttgctgtctgtaggatcttgaataggcaggatgttatgttccagaacctggagagataacatatgggaacgggctggatgttccttctgtccatggtgtttaaacccatgtcgcttattccataggtacaaacacctctacctgcccccttcccctcagcctttatgcccactaccaccaggatgatgccagagagggccttggtggccagagccagtctgcatgtcaaagacccgagctcccatttgggctccaccacacactgagtgatcctgggaaagtcactttttcttctctgtagaacagagataataatctccatgatgcctttctcagagtgttgttttgttagaagaatcagataaggttatgactgtgaaagtagtatgtaaaatacagggcactctacacatagaagtttttattgttaaagtctggcctcttccctggagctgtcagggagaaggtagatgccaaaaccagctggcccagcttccttccgtgattggctcatggagcaaacattccccttgtgcacttttcaacatctacacactcatctttaaaatggagtgttgtaaaggtcaagggcacaaagcgttgacaagggcgtggaacaactgaaactctactaatgcttctgcacagctgctgggaagtaaattggtacaacctctttggaaaattgacagtatatactaaaactgatcatgtgaattcccctatgtacggcccagcaagtcctctgctatttatgtaataaacacaggtattgtggatgttcaccagaagacatgttattaagatgttcatagcagaactatttgtaagggtcccaaactagaaactacccccaaatgtccatcagtaattaaatggataaattacaatattttcatacaatggaataggatacagcaatgagagcgaatggtattcaactacatgcagcaatatggaacaatcttacaaacgtgttgagcaacagaagcctgaccaaaataagagtacatacttgtttcactaatctatacttgtttcgctgcataacaagtatagatcccaaaacttaatgtcttaaaacaacagatagattacttctcatgagaagatgggatagctgtgcaatttctcttctgatttcaccttagttgagtcataaggctgcactcagatgcagatttggctgggtgggaaggtctgaggtaccctcacgtgacctcattctggtgatgctcagttctttcccaggtggcctagaccaccttccttacacggcagtctgggggcagcatttcaagagagtgaaagtagaagctgcaaagttttaaaactaagggttgtaactatcaagagttgcaagggcccagcctcaggagcttcatcgtgtccatttctctgcattctattggtcaccccataagtcaaaaggccagcctagattcaagggtgtgaaaatagaccctacctctccctgagtagaagtcacattgcaaagggtcatgcatacaggaatggaagaaatctgtggtccatctaccacaataccctgtgattccatttatagaaagtagaaaagcaggtaaaatccactgaagctgttataaattctttgacgaatgggcctggagaggagtatgagagaccatctgggttcctgatgtgttctgcttcttcatctaggtactgatgactagaatgtccagtttatgaaattcagcaagctattaacttaagacatctgaaactttttacgtgattactatacttgaattgaaagtctaagttacatagtggttttaaaagaatgcagttcatttccctttccagttacagttccatccatcaggctggtggagctgctcatctcctcaatgttcctcaggacccccgcttccttctttcttgccatgccatcatcttgtcctcatcgagagttgaagctgttgctggcagtctgcattccagctagtggagaggatgcagaggggtagccctggacaagcacattccttgcaagctaataaggtggaagttacacacattacttccactcacaatccactggcaagcactgattctcatggcctgcctagctgggaatgtagtcttagctgggcagcctgtgccaaggatatgtgccaatttcagggaaacaactagcagtctactgcattttttttttaatggagtcttgctctgtcgcccaggctggagtgcagtggtgcgatcatggctcactgcagcctctgtctcctaggttcaagggattctcctgcctcagcttccccagtagctgggatcacaggcatgtaccaccacatctggctaatttttgtacttttagcagagataggaattcaccatgttggtctggctggtctcaaactcctggcctcaagtgatctgcccgcttcggcctcccaaaatgctggaattacaggcatgagccaccgcacctgccacagtctactacattactaataataaagctgctctttaataattatgttttcagaaggccatttggaaatagtttttatctcactgttggattataaaaacaccaagtgacccgagttctacacttttctgtgccaaaatgaagaacattaataataagtatccatttcccctcaagtatatatatttaaatcataaatatgtaagtaaatgtatacatttatttaaattttaaatatgcaattggccaggttccaagggcttatccaccttcctggaaaaaaattgtctttggaaaattccttgatatgattttagagggcagcctctaaaatgaagtgttcaatgaatgttcaaggaatgaatgaattttagcaacctgtatcttaggtgctgagagtatctgattagggcatatcagactaaaaaaagtcctctacaaacactagaatttactaatctattttctacttaaaatgcatagataatttgacatcaagcacatgtacagtttatggaaacaattttattggtaacagaaccctactaactcatcagagccccactattttctcccgtgtactttccttctcctggcagcctgtcccccttccctgggaccccctcccaactcattcccgtgaactttctgacttgctgcctctctcccttctgggaaaaagtgtcagctgctgcactaataatccagcacatgctacgactgtccctgagacagctgtctactgcccctaggcacttgggcaggggatctccttggagccagaaagttaataactggtcttgaagatacaaacaatgtcatggtctatgactttgtgacacgatgcaaaggaaagcgtttgggctttgagtcaggcagacccagattcatacctcagctcttcttaatatgtgtgtgactttgggcaaagtactgcatgtttctagccctcagcttcctcatctgtgaaatggaaatcacaatacagagaatattgggaataacaaatgagaataaatatatttagccctctgtagatgctcagtgaccgggcttcctctcccactatctctttgtctttccagagttgaaagacccataacaaggaatcaaaggagagtgaaacgatgactaaaggtttagaggataagatctaagaatggatgaaggaggccgggcgcagtggctcacgcctgtaatcccagcacttaggcgggcggatcacgaggtcaggagattgagaccatcctggctaacacggtgaaatcccgtctctactaaaaacacaaaaaaattagccgggcgtgatggcgggcgcctgtagtcccagctattcgggaggctgaggcaggagaatggcgtcaacccgggaggcggagcttgcagcgagccgagattgcaccactgcactccagcctgggcgacagagcaagattccatctcaaaaaaaaaaaaaaaaaaaaggatcaaggaatggtaaacgtttattttattttattttattttattttattttgagatagagtctctctctgttgcctaggctggagtgcaatggcacaatctcagctcactgcaacctctgcctccccggttgaagcgattctcctgcctcagcctcctgagtagctgggactacaggcgggcaccaccacacccagctaatttttgtatttttagtagagacggggtttcaccatattggccaggatggtctcgatctcttgaccttgtgatctgcccgcctaggcctcacaaagtgctgggattacaggcatgagccaacgcgtccggcagaatggtaaatgtttaatatggaaaagggaacatttagtctggacagagaggacaataaataattatggctaccatttgtcaccacctttcctggcatttacttatttatttatttattgagatggagtttcgctcttgttgcccaggctggagtgcaatggcacaatctcggctcaccgcaacctccgcctcctgggttcaagcgattctcccgcctcaggctccccaggtagctgggattacaggcatgcaccaccacgcctggctaatttttgtatttttagtagagacggggtttctccatgttggtcaggctggtctcaaactcctgacctcaggtgatcctcctgcctcggcctcccaaagtgctgggattacaggtttgagccactgcgcctggcctttcctggcatttaaaatagctatgtccagtcttcagaacagccctgtggcgaggtatgatcatgaaacccacgttataaagtgaagaggaaacagattttataacttgcccaagatcatccagctaaatggagaagtggagattcaaagtcgggtctgactctttgtactagcttaagaacagactctcagctggatgtggtggctcatacctgtaatctcaacacttaaggaggccgaggcagatggatcacttgagcccaggagttttagaccacacaaacacacaaaaaattagccaggtgtggtggtgcatgcctgcagtcccagctactcaggaggctaaggagggaggattgattgagccctggtgattgaggctgcagttagccatgatcacaccaagagagggaagaaggaaggtggctgtcagtcactggtatcagagacaagcagaggacagagaagacaaatgcaaaatctttctttggctgggacttgtcagaaagggaatctccagtgttggtgatggtgtcaccaacagcctcatgtgccttatgtgtgggcatctctgaaggcagaaagaactccattttccctggaggaaaatggaccagtgagcatgaggctgaggtctgactcctgggggccacacaggcaggcctgagcaccttgcccctcctcactgaagggggcttaatgtctggggcacagttgactccatccctctcttttttcctgtatgtggttttttgtttttttttttttcaagacaaggtctcattctgtcacacagactggagtgcagtggcacaatctcagctcactgcaaactctgcctcccaggttcaagtgattctcccatctcagcctcccgagtagctgggactacaggcacgcacgtacaggctggtcttgaactcctgacctaaagtgatctgcctgcctcgtttttcctgtatgttctaatgttatttcagggatcccctttgcctcactctggccattccaaaacatatatatgtttcatttatataaatccaaatgaaaatattaaaattgcaagtgagatatttttggccttaatctttgaatttcaatgttttcttatctgtagagctggtgtgctaactcctgtaattctgggcaatgcccatgtggttcttggctgcttcaagccatctcaggtctgattttcacacaagctcagcagcactgggctagaagggtaccgccctcccactctgctgccactttgaatagaagtccaagctttcgctttcttgccctgactttgattcttcacattgctgaggagcagtgattgaagcttaatctcattgtctacagtccgtctcctctatggagctgcactattctttcccatctcaattatttctgatgtaaccaaaacactctctctccccactgccttttttcttttgtaaagacttgcaaagggtcagttccagaggctcgagccctgtgttctgactttcacagacagaggcctgccactcttacatttacaggtcatcattctgagcaatacactttttttgaagagtagtcctaaaagctcactaaaaagttgcatttgtatttaacttaaatagagaaccttatgtgtagtccatgtttctggactctatacctgattttgaatcactggacttaaattattggacttacaacactgatacatcttgtaaatgaacctaagcaaagaataccagccctacatcccactcccctcaagataactgggaaagacacaaagccatgctgaggaggagccatggtttgatattgtccagtgagtgtctcttggcctcagaatgctgccacttcctgcagttccagcccttggctgtggtccattctgagtaagtgaattcctctgttaaaacttgcacacaataaggagatggcgtcaccaacagccagagaagtcaagggtcctgatccatccagagacaaggtgaaaaggcaggctgggggggaaagggggaccagcagattaggccaagagtgtagcatcatgaaatgtgatgtcttcatgagaaatgcaaggaaataaagcatttgctgtacatatctaacccgtatgagagagaccccacttcttcagaggaaagcataccagggaggtcagaacttgggccaactccatgacttcaatggtagagaatggcacacgggccaaacaggatgcataccatcaccaagaagtgtcggggtctcaccggctaaagacatgttacaaaggtgccctcagtcacctgcccagagaataaagcagggcccaggcagggaaaaacacacaaggatactgatctttagctgctggcttcctggggtcttgatgccttggagatggaggataatgggagagcccgaaaggcagtctttgggggtttcagctgacccatctccctccatctgcatcttagaggccactcttctaaaaactacaggcgcatacctggtgggcagggaatctgtgccacttggtcaggtcaacatttccagatctcgttctccctggtcagatttatgatcattaagtctaaaacatctgctctttttcctcaagcaacagttacacctgagtggctggagaagccactccaggtaacagtacagcaggctgtccttactatggaagtttggcttgtggccacagctgtttgcagaatgcccacaagacatggtcctgcctctattctctgagggaactaccctgtctcccttgagaggagctgagttctagaagactgttgtaggacagatttggtttaaagttctttaaggcaatgctgtttctgtctgtggcagaaccctgtgtccaggacagaatagatggaggcagtggggtgctggtaaaccagctttctggaagagaaaacaccaccaccaccgattcatagcacttgttaattttcatcatgtaaatacctccatcatgatcagatttcaggctaccaaaggtttaaaaaccagttcacaaaaaatcctgaatatttaacaatcggccagcaggggctggctccatccagcagatccaggactctggggagctgggttgcataagacatcttttttctctgatgctttgaaatgttatgagcttactgtgttcttaaacttcagctacagaatcaaaacagggcagagactttctgaaagtatccttactcccccttaccctcaccaagagctggggctttcattttagtccttgaaagaagacttgaaaagtcacaattcttgttctcttttccaaatattttgagtgtcacaagttagaatctgatgaagaacttcaggtagaaagaatgtaagagccaaatctacgtgagttctcaggaatgagtctatacaacatggtaccaggggatacaggggatagcatcttgacatcacctcttaagcatgagactggacagtggcagaagatgggtggctttgtaatgctgagcaatgggaagaaggagttttaaagaaggttttaggacttcatgtatcttttgaggagaactaacagcaggctgcttacctccagtatcttggttccaaatcttcaccttgcaatcatgtgatgaggtagcaattaaaggcatcaaggccaatgctcttggtagaaagacgcaggatgcgacagtctggaaatgccccttatactcacatattctgtttcgagtctgtcttaggtcccacaactgcaaagtaatgacatggaccagctcatagtcacttgtctagcttcatccatgaatatctatctccccctacccccatgatgcacctattccctccacttacctgctcacgtagctaccccttatcttcatccatccacagacccaacaacccatccatccacagacccaatgacccatccatccagtgattattttaagcctcaactatgtctcaaacaaccctggttaagaatgtgtcatatgagtttttgcctttttagtggttagggaagtaaaagctcccagtcctacagcatgatggtgttccatcatggggaacccatggggagccccaaacaacagtatggggttgtttgctttcatggcaactcaagagctgccttatttcaacctcttggcatctgtgggccctgtggggaccccgtagttagaagtaccccatagatataagtacatctaggtgcagacattctgatttaatgcctagatgctgaaccttgatgtgtgaagactagcgtctacaagagggaagtgccagtcagtgctgccagtcccactctcattgatacagatcagatcacagctggagaataatgttcagggaggagagcaaattgaattatgtccaaaaagataatgaagttattggacagcatgttatccagggaatagctgtaggagctggaaatgtttcacttagaaaagagatgctacattcaaaggctgcaacaccccaatctaccatttactagggatgtggtcttgtgcaagagatgtcaacttgccatgcctctatttccttgtctgtgaaatgggaattataatagtacctaactcatggggttgtttttaaggattaaatgagatattacatgtaatgtgctcatcccagtgcccagcacacaagaaatgttcaataaaataggaggcataattgttctgtttgaatactagataacccttttaatggatattctacaattatgaatctaaggtgctttggaggagcctaggcaatctattccaaaattaaatgtaaggaaggtacatgagtaagggatggagtaggccctggaccaacactagagctccaaatttcctaaaaagcttgagcttcttttactgtggccacgcctataatgggaataaatctggttcttcaaacagtccctcccctctctaagctctgctgggagtagagacatcagcaggctggttctgtgtttagctcctccccatcttgactctcatcccattcctctttcctactaccaattcagagagccctaagttgatgaatgtttcttttattttctttctttatttttttgagatggggtctcccttgttgcccaggctggcctcaaactcctaggctcagttgatcctcccacctcagcctctgaatagcttggactacaggcacatgccaccatgcccagctaactttttatttttttatagagacagggtcttgctctgttgcccaagctagtctcaaactcctgggctcaattaatcctcccgccttggcctcccctatgaatgtttcttaaatgaagcaactggaatgcaaaggatcactcacagtatgcttttgaaagaggcctgagccattagcaaagcccgcctgtgtagcacagctacaggcatgaggccagagtaagtgatctgttcatcagcaaccagatacctggacctcacacagtctcctaccgtggcttcacagccttctcctccaaagccattgctgcaggagatacacttgtgtccatccacactgacttcacagtaggtctgaatgtgctgctttgcaggaaacatatgagctacctgcagcccccgactgtcccataatctgaaagagattagggcaggaaattagcttgtagtaaatgtggctgaaatacacccgtattgtcccactaccaaaaaagtcttggctctttgctgcataggccagtcagattggaatggcatgatttacctaaaaacggcagcatgaaccagatcaatctctgagactctaaagttggcaggaagtaaccaaattgaatgacatctgagttctttctattttgagatcagttaatagaaattgagaccaagcatcttaattgtacaagttaatttgttaatttggtcctttgagacactgctttccgtggacaaaaggatatttctgtgcctgtgacttaaatttttaaaaagatacttattatgatatgggaaatcagtcatcattcagaattagttacaaaagatttacatacaggtcatggccagccttggctatggggtccactggggagtgttttgttttgcttcttatttcatttttacctctttaccccattcctaccattttctaaggagaatctcttctgagatccaaagtttctagttatcctctccggtctaagaactattggctttactgactcccctgatgctgatttcaaccctgcttccccagggagggcttcagctgaaggctgggtgactgagaacaccaggagccatgcaggggtagcaaggagagccaggcagcccaacagggtgggacaagcaagtgactgattctggggttaatctgaacaccttcacacagcaggagctggctgaatcagatgctttggaaccatccaaaacaggggcttttacttggcctgatctcatgacacacaacctctaccttaatgatccatggggccaaagcagagaggccccagcaccagtgaagggcagaggaacagaaggctctgggaagggcagagcaatgtggagaatcagagtgggaatggagccatgtatgcatgggagccacaaacctcacaagaaacactttcacagctgctcagtaagcccacctgagggttttatcttcagaggtctgtagtatgtatggttctctggggacccagcacaggtgagtgacctagaaaaagcaaaatgttcagaacttctccacaccaagtcattcctctgctgtaattcctgtcaaatgtgctaactagcatcactgtgcctcttctcaaggattctgaactagcaaattcatttacaggcatcttaggttttgcagatacctatcagtcatgctctacctgcatctcctaggttatcagcagcaagataacagctgggccagttgtgagcaccaaaatacatgcaggcaccctaagagtgcctgaaaccccagctgtgtggcagatagaacagctcctgttgtaaggtgggttcactgaaactctagccccaacacctcatggggatcaggaagagcattcatgtttctctttatccctgcaggtccctgctggataggcataaaatagtttccaaaataacccgaaataacaggattttcttttcttccagtaacctccaccaatatagagggcatggggcaagcatatctgaccattggcagtcatcttcaaaattagaaaagatgactgggactgaaatttgacaaccactaaaagaacatctagtatgggtcagacacaatgtcaggtatttcacatctagtatctgaattcatcctctgaagaaccttagcaggtgatagaattctccccattttataaatgaagacacagacactctaagagcttaagtaacttccttgagataacataactggtaagtaatagatccatgattttaacctgagtataactgactccaaaggctctccaatttataccagtctgctactagaaaacaactggtccttcaaaagcaatgcaaattctacataaagcaaaaggtaatgcttatttctccacatgatgttacacatatgaacatacaataagcataagctgtgaggtcctggaagacaggaactatgttcttggtcactaaccctgttcctagcacagtgtctggcccacagaagaaacagaataatgaaagaaataatgaagacaccattttaaattccaatataagtgagtaaaatcattgtctggagcagaagactcaagggaacatctaatctaataaccctgagaggccagggtctcacagcaggttaggggacagcaattgggacccaggctctaatttctgctcatgggcctcctgatttatctcccgagcctttccttcaccccatgctcctttctgctgccctgttctgtaccaagtttgagttcataccacgttcctggagacagatgctctttccacactctgtcctgtcaccacatcccacagaagcagggtgttgtcccgagagccagtgcacagctgtgatgagtctttggaaacaatggtgagaagacagcctgtgagtggggacctgaacggggcttttcagaaagcacaaaggcattgggaagaggtccgctttgttttacctggactcacagccaatccggtgaccaccatggcatggccacacaattgctgccttggttgtgaggaaccgtgcaagtcccacatcatgaccatcctgtcacgagaggcactgaagaactggctggatttgggaatacaggctacctgctcagggaaaaaacaacaacactgaaatagctctggtatgctagttggactggactttaaattgggggaaagatgagtctgcataactccctccccacacacacttcttttctttttttttgagacggagtctcactttgtcacccaggctggagggcagtggtgtgatctcagctcactgcaacctccacctcctgggttcaagcgattctcctgcctcagcctcccgggtggctgggattacaggcaccagccaccacgcccagctaatttttgcatttttagtagagacagggtttcaccatgttggccaggctggtctccaactcgtgacctcaggtgagccacccacctcggcctcccaaagtactgggattacaggcatgagccactgtgcccggcccccacacacacttctcaaaagagtaatacctaagcttgaaatctatgaatgcacagcatgggccagtctgaatttccacctttatcaatgttgtgctacctttcctttatgtagcagatttcctcctgtccttcagggtaaggttaaaaatctcacctcctcagatcatgtcaccttggtgaggatgtatcccctcttgggcttcctatagaacttcctcctgtgggattccttttgcacttgatcatcaccacaccccaaaaatggatgctgtactgttatgacaggtgattctgttatacttacgaagaatttgaagtgaatctctgttccattttatgctttttaccttgaatacaactttgcttgatattattatcatcccaactcctgctctgtttgtttacatttgcctgatatatctttgctgacctactcttcctgttctgatctcttccatcgtgtttctttttttttggaattgtggtaaatatacataaaacttaccattttaaccatttttaagtgtacaactcagtggcaacaagtacattcattgttgtgtaaccatcaccactatcatctctagaactttttcatcatcccaaactgaaactctacaacctttaaacaattactctccattttcctctccccgcagccgctggcacccaccattattctactttctgtctctatggacttgactattctaggtacctcaaataagcagaatcataccatatttgtccttttgtgtccggctcttacttagcataatgttttcagggttcagccatgttgtaacatgtatcagaatttcattccttttttttttttttttttgagacagggtcttgctctgtcacccagactgcagtgcagggacctggtctcggttcactgcaaccttcccttcccgggctcaagcaatccacttgcctcagcctcctgaatagctgggactataagtgtgcgccaccatacctgactaatttttgtattttctgtagagacagggttttgccatgttgctcaggctggcctcgaactcccgggctcaagtgatctacctgcctgggcctcccacaatgctgggtttacaagcacgagccactgtgcttggcctatttcattcctttttaaggctgaaaaatagcccactgtatgtatattaccgcattttgtttatccatgaatctgtcaaaggacatttgggttgtttccagcttttggctattataaacaatgctgctatatatatatatgtgtgtgtgtgtgtgtgtgtgtgtgtgtgtgtgtgtgtgtgtgtacaaatatctgttctatatttactaactgttttactttcaatcttaaagctgttttgcattagatatgtcttattttttatttatttattgagacacagtctcactctgtcgcccaggctggagtgcaatggtgtgatctctgctcactgcaacctctgcctcccaggttcaagcgattctcctgtctcagcctcctgcatagctgggattacaggtgtgtgccaccatgcctggctaattcttttttttttttaatttttagtagacatggagttttgccatgttggccaggctggtcttgaactcctgacctcaagtgatccacccgccttggcctcctaaactgctgggattacaggcatgagccatcgtgcccagcctagatatgtctcttttaaacaatgtacaggtggctttagtttttaactcagtaagagtactgcctttcaataagtgaatttatcccaattacatttactgctatcatatatatgtttgatcttgttccttccatcttttctgttggtttttgaaaaacactttgtcatattttcattgtcttctttttctataaaattgtatatttgtttttagagttatttttccctttatatttttaatttaaataatatggaacttaagttcttctcatgatacctctgtatatgtattaatatccttaaactcatattctcaatgtattaatttcagaaagaaaacagaatctcctgtaaggaaaattttttttttctttaattagcacaattatattacttctggctcgttcccacttttgtaagtactctcttggatttttatctagtctattatcatattattaatattttgtattttatacatataaatttttaaaagaattaaaacaattacatttcttctcatagccctcgttttgacaattctttagacataattctgtgtttaattggattgaaggctcatacagtgaattcagtttggaacttctttaatattcattggctttattattcatcattcattcacattctttattttttattttttattttttgagatggagtttccctcttgttgcccaggctggagtgcaatggtgtgatctcagctcaccacaacctctgcctcctgggttcaagtgattctcctgcctcagcctctcgagtagctgggtttacaggcatgcgccaccacacctggctaattttttatttttagtagagacggggtttctccatgttggtcaggctggtcttgaattcctgacctcaggtgatctgcccgccttggcctcccaaaatgctgggattacaggcgtgagccaccgcacccggcccattcacattctttaataatataccttcaactatattattgaggaatgctttgcatatggcaagattttacaaatttaagaatgtcttcccattgcctttacacatgaacaacactctccgcacatacagattctttttctttcttcctttcctttcctttctttctttctctttcttttctttctttccttctttccgtccttctttctttctttttctttttctctcttctttctctctctctctctttcctccctccttctttctttctttctgactgggtctcgctatgtcacccaggctggggtgcaatggcacaactatagctcactgcagcctccatctccctggcttaaacgatcctcttgccttagcctcccaagtagctttgactataggtatgcaccactatgaccaccgaatatatttgtatttttatttatagtagagacaggtcttgctatgttgcccaggctggtcttgaactcctgagctcaagcaatcctcctacctcagcttcccaaagtgttgggattttaggaatgagctaccctgcctggccaatttttactttttaataatattttttcctcaaatattttctctcccagataattcttctattgtcttacttttttttttgagactaagatcttgctctgtcgccaaggctggatgcagtgaaatcatcacagctcactatggcttcaacctcatggactcaagtgatccttccacatcagcttcctgagtagctgggactataggtgcgcacaactacatccaactaattttttaattttttgtggagatggggtctcattatgttgcccaggctggtctcaaattcttgggctcaagcaatcctcctgccttgccttgccaaagtgccagcattacaggcatgagccactgcacctggcttgtcttattttttcaatttcttgtttcatagagtacatgttctcttaatttatagagagtaaaaagcattaatcaaattttatctttgcttcttgagtagttcttccttcaaagtgtattttcatctgacattagcttgttatatgtatatttaaaaaaatctaggcatataggcctcactttggatcctttctgcttattaatcttttcatctttgaatgaggataagtccaatttttggcagtaaatccaataaggcttgatacatgctcaagtgttacatgcacacacacacacacacacacacgtgcacacacacacaagtgcatgcacacacactcacacacagtcaattctctctcactttctttccttttagtccaaggtctactataacttgacttgtcatgctgaatattgatggttgattatgtcttgatttgtcatcctgaatattgatggctgattatgtcttgtctaaatagctgagactacaggtgttcaccaccatgcctggctaattttttttatttttggtcaagatggggtcttgctatgtcccaggctggttttaaactcccggcctcgggcgaatcacttgaggtcaggagttggagaccagcctggccaacatagcaaaaccccatctctactataaatataaaaattagccgggtgtggtggcacatgtctgtaatcccacttacttgggtggccaaggcagaagaatagcttgaacctgcgagatggaggttgcagtgagctttgatcacacaacggggagagtgagactctatctcaaaaaacaaaacaaaaaattcctggcctcaaatgatcctcctgcctcagcctcccaaagcactgggattacaggtatgagccaccatgcctggccagtccttcggcattttagggtgaccagaagaaggagaagcaagctggcagcagtctcaattttgttacattgtcttgttttactggtaaacaatctatatctttagtcctcatctttctaaataaagggctgttgggaggaccattcaggaccagctcttttagtgacatctgcactctgccaaatatctggggataagtgcattacagcatggtgttctctatcagtctagttcagaacacaatgtatctggcaagcaaatatcatattctgtgctatgggattgtggctgatgcctagtttcattataaatgaagtgtgtatcttaatttttggttcatttaggcggacttcagagcggggaattatataaattggcattctctatcatttttgctggaagctcactctggtctgtaatgctatctaacaaataaatttttatttcattgttattgaatgttcattaaatgtccccaactagactagaaggttgctgagcacagggattttgtcactttcctagctatggtaagcacagggtaagcccaagccttcagtacagtacttgttgagtcaggataggtcaagagttgttatcagctgtgttctgtttactacctgtgctattaagggcttaatgacaaaagaaaaattgtgttcgatatgcctgtaacaacaactaagtgaatggtttgctctgtttctcctgaagtaggatttcacagcatcaaacaaacctttgcatttttccttaagaccaaagattcaatcactcttaatatctagaactattagctatcctttattcagttccagattgccttcataataatcatttgaaaattaccttggtgatctcatgttcatgtcctttgaaccttttcaccacatttccagttttccaattataggccacaactgtctgaagagagtgaagattgtagtttcattactcaattcttgttaaagtgacactagcctctactgcattctcaccttactttctccctcctcactcactccctctctgctcaggaacttgctcaaagcattcggggttccctgttgtggccgtccctcctcacgtgcccctcctttgagtttcttttctttcctcctggttgttctctgtctccctccgacactggaccactgctctaaacttactgatgggtttgggctaacattccccaaggagaactgattcccctggaggttctgactgtagatggtgaaggagaattccacataaggttagatttgttttccctatagtactgtatttttttgttgtggtgtttttttttttttaatctaccatttcaagctgggcgcagtggctcatgcctgtaatcccagcactttgggaggccaaggcgggcagatcacctgaggtcgggagtttgagaccagactgaccaacatggagaaaccccatctctactaaaaatacaaaataagccaggtgtggtggcacatgcctgtaatcccagctactaaggaggctgagacaggagaattgcttgaacctgggaggtggagattgcagtgagccaccctgcctggcctagattttaagacaaaatactgccaattaaactatgatacttcgatgcatcctgatttcagaagtgttaaaatgtgaaaagtgaaaacagggccaggcacagtggcgcacgcctgtaatcccagcactttgggaggctgaggcgggcggatcacctgaggtcgggagttcgagagcagcctgaccaacatggagaaaccccatctctactaaaaaaaataaaatacaaaattagccgagtgtggtggcacatgcctgtaatcccagctacttgggaagctgaggctggagaatcgcttgaacccaggaggcggaggttgtggtgagccgagatggcgccactgcactccagcctgggcaacaagagcaaaactctgtctcaaataataataatataataaaaataaaataaaatgtgaaaacatgcatcttagaaccagtggaatgcagtatgcaaatggaatttgaagattctaaaaggctattgaaaatgagagacattattattattattttttgagacagagtcttgctctgtcacccaggctggaggacagtggcccgatctcggcttactgcaacctccacttcccaggttctagcaattcttgagcctcagcctcccaagtagctgggattacaggcaagcgccatcatgcccagctaatttttgtatttttagtagagatggggcttcgccatgttgtccaggctggtctttagctcctgtcctcaagtgatccgcctgccttggcctcccaaagtgctgggattataggtgtgagccaccacacccggcccattattagtattattcactacaaaaagaattagcagttgtactaccagtatcccagctgtgagggctatgatagatcctaatatgaaggagagaaatgtgagaatgggaggaaggaagacaaaaacacagggaggaatcatgatgcataccagtgtagagagcataaaagaagagattagacagttccttttgctgacaattaactcctgtgtctccatgtaggtgtaacatgggattggtggtaagtataatctttgccatttatagaaagcatgtgggtggtcaggcatagtgttaagatctcacctacgttctttgatttaatctttaataaccacctgtgaggtggcattattattcccacttaacagataagactgaaactcaaaaaaatttaaagacttgtccaaacgaatgggaagtggccaagcagggatttaaatccagtctttctaactctaaagccaatatttttacacttgtcaaccctgctccagaaatgcaaatcctagacttcctttcaaaatatcttcctttccctgcaataaagttcatttcccgggaaacactgcaaaccccaccttatctttccctccagagacacaaaggtctgagttcaaagcagccacgacagagacggtatccatgtgagctgggctatactcttgaaaagctttagtttgaattctctcttctataatttcatcaggcctgctaaaaagagtatagaaaatgagagacccaatggcatgggagtggatgggggtggggtggggtggggtagggagaagaatgtgggttaagaaggcaattcaggccagactaaggagaaatatttaaaaaggagaagagaagggagacccatttacattgtcagcaatggtattatttactctgaaaatgtgcagaatgactgaaggactggaatctgataaagggggatcctgaagccaagaagccaggagtctttctttgctcacactagcaattaatcctgaagatttagggcccctctgtgtatgggtgcagacactagctaataaacttgactgtttctttcttttgagacagagtctcactctgttgcccagactggagtgcagtggcacacatggctcactgcagccttgacttcctgggctcaagcaatcctcccacctcagcctcccaagtagctgggactacaggctcatgccattatgcccagctaatttttgtattttttgtagagatggggtttcgccatgttgccaaggctggtctcaaactactgagctcaagcaatctgtccccctcgggcttccaaagcgctgggattacaggtgtgagacagcacacccagccctgactgtttcttatccaaaagaaaacacactaaactattcagggaaggccaactattcagggaaggccatcaacattcgccctgggccttctctttcttcagtggagagttttaatggggcatgataaaacctgggctcccaggggaggattgcagtacccgtatttataagtgctgtgtttgagtttgctttgctgtttccccatcacgacacaaaacctaaacgaaaccttctgtggaggagcttgtttcagttggcacctgagtagcagcatcccttgtggctgctggaagttgtgttccctgtttaataaaaagaagaatacatgttgttaattttgttaggcacaatagtatgatgttgaaaataaatccttttttagactaattaattgtatgcttttgcttttcctcctcaccctgcttcacacttacagccctgaggttgcagacacacaaaaacaaaactgattttaaaaaagactaagaagtcctgtaataagtaaaacacagaattgccatacggtccagccattctaatcctgggtttaaggccaaaaacacagaaacagatgttcaaacaaaaatttgtgcacaaatgttcacagcagcactgttcacagcagccaaaaagtgaaaacaactcaaatattcatcaacagatgagtggagaaacatcatgtggtcaatccacacaatgaaatattactcggccattaaaaggaatgaagtactcgtacatactacaacatgggtgaatcttgagaacatcatgctaagcaaaagaagccagacatgaaaggctacacagttcatattctatgtatgcgaaatatccatagttggcaaatctatagagacaaaaagcagattagtggttggcaagagctggaataaggaagagactggggagtgactacttaatagatacagatagaatgtaatacagagtatcttaataggctagatatagtttggatatgtgtcccctccaaatctcatgttgaaatttgatccccaatgttggaggtagggcttagttggaggtgtttcggtcatgtgaccagatccctcatgaatacttggtgacatctccctggtaattagtgagttctcactctattagttcccacaagaacgaattgttttaaaaaagcctggcacctccctcctcacctggttccttcctctcttgccaagggatgcctgctctcctttgcctactgccacggtggaagcttcctgagccctcaccagaaacagaagcctgcgtcacacttttcatacagcctgcagaaccatgagccaaataaactgcttttctttataaactacttagcctcagttatttttttatagcaacacaaacaaacaaagaggcagagtttccttttggagtgatgaaaatgttctagaactagatagtgatgatggttgcacaacaatgtctctatatactaaatgtcactaatcataaattttatgttatgtgcactctgccacaataaaataaatactaagaagatgtaatcaaaaataaaaaataatttacactactgaagcttcttgaaaaagaaaagcctcagttattctaaaaggttataaccttccttggttgttggattttttttttttttttttttttgagacggagtctcgctctgtcgcccaggccggactgcggactgcagtggcgcaatctcggctcactgcaagctccgcctcccaggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggatttttttttttttaataatttcactatggcacctctcagtgtgccagaatcatgaaatagatgttctgagatgctagaaataatgccactaaatgagacaatgtaggtaatgacctagactagcagttcttaaagtgtgatccatggaacatgggggattcctgagagcctttcagggagtttgggaggacttctgttttccaaccacatctctcagtgaggcccttcgctccctccctcccttccttcctctccttttctctcctccttcttccttcttccttctcctccttctccttcttctttctttctttttccttctccttctcctttctttttttttgagacagggtctcactctatcacccaggctggagtgcagtggtgtgatctcactgtaccctcaacctcctaggcttaggtgatcctcccacttcagcctcccagggagctgggactacaggcttgcaccatcatgcccagctaatttttctgtgttttttgtagagacggggtttcgccaactcctgggctcaagcaatccacgtgccttggcctcccaaagtggggccttcttttcttttaatacctcaacataaacaatagattataatagactgaatgcagaagcagatatcagagtccaattgtctcctttttaaggcaaacattagaaatttgcaaaaacataaagcaataccacttcttccaattaaatattttggttttggaaagtatatttatttttcataaaatgatgttttatgttaatatgcaataggtttattgctatttcaaaattaataagtaaatgtctttaaaatttgttttttaaaattaattaattaatttacttatttattttatttttttgagacggagtttcactcttgtcacccaggctggagtgcaatggcgtgatctcagcccactgcaacctccgtctcctgggttcaagcgattctcctgtctcagcctccagagtagctgggactacaggcatgcgccactacatcaggctttttttttttttttttttttttttgtatttttagtagagacagggtttcaccattttttggcaaggctagtctcaaacccctgacctcaggtgatccacccaccttgacttcccaaagtgctaggattacaggcatgagccaccgcacctggcctcatttatttatttttaaatttaacaaaccctgcatgtggcattcaatctcagttttaatgtcaaatgatggtagcagagcaggattcgaactcaatctataacctacataaacaaaacctctttgggggttcttaattttgaggagtgaaaagaagttctgagaccaaaaagtttgagagccagtgacttagaatttaaataatgttaatattggattatatattagaattaaaagaataatgaaacattttccagatttacttgtatcatccccctcaactaacgaggctagaactgaaaagaaagagaatgaattatgcattcaaaggtgctcctccactcattcagggaacacctcctaagcaccttatttgtgtaggtcctataccagttgctggtgaaactgaaaaaaagagaaacctgaagatgtgaccagcatgaacatttgctgggaccgaaggaacctaacgaaggaccagtctcaactactccatgtcatgtgtcccctgcgactggctgtgatatcagatagctgagggaagtatggggggcagtgggagcacccagtccccatttcttctgaggttctgcctaaaagttctaggaaataagtttcttatgggcatgaccaacctaattctaggaagaactgtctacaggaagaactgtttacagaagagaacagcagctaaaacgcaccaacttaatattctcattcataccattagcattaaaaaaatggagttttccagaagaatttcagcctacattttgagaagttgctagaattgacttcctgacgagaataggtaaccaatacagaaaagcacaatgcaatggaaacaatgtgagtggcatcaagaggcctaggatctaccccagccctgcctcatcccattatgtgtccttgagtagctccattccccactctggcctcagcctccccagctagaaaattaggacactatacgaaatgatttttagtagactatgtgtataatgagagaaggtctctcgttattcatctttgtaccccaagtggcttgcacagtactgtacaacaaaaatacttgtgaagtggcaaatctaaggtcccttccacttcagatattccaggattttctataagaggccacaagatgtgctgagaggcaaaattcaggatagttttcaaaaagtttgggatgtggtattgtttacagatagagggtgcagggcttcttatctgccagcctaacctatttttcaacattgtcatcaaaccaatgacagatgccattcatagatctaggtcactggaaattgcagatgctataaatggattagctctgctcaaaactgattggtatagtcagagagccatacttcccaagtaaaccatattcatgggacattctaaggaaaagataacttttagaattacttacccccaaaccaataggatcttcttggttagctgccctattcaataatttgtaatgtgtatcctttggaaaatagttcaggcagccacttcttaatctctgtaattagtgggaagccactgaagttaatctcttctctgtctaagcatgtttgcactgaaaagagatttacaaggtaaataaagaccttgtttattaaagagatggttaggtgtagttttccctcacaaagaaagaaatattttacaaaattccaagattatctctctcacatttccacaattcaggaaagtatactatagtgttaattatatatctatttttaaatatgcaaaatatatttaaatacattgttaaacattttgattttgctcataacatagtacttctattcatcaaaaatcttgagttgactgcttatttcagagtttactgcttttgtgaaaaaggcaatttctcctgttttaaataattctcctagaatttgagatgggagagcttttcaaaatcaccatatataaaccatttatttatttcaagatctgcagagtaagggtagaaatattatttgctcaaaattataactaagaccatttattgaaagatctgcagaataaggatagaaatattatttgctcaaaattataactaagtaaatctcttgacttctagtccagaatttccattataaatgtctacaaagaataaacagctttattgcattttaataactcaattttaagaattcaattaaattctaaatattgattgacagtgcagcttattctgagaattaagggcagcacagaatagtcagaacaacatttcattaaatgcattagtgtctgcattagataggactagttgtgaattatagctcaactgtggccttgggcaagttgctgaacctctctaagtctcactttcctatgtgtaaaataggataataactctatcattgacttctgtgaagattaaaaatagcacttaaaaggtaccaggaactgctctatgttttatatttattaactcattttatctattccacaagcctctgagatactgttactacaggttgagcatctaatccaaaaatccaaaatccaaaatgatccaaaatctaaaactttttgagcactgacatgacattcgaaggaaatattcattggagcattttggattttttttttttttttttttagacagaatcttactatattgcccagactggagtgcagtggtgcaacctgggctcactgcaacctccacctcccaggttcaagcaattctcctgcctcagcctcctgagtagctgcgattacaggtgtgtgcctccatgcccagctaagttttgtatttttagtagagatggggtttcaccatgttggccaggctggtctcaaactcctgacttcaagtgatctgtccacctaggcttcccaaagtgctgggattacaggcatgagccaccgtgcccagccacatcggagcattttggatttcaggttttccattagggatgctcaacccttaagtatataatgcaaatattctaaaatctgaaatttgaaacacttctggtcccaaacatttcagataagggatactcaacctgtatggccattttgcagatgtgaaaagtgaggcacagagatatcaaatagtttgctcaagtttatactgcaaataagtggcagagctgaaacttgaatccaggcagtccaactccagaggccctgttcttgaccagcatattatactgcatctctacaaaagctggtgcatataaagcttttggttcaatctggcaagttgttaacaataaattatggttactagcatgattgcaagattaacagtgatcatactggaagcagcattttcacccttgttaatactgttcataatgcacaaatattaatgcacaaatatacacagagaacacatacaaacggatatatgaatctagaggatattaaagctgaagcaaattatggcctctgatcagagtgattggacccaataaagctaagaattcattatgttacatagcaaggcaattaaaaagtctcaagaacaaagtatatgaatttgggttatatctacgttgttgtaatttatcatgagtagaataagaaataaaagtactactaagttatcttccactatttttattaggaacatgtaatatacttgagaggaggtataatttctggttcatttttgtatctatgatttgaccttagcctaggagaatgaacgcaaggcaaataaatacctgttgaatgagtgaatggaatactaagatgaagagtcggcttggtggtacgctattttttttttttttttctgagatggagtttctctcttgttgcccaggctggagtgcaatggcaccatctcagctcatcacaacctccacctcccaggttcaagcgattctccagcctcagcttcctgagtagctgggattacaggcgcctgccaccacgcccagctaattttgtgtttttagtagagacaggatttctccatattagtcaggctggtctcgaactcccgatctcagttgatccgcccaccttggcctcccaaaatgctgggattacaggtgtgagccaccgtgcccggcccagtggtacactttttagggacccaacaacataagcgcccttttaacctgcccaacaacatatcccttagagagcagtcaccctgtttcatcccaggctccagacccagaaaggctggagaggacatgggaaaatctacagattcagttatggctctggatgtccctgttggttccagttggaaccaggcctcggtctgaatcccatcacttctttctattccaatctgctttccaaaggccttgggatatccagtagtcactctaaaccaccctaaacagaaagcagagaattctcttttaactctccagtgcaatattccttgatatacaccagtacctatccgactgttctattccatgaagaaactgggactcagagggctgtgacttgctgaaggtcacaggggcagagccgggtggactggaccttatttccctggtcccgttaatgcaaatgctgatatcttatctccctccgtctccccaaatctccctctgcacacttctgtcttacactctgggagaccaaggcatctttagtcgccaaaacaatgctcaaagaaagaaaagtatgagtagaaacacctggaagctggtctggttcgaccctctaatggtacagataggggaaaccgaggcccagggaataagagggtcttgcctagagtcacacagggagccagttctaggccaccactctcacggttgcctcaaattttggggacgacttgtgtgcagtttttcctttctgtcgcttcagatggcaaatgctcctctccctgcccattatatgaacaactaaagcttaatttgtttttgtttttgttttcaagagacggagtctcgagtctcgctctgtcacccaggctggagtgcagtggcgcgatctcggctcactgcaacctccgcctcccgggttctagcagttctcctgcttcagcttcccaagtagctacaggcgcacggcaccactcccggctaattttttgtattttagtagagacagggtttcactgtgttgcccaggatggtctcgaactcctgagctcaggcaatccacccgcctcggcctcccacagtgctaggattccaggcgtgagccaccgcgcccggcctaaagcttattttttatgtgtatgtggaaagcggggagaagagtccccgaagatgggaacctagcgccacccagcccaaggttggccctcataaccgctctccgcttcgaccaaagggcgagggttgcccgctcctagtctgccgctatgcccctttctcccacctcaggctcagtacccaccggtgggctgcggggctggagctggggccggcgggaacgcggagcctgggggtgggaacagcctccgagccctcccgcgcctccgcccctagcagcaggcgcacgttgctagggcgggagtgctggagaaaagcctccgggcaccctcgcaggccgccgaaccgcagttccgttcgcctaaagctgggacgggaactgagcgcccggcgctactctcttcgtgatcaggtccagaggagaggacgcttgtgcccaggactccgctgccagaagaatctagacaatccaagcaaaacgggtacctttgtaatagctatggagaaagcacttaataaaggtcatcttttaaattattggtcgctcagacatacgtgttgccgtatttctttggagtttccctgatttcgactagaaattcctcctttggacactcccccagctccccactcctctattcctttcgttttttttttttcattgaaccattacagcctagtaccatagcaagaagagacccctcagtaccttcttgagatccaaatgggaagacagttgtagaaacacagtttttacagctgcggtcgcattgctaccagactagagtctattcatctccgtattcctggtgcacagtatggggcttggtatatagtaggggcttgttgaatgtttgttgaatgaatcaatggcagggatcctagccaacatttatttatttttaagacggagtcttgctctgtcgtccaggctgaagtgcagtcgcgcgatctcggctcactgcaacctctgcctcccaggttcaagcgattctcctgcctcagcctcccaagtagctgggactacaagtgcgcgcctccatgcccggctaattcttgtatttttagtagagatggggtttcatcatgttggccaggctggtctcgaactcctgatctcaggtgatccacctgccacagcctccaaaagtgctgggattacaggcatgagcctccgcgcccggccccaacatttattttgaaccctagtaggtgcctctgcagtgttgatctggcaaaacagccttcaatgaagatttgtggagtttctgaaaattgggtgcctttgagggggtgggaatggtgagagaagtttgcctccacatactggctattgggtctgttttccagtccagggaagggatcccctccatggcatccctgatgaagtatctgtagccctagttgatgctcactctgtaatgatgggctgattactttctaagctagtgacctattgttgggagatttccttctggcaggagaaagtatctacccgtatgccacttgaaactctgatcttcgctcagaaccaatggctctccttacagacttaatccctttcccccacaacagcctggcaagctacaaccaggatagactcactgctttgtcctgggacactgggctaggctcagtgcagctacagaggtgagttactagatctctgcacccaagatgttcctgctctggggatgtttttccctctgagagagaggctttaggcttcaggcacgaaagactcccaaactggtacctgtagccaggcctctccctgagtcggacctgtatatccacctgccacccgcccatctgcaactggcagtttaaaagacacctcattcttgacatgactcatactggaaacatcatcttcccctcaaacctgttccccctcttttccctgtaagtgctgggcactaccattcaccaatcacccaagccaaggatctaggagtcatttgtaactttacccttgcttcctcgttcaagaacaatccccgagacttctcaattctgcctcccaaacattataaaaataaaaaccttctctctacctaccagctggattcaggccaacatcagggtgtgatagattaaaaacgaccacaacttctttgtagctcttcccatcaaggctggctttgtaacttgttttgaccaatagaatgcagcaggagtgacatcgtgggacttctgagtttaagcttcaaaaggccttgcagtttctgctcccatcctcttggcacactgccagcatgggaagaggaccaggctagtctgtttcagagacatggcccatccaatagctagcaccaaatgccagccatgtgagtgactgttgcccatgctggagtgcagtggtgcgatctcggctcactgcaacctccgcctccttggttcaagcgattctcctgcctcagcctcctaagtagctgggattacaggtgcgtgcccccacatcccggctgattctcgtatttttagtagagacggggtttcaccatgttggtcaggctggtctcgaactcctgacctcatgatccgcccgcctcagcctcccaaagtgctgggattacaggtgtgagccactgcgcccgcctcagtgttataatcttatgggaccaccaggtacatgcagtccatcattgatcaaaatgttattatgcagcatacgactttatcctcagcttagaggccatctccctctctgcccccaagtcttccctacccattcctccccttctccagactgggttaactattcttcttctgtgcttccaaagcccccacactttacaccacatagtataacttttcatttacttctctctctcactcaactgcaagcaacagaggcagtgactgagtctcatttacacttgtattgttggtgtctaacccagggtctggcacagcactgcaacagaactttcaacaattatggaaatgttctatacctgcattgtctaatacatcagccactagccctactagctattgagcacttgaaatgtagctagtgcaactgaagaactgaattttacatgttatttattttaattaatttaaatttaaatagccacatgggcctagtggctatggtattgaacagtgtagggctagcacagagtagatggccattgaatatttttgaacaaagattacaagggaaagacagtcatgacagaccgttaggacatgatagaatgctatgggtataagcaacataatttcatatcgacctctcctggctcctcacttcacatcccctcaactttacactaccagtgcctttgtcttagtccattttgtgctgctgtaacagaatactacagactgggtaatttattatgaacagaaatgtatttggctcatggttctggagactgggaagtccaagatcgagaggctgcatctggtgagagccttcttgctgcattatgacatggtggaagacatcacatggtgagaatgcaggagtagtgagggaaggggacaaacctatccttctatcaggaacccactcccacaataacatcattaatccatgcacgagatcagagccctcatgatctaatcacctcttaaaggtcccatctctcaacactgttacaaggggaattcagtttccagcacatgaactttgggggacatgttcaaaccacggcagcctgtggctctgccttatttaaatataatcctagtttttggctctttatggcctgagttggttgttctctcctggacttgcccagattgataacaccccttctgtgacatgggctggtctgaagagccctctggagaagagagctgttctcatctagtttagtctggcctgagcagagagcactctgtcattgggaggcttggacttcatcatagaggacccatgtgatctgaatttgtctgcatggcaggctgccaaatccctcttaaaagtgacagttaaagctggctgtactgtgaaaacaccccaggaggaaaagaagccacagtattggtagtcttattgctgttcctggaaaccatgcaaaccccagtcagatgacttccagccctggcaccagagatattggatcagtgtctgagaaggaaggaggaatggacacaggcccaggcagaagggggctgggctgggccaggccagggccccaccaggcaggcagaaaaggctgggcctgacaccgaggagcaggcctgagggaaagtaaaggctagggaagaatagtcctttccaaaagactttccaaaatgttcattaaaataaaaagtttaggccaggcctggtggctcacacctgtaatctcaacaatttgggaggttaaggtgggaggatcacttgaggccaggaatttgagaccggtctgggcaacataaaaagactcaggtctctacagaagttttttttgttttatttttatttttatttttttttgagacggagtctcgctctatcgcccaggctggagtgcagtggtgcaatctcgtctcactgcaagctctgcctcccggattgatgccattctcctgcctcagactcccgagtagctgggactacaggcatctgccaccacacccagctaatttctttcttttttttgtatttttagtagagacagagtttcactgtgttagccagggtggtctcgatctcctgaccttgcgatccacccacctcgacctcccaaagtgctgggattacaggtgtgagccaccacacctggcccagaagttattttttttttaaagttttttaaaaaagatccaagccaaatgttataaatgagcaagtgaaagggcaggttagagagcaggttgtacacataatcccaattttgtaaaataaatatgttccagcttgtatcatatagtgggagctaatgaatgctttaacctatgtgtgaggacctgtaagtatatttgtagcagtttttcacacattgtaaatcgtgtgaggttctttgaagattggggagcagagttcatggtacagaaagacatcttgcacttgctagtcctctgtctggaaatctcctccccagatgttttcatgccttgcttcttccagtgccacttacctgagaggacttctacaccatcctttctacaccagcacctccatcatgctctttttcttgtaatacttgaatctttttcatagcccttatcattactgacattatattacatatccatttgttgcattttatttgtgcatgaaagtagactttgttcttcttgactgttgtatccccagtgtctaaggcctggcacattggcaggggctcaataaatctgttgaatgactaaaatgtaacaatggtgtccattcttctctccctagctcagagtgcctgaagttcaagtacagccctgcctatgcccatgaagcctccagaggtcccctaagagctctaagcagctttcaaatttttttgacctcataaagaagtacattcattctccacggtgcatatgtacgtatatataggccaaagacaaaattacaacaaatgtagttgagtgatcttattggcttttattagcacttctagaatcaggcaacacctaattctataaaacagaatgttccaatgagctgaacagaggacatgggctttataggtagaaaagagctggaaaaaaaaagaggattactcatttcaaagttactttccttttagggttaaaacagagaggacttccttatcatgccagctaattctgtactgtttggggattttaatatgctctctctttctctttttctctcccaatttcttggaagttcagataaactacttagttttggtttggtgaagtggcagtttagcatgagtaactccattttgttttggtttggtatggtggggcctagtgtggaagcccagtccaaaacaacgaccttccatccattttgtttacctatatatatgtaattgaaacaacaaaaaccttactaagagcatgttttctgttctttattcttttctttttttctcttttggagacagagcctcactctgtcacccaccacccaggctggagtgcagtggtatagtctctgctcactgcaacttctgcctcccgggttcaagtgattcttctgcctcagcctcccaagtagctgggactacaggcatgtgccatcacgcctggttagtttttgtatctttagtagagacggagtttcaccatgttggccaagctggtctcgaactcctgacctcaggtgatccaccttcctcagcctcccaaaatgctgagattacaggcgtgagccattgtgcccagccttttctttctttttataaaagatgctgatctccaccccttgaatttcttgatatgccacctaataaagggttgccactgccttagggcagtgtttctagaaacagtcaaggggctcctttgcatcctagtcaaggagtgactgccacagatgcagcttcttggcttcatcccagacttaatggatgaaaatcttaccggaaagtctgcgtgttttacaactcctcctctttcccctcctgaccatcccctgtcctccaacgattccgaagcctgataaagcttaagagctataaccggggagtttatgagtatcccagatgtgtcctgcagggcttgatgaacagatagggaaagggcgattctccagttccagtccaacttggctcataagtggtgaaacagaggaacccgacttgataaaagtaaatctactcctaccttagccctttgcatttgctgatgccactacctgaaagtaattctggtgatttaggggctgttttccagatcctggacctggtagggccaatgactgctctagggccacacccagtgaaggcccccctcccccccccccacctttccctaaggattttaacccttgttcctccccctgccctccacaacctcttttctttcttttcttttcttttctttctttctttctttttttttttttttgaaacagagtgttgctctgttgtccaggctggagtgcagtggcgcgatctcagctcactgcaacctccacctcctgggttcaagcgattctcatgcctcagcctccccagcagctaggattacaggtgtgcaccaccatgcccggctaatttttgtgcttttagtagagacggggtttcaccatgatggccagactggtctcgaactcctcaagtgatccgcctgcctcagccttccaaagtgctgggattacaggcatgagccactgctcctggccacacaacctcttttctttttagccttcacacaaaaagcacctcctattttctttgttttcaccatagggtttaataattccccatccccagtccttagaaggaaaaaattctaaccacaatctctaattaccatggcctatttccctccccacccccagaggagtgtagatgctgttatgaggccatcaccctcccactgggatgcactggaaacttctttagatgccaggaaagcagcacccctgtcgccaaagaacctcacacaatttacattctgaaacctgctacaactgtatttacagatcctcacacatataataaaaccttttattatcccctactgtatatcagacacccaaagtaaatactttgtagacaagatctcatttcattcttgaagtagccctctaaggtagatgatagtattattatcacctctgttgtagagataagaaaacagacacagaagctgtgagtaacctgaccaagatcccatagctgtaagctgcatagctgggatgaaaccaatgactatatttcactcagtgttctctctaatcatatggtgtaatattgtctatctggggtgacaatgtgtccccattggatgatgacaccactgtgtaccgctctgggtagctctggggctgttagctgcccttacccctcaggtgctaaagcagtagtggctgagaaggaaagggttctatctcctttgtgtggccattgcttagagaagcttcagagtagaggtgctagagcccctgtgagctatgggatgtaatgtttctctttcggtttagctcccgcctgtgttcagttctgatgcactcagagtactctctgacacctgaaggcctgggcccttccccttttgagagagtgcccagctttctgccaagactcctaagaaagaatttggggttggtggccgggcgcggtggctcacacctgtaatcccagcactttgggaggctgaaggggggagatggcttgagcccaggagtttgagatcagcctgggcaacatggcaaaaccctgtctctacgaaaaatacaaaacttagctgggcacggtggcatgtgcctgtagtcccagctactcaggaggctgaggtgggaggatcacttgagctggggaggtcgaggctgcagtgagctatgattacaccactgcactccagccagggtgacacagtgagaccctatctcaaaaaaataaaaaaaaataaaaaaaaaaaagaagaagaagaatttagagctggagagcagcgttctccttgtatgcccagacagactagactggatccccagcagagggctcaatctgggctcagactaatatataagatcctgagggtgggaaaagccctaaacagctcaggaacatgttagcagtttttctttctggggtgggagtgggtggatttttcttccacatgcttatttgcatattttgttttcttcgaaataaaaaggcattactttttttcaatgctagtttaaaaagaaaactcaaatattcaaattcaaaaagtttggatgtaaatactttgggaaaatcagcctaatacagatatttctcactgggcctcaatgttcaatttaaaaaattattaattatagtaaccttaagtcacactgcctaggttccaatctcatagctaccaattagtaactgtgacccttggcaagccacttaacttccataaaaatgggatcctaatagtactttcctcgcactgttagtagacacttagcgattgcagctgctatgttccagatattgttttacgtatttagcgtatttactcctcagacgtctgggaggcaggtactctcaccccattttacagctggagttcccacccagtgagcagccaaacgggatttgaaccaggcagtttctcagcagagccttgcttgaagctaggcatctaaagctgcctctcaaaaagggcagtggtcgggattacataacagaacgcttgcaaagctctcagcgaaagcctggcacttaataagtgctcaataaagtttcctacggtcacagtaatatttggagttttatgtttgttgtagaacaaatacgcatacaatcgcgatttcattcaacaaggaatttaaagagacctgctgccccgggcgggatgggagcgcgggttgggtgggaggaggcgcagctgcggggcgcgctggcgcaccgggagggccgggggcggggtcagccaggccccgcccgccgccacctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcgggtgagcgggtgtgggcgccggaaggcgagggctccggagaccccgggcgcgcctggcgggacccggcagggactggggagcctggggctgggcggactcgacacccggccccggagcctaggctcctcggtggctttggctgtaggactaggcggttaagggtgtggcctctgaagtcaggctggcctgagttcgaatctactccctgtgagtcacgtaactctgagcctcagtgtcttcatctgtagtttggggacaacaacaataataatagcgcgtatttattagagttgtgagaaataaataagatagtgggtaaaatgcttagcgataaggggatccaggctccccaggccccttccattgctctgttgaggaagctggggctggcatgaaaggctcagctgctccagttctcagcgcagggtgtgccccagctcccgcccctgtggaaactgacactgataaaatccagcgcgaccgtatcccttaacccctggactcaaa

SEQ ID NO: 210 - DNA, 53108 bp, Homo sapiens
cgggttggagtgcagtggcacaatctcggctcactacaacctctgcctcccaggttcaagcgattcttctgcctcagcctcccaagtagctgggattacaggcacacgccaccatgcccagctaatttttgtatttttagtagaaacagggtttcactatgttggccaggctggtctcaaactcttgacctcatgtggcccacccaccctggcctcccagagtgctaggattacagacgtgagccactgctcccggcctgaaaaagtattttctaattttattagtattttaaaacttggtactgtgaaacatagcacctattttgttcctcatttcactttggaaaacccccaggttgagttagtgggagttgagcccagtcactgttgaccggctgcatgggcctgggcagtgctgagacttggcaagagagcccagggccccctgaggaccagtggggcacagagagtggctacgggtgtagcatgggatggaggagagggagaagctgctgcccggtccatctctgattcgtggagctgattttccaaacactctaaggcctcggttcacattctgtttcccacagaggaggctctgcgtctctgaactgttgtcaggccccaccaggctcttcactgtttggagccagatctacggagccaaactgccttgacctgctttctgaggaggggacaggcagcaagtgccggacctagccagattcagcccgcagaaggtgttccagactccaagcagcctgctggcctagctccaggcccaggtggctgcagactccacaatgggtgactcaggtaagctgtgctggacaaacaagccagtgttctcagcccagcagggtgatgcctgtcataagctttcctgtcgtcattgtaccgccatttcctgagggtggccttgccaggcccggagccagggtccatggagactggtaggaatgtggttatcttggtttatgtcttgttgccaaggtgcttcccaatgcttctaaagctgggcttggcgctgatccaccagcacctgtgctgtctgatggtggcatggaggccgctgggctgaaagaggcctactgagaccacagacagtctggtgaggagatactggtatgtgtctttctcatgatcctaacacctatagttttggtgctcccttccttcaggagtcccaaaagaccaggcaagctggagacacttggccagagaggcaactgggcttaaacagccagcttaaacaaacagctactatttcctgagcacttctcatgtgccaggcactgctctaagcacttcacatatgccaatgaattctcaaaacattcctgtgacacagctactagtattatccctaatttacagatgaggaagctgaggctgagtcataggttcagaaacacacagctggtgaccagtgaatccaggatctgtacccaggctatggaacctagagcctgctagatccacctgccaagctacctgacctagagctggtgtttttttttttgtccccctttatttttcttttttataaacaaggtgtcttgctctgccacccagactggagttcagtggtgcaattatagctcactgcagtctcgaactcctgggctcaagcgatcctcccacttcagcctccctagtataatgggactataggcacgtgccaccacttctggctagtgagctggtgctcctaactctcacagggtactgcctctcttctgctctgtcatgatgactgtagtgcaagaaggggactcagcaagaagcctcaggattctaggcgtggctcagccacaacctgctgtgtgatcttggccttcactccccactctggccttcagactcctcagggattagaccaagtagtctacaactctgcttccagttctgtggctctgactcacgtggaaacagcagtggggaaaggccctatcccttagccccaccggaagtgtctactgctgattaccaagaacagcctcacgggcttttgagaagggcagggaggatcaactcctgacctggtgacactgatggagcaaagctgcttccccactccacacctcagtttccccactccttccagtggagataatgacctctgtgtgctcagtgctactgtgagtcagggttaattagcattagtcatagacttgggaatcctcacaagaaaagggtcatctggtgggtctgggctgtgccctggctgtgatgagacaccactcatgcccctgtgagtgtgtcatcatgcttcattagtggcttgcctaactttgcaggtcggccctggggtggcccagccctgagtgcgggtgctgagatcagccaaaggatgacacctggggagggctgcatgtgtcccagggtggctgccaatggctcacagtcccctggatttccctttcggttgacttcccattcaatcgggttcttatcattgctactcgagccactattcctggatgcaaggccccaactctgaccttaaatttagaggtttttttttccttctctgtctcctcaataaatacccattctcatttctgtctctctgctgactgtttcaatgctttcagtttctttctgtttccatcaccgcacttggtagagcttaagtggggttaggggaaagaccctgtaacaaaataaggacaaagtaagaatgatgatgtcttgtgttggcaagtccagctaggtaagccagaagtggaacatgggggacatctagtggccgtagtgggtactgctagcattcttgcctggcaccgaggtcacattcttgaactttttttttttttttttttttttttttttctgagacagggtcttgcgctatctcccaggctggagggcagtggtgtgatcacagctcacggcagccttgacttcccaggcttaagggatcctcgcacctcagcctcctgaggagctgggactacaggtgcacgccaccacacctggcttttttttttttttttttttttggtagagacggggtttccctatgttgtctactctggtcttgaactcctgggctcaaacaatctgcctgccttggcctcccaaagtgctgggattacaggcataagccatcacgcctggcctcatacctgaacttgattctcaagttggctacagtgacttgccccagctcttggagacttgggagatggcacgatccttaggaggggagattttcttatcacttaatagctgataaattgcatttcccttgacatctggtttctctggatctacagaagaaaggtctcaggctgggcacggtggctcacgcctgtaatcccagcactttgggaggctgaggcgggtggatccttgaagtcaggagttcaagaccagcctggccaacatggtgaaaccccatctctactaaaaacacaaaaattagctgggcggtagtggcatatgcctgtaatcccagctactcaggaggctgagggaggagaattgcttgagcctgggaggtggaggttgcagtgagccgagatcccaccactgcactccagcctgggcgacagagaccctccctgtctcaaaaataaaaaaaggaaaaaaaatcagtccagcatggtggtgggcacctgtagttccagctactacggaggctgaggcagaatcacttgaacccaggaggcagaggttgcagtgagctgagattgcagtattgcactccagcctgggcaacagagcaagattgtctcaaaacaaaaacaaaaacaaacaacccaagtaacaatggaattaaacatcgtcatgcatgtataactatgtccttggttaaaggcaggcagtggggtctgccttggaggctgatgggctgagtttgaatcccggccctcacttactgggctgtgtgaccctgaacaaagtaattaacttatgcttttgtttcctcatttgtaaaaatggaacagtaattataccttcctcataggactgctatgaggcttaaataagataaaatgcttagaccagtgcttggcaaacaatctgtacttacaagtgatagctatttgcagcagtagtaaaatcaagtttcagaggttctcctgctcaagactgattccccacatttcagtaggaggtagactccagctgcagtcttggtttcgctatcactttttttttgagatgcagtctccctctgtcacccaggctggagtgcagtggcgcgatctcagctcactggaacctccgcctcccgggttcaagtgattctcctgcctcagcttcccaaatagctgggactccaggcacccatcaccacgctcggctaatttttgtatttttagtagagatgaggtttcaccacgttggccaggctggtcttgaactcctgacctcaagtgatccgcacacctcagcctcccaaagtgctgggactataggtgtgaggcactgcacctggccttggtatcacttctgattggctcaaaacccgttgtgccgtcaagttattcttgtgtgcctttccttctgctccattggttctagttaggttggacaagactggctaagaaatggacacagaggctaaaaaggattttcttgtctctgtgatcctggcttccccgtgagaactatgaaggccttggaggtgaatcttgagtcccttctaggcttcacattttctgttcctactaccatccctttgagggctgttactgacacactataggaaacaattttcctccatatctgcttactgggatatcaataggtggctaatagaaagaagtgagtacagaaagctgaagagtatgttattataatgatctgacttgttggataatctctggataagtgaccaaatctccatgacctacctgtcctacacagaggcctttgtatgttcctgtttccctctcttcctaattggcttcagctatacaacagtcagttcaactagagaggcactgtggcaagaaaaacaataaccaccacagctgtagccaaggagcaatgagataaaagagagtatgggatatagatggaatgaatggtctctaattaaagggtttaaatgcagcattcacttctgagggcatgggccaactgaccaggatggcagctgtataaagccaaagaaaacctagaatagaaataaaactaaacatagaaaggaaaactgaggagaaggaagtgtttgtacttttgtcgatggtcaagctgtgcgtgcagctgtttttattgctaagatggaataggatggaagggattcagaagtggctctcaggcacccacaaccagaagaagagtataagtgaggaaagccccaaagagaatgctccacctgttaagtctattaaagttggctgaaatcaaaaaggagccaggagaaagactctcttctgggcactagtatcccgtgagtggctgcaagatactcctttctactgtgagagggagatctcaactttgagcttgggaaagaaaaccatagactcacagtgcttggaagatattcccagctgtatcgtaatggaaagaacagaagctgggaaagatggatttcagtgtggctctgcctcattctagctatatgacagctagttattagatgtctttgagcttcagtcttctcggtaaaaacaaaatctacttggatggggaatgcaacctttgttaaaacacagaatcctagaggatttagtggagaaaattagtaaaaggagaatctgaagtttggggggactataataatggggtatgaataatctggaatggcaagggctcttcaaaatgccaccacctgtcctgatcactgagaccaagtactgcaaaagaaggtgctggcctgggaggtcaggaggaaggcgctgaagttctatttaccagcaggagacaacacaaatcacataggatcctcataagctacctaatgtggctaacacaggtggaaaaattccttagaatgacgacttttaatgctacctttgtggatagtcaagtagcaaaaatgaaatttcaggcaattatcttctttaaagggatctaacaaaaggaaaaaaaaaattcaggctgggcgcagtgactcatgcctgtaatcccagcactttgggaggctgagacaggcagatcacttgaggtcgggagtttgagaccaccctggccaacatggcgaaaccctgtctctactaaaaatacaacaattagccaggcatggtggtgcatgcctgtaatccctgctactcaggaggctgaggcaggagaatcacttgaacccgggaggcagaggttgtagtgagccgtgttcacaccactgcactccagcctgggcaacagaacaacactctgtctcaaaaaaaaaaaaaaaaaaaaaaaaaaattcaaataaagaatcaaattaggaagagtgggttcctagaaaggccaaactaaaaatgtttacatgagcaaaccacaagacgaatgaataaaggcctggggttaaaaggatgtcccagggtgtggaagagaacagatgctttgggaaaggaagctcatgtgctcagtcccatctgagaacaccccattatgctactaagctggaatgagtatatttgaaagcatactcacgccagctcagtagcgtattctccagaaacggtgacatgtagacttgaactcatgctgttaaagaggatggcattaagatctcttgtgagaagacaacaaggttgagagctttactctacatggctctatagatcctaagctttttttttttttaaagacagggtcctttgtgtcacctaggctagtcttggactcctgggctcaagcaatcctcccaaatagctggaactacaggtgtgtgccaccactcctagctgattttaagcatttgaaacaatgatctttgatttcttcaacacattgaatcctcctctcctgaactccatttctagacagatattttcatatgtaactgaactcaataaaaagtgagtaaaagtaaaaaactattatcatccattaacacctgaggggttctctgtcttggttaggcctcaacctcaaggtcatctttaattcttcccctcttcctcatgcccaaaaccaatcatgaagtcattgctgagatttctatcaaattatgccccattgcaactgccatggccactgccctcacacttcccttaaatccttcttgtcttccctaagccaggctattcagagacactggaattatcttcctaagcacaaatgtcttttttttttttttttttttttttctgagacagagtcttgctctgtcacccaagctagagtgcagtggcgtgatctcagctcactacaaccttcatctcccaggttcaagtgattctcctgcctcagcctcccgagtagctgggattatagtcatgtgccaccacacccagctaacttttgtatttttagtagagacgggctttcaccatgttggccagactggtctcaaactcctgacctcaactgatctgcccgcctcggcctcccaaagtgctgggattacaggcatgagccaccatgcccagcccaaaatattctttaagagtttctctttccctagagaatcaagtccaaactccttagtataacatacaagactctaatctggcccaacttccattttcttttcctttcttttctactcaacacagagttctagccacagcagaatacctgctcttcctggaacatatcctacatgctgctcatttgcttacaatgctccctcagtctcggatgtgcatatttttaaccgagggtctatcacgtgtcaggcactgttttgaatgttgagattaaaaccaggacaaagtccctgttctcatggagcctgcatctcccactcatctccaaggaccagctcaaatctacaccttcctcaaagttcttcccaacgacacatgaccattcacttcttccttttttatacctctcctagactagagcatttagcagtttgtcccgcaacatttatataccagtgtgtcttctggcctggcctatatacttcttagaggtagaaagtaggtagtcattcatctacaggggctagcacagtgcctcacacatgaaagagaatgtttcttgaattacacaaagtctatctcaatctgcttcaatttatatttttatttacatatttatttttgagacagggtctcactctgttgcccaggctggagtgagtgcaacggtgatcttagctcactgcagtctgcctttctgggctcaagagatcctcccagctcagcctcctgagtagctgagactacaggcaaaagccaccatacctcactaatttttttctatttttcgtttaagacaggatttctccttgttgcccaggctggtcttgaactcctagacttgagtgatcctcctgcctcagcctcccaaagtgttgggattgtaggcatgaggcatcatgcctggcctctgcttccatttatgattttattttattttttaatttattattattattatttttgagatggagtctcgctctgttgcccaggctggagtgcagtggtcgatctcggctcactgtaagctccgcctcccgggttcgcgccattctcctgcgctcagtagctggaactacaggcgcccgccaccacgcccagctagttttttatatttttaatagagatggtgtttcaccgtgttagccaggatggtctcgatctcctcacctcgtgatccgccagcctcggcctcccaaagtgctgggattacaggcgtgagccactgtgcctggccattttatttttattttttgacctggactcttgctctgacgccaaggctggagtgtaatggcggcaatctcactgtagcctcctcccccggggttccagctattctcctgcctctgcctccagagcagctgggattacaggtgcacgccgccacacacggctgatttttgtatttttaatagagacagggtttcaccatgttggccaggctgatcttgaactcctgacctcaggtgatccgcccaccttggcctcccaaagtgctgggattacaggcgtgagccaccacgcccggtcagattattaatttttgttgggtgtaatatgttggagaaaagttatatatatataaaaatatacataaatatatatatatatatataatgagacggagtcttgctctgtcacccaggctggagtgcagcagacgatctcggctcgctgtagcttccacctcctgggttcaaacgattctcctgtctcagcctctccagtagctgggacaccaggcacccgtcaccacgcctggctaatttttgtatttttagtagagatagggtttcaccatgttggccaggttggtcttgaactcttgacctcaagtgatctgcccaccttggcctcccaaagtgctgggattacaggtgtgagctaccgcacctggcctaggttctattttttagagattaaactatgagtaaaatattatgtgttattttctttaaaatacttcagtacaaaagtataaaacaaaacaatctcagtgacgaaaaacatggcatatcagagaataatcactttctagcctttgctaggtcatggttactttatcagtgggcagttcagggtccaccttctctaccacaaaaactgatgatcccccaaaagcaacgagtcttggggaagcccaactgggggactcatgcattcaatggcacatggagaggggtctcttctgaagtgccttcctccccattacattgttttattctgttattatcaaagcaaggagaaaattatcagttgaccattcactataacacaccaggaaatttcctggtggcataatgaaaatcatcttgcttttggtttaggaaagattatacctccttgactggaatcacaaattttaggctttgcagccaatctgaaaatcaaaagttgaatgttccactgaagtttctccggcccacagggcaagggggaaaacagttctccaacaatgagaatcttagcaaatattttattaatacacactgtcatagtcctaggatagaagagtcctcagaacactgctccacattgaagatgctgaaatgggtggtcaggtccttagtcttccttctagtctgttaatcccacactcctttaacagaaccatgcttgctgcccttaccctgtccacatccctgaaaggaaacgggtctctctcagccagatgcagatagttgacactcactgcctttgctatggcagggggctccttatgattaacccagaacaggaaaaacttagtgtcagctgaccgaaaggaactcagccttaatttttcaaaaagtcactctcattccagctatctccaggaaggcgctggagtatcttcagcatgagcacagagattcccactgccgaaatattcggaatactttccttgatttctcagagagactctgtaggtagaaaagcttattattagtgattacgttcttttatagagacaaaggatagatcatttgtcccacaatgatctggatatgtctaggactaagtaaaaattcattttgtagtatgctatacataatgtatacctaaagtcagactaaagatcgaggggccaacgttctactgtcagactcctgttaacacactctgagcctctaagacacggctcatatcctcccttcaggcatctgtatctgtcctcatctttgtacttgaggatgacacttctgacttgccgttagtacagcacatgttttgcactggtttttctttttttttttttttttgagacggagtctcactctgtcacccaggctggagtgcagtggcgcaatctcggctcactgcaagctctgcctcccgggttcacgccattctcctgcctcacccagtagctgggactacaggcacccgccaccactcctggctaattttttgtatttttagtagagatgggggtctcaccgtgttagccaggatggtcttgatctcctgacctcgtgatccgcctgcctcggcctcccaaagtgctgggattacaggcgtgagccaccacgcccggcctgcactggtttttcattcatgatgctgaattggccctagttcattatttattgtgaataagtacttatacttaatgtgatgcctagctgaggttaacagtataaaccaaggacaactaataaaaacagagttgaatgacccctatgagtttaagctctggccttggtcttcaccgcttttatgttttagccagcagtgctaataataggaagaatcgcagtgccatctgatcatgccaatgaagtactctgagattctgagaaatggtggtaaagggagacaaagtaattcattaggagacaaaagctcttggtgaatcagaacacttggttctgtctgcctttgagagtcacaatgaagagcaagtattccacgcagaaagggtctcagtgagagtacaaagaatgtctagcaagatgatccacagttacctccagtttctcatatgacgctttcacaggttttttttttttttttttttttttttgagacaggtctcgctctgtcgccaggctggagtgctgtggtgccatttcagctcactgcaacctcttgactccctggttcaagcgattctcctgcctcagcctcctgagtagctgggattacaggcatatgccaccacgcccagctaatttttgtatttttagtagagatggagtttcaccatgttggccaggatggtcttgatctcctgacctcatgatctgcctgcctcggcctcccaaagtgctgggattacaggcgtgagccactgcgcccggcccactttcacagttttttaaaaatctatcctctttgaggatgtttcaataagttccaggaggaaaaagtttgaactcttactaatgactgagggaaatttagttaatagagtgacaaagttgaaagaaacctgagttgaaaaaatagtatacacttttttcttttttttttttttttgaaagggagtctcactctgttgcccacgctggagtgtagtagtgcgatctcggctcactgcaacctccacctcccaattctcctgcctcagcctctggagtactgggattacaggtgcacaccaacagtcctggctaatttttgtattttcagtagagatggggttttgccatgttggccacgctggtctcgaactcctgacctcaggtgattcccctgcgtcagcgtcccaaagtgctgggatcacaggcatgagccactgtgcctggcctcggtatatacttttttttttcgaacatcaggatcctttaccacacagtctcattaagctttctagcttcgtcacagcagctgtcagaaggttaagacacactaccgaaaaaaaaagtcctggaatccagggccaattatgaggccaacttttcccactacaaaacaaaaacaaaacccataggctttctttttcgtatggcagtgacagagaggagtcttactgaaaactgccaatgtactagttcctgaagatctaggcagagaaatgcggatttttttttctgtgaaaacttggaaaaccttcacctgcatatttactaagggtactaatatacatttatttttattttatttttttttgagacagcgtctctctctgaagcccaggctggagcgcaacctcggctcactgcaacctccgcctcctgggttcaagtgattctccagcctcagcctccccaatagctgggattacaggcgcctgccaccacacatggcaaattttttttttttttgtattttgagtagagacgaggtttcaccatgttggctaggttgtctcaaactcttgacctcaggtgatccattcgccttggcctcccaaagtgctaggattacaggcgtgagccaccacacccagccatgcaattttggacttttagcattactatagttccctccagtggaatcctgtaaccctagaaaaccatgaatctaggagtgctgctcataaatatctgctgacaagtattattttactttgtccttgaaagttatagactacgatcagaaattgttaccagctacaaggaaaatttgggagtgagccagcgaaggagagaacccagttttcatggttccatattacccagcctatcacttccaatctttacacagagcaaacacttgacttttcttctcagttgtcacccacatttgtaacccacagcagttatggctgcaatggctagcagagtcacagtctgggctgtggaacagagtaaagtaatgtgcccagcgtgcggaatgaggccatcatcttggtgtcagagcccagtgctccaaacagctaagttaactggccaggctccaagtgcaagtgacagcaaatgaaagaaaaagcagctgtctgcaacatgaggccggagcagctgcctgttcatctatttctgtttccgtactccttttctacttggagtcactttatttaggagaacaaaagaatttatcagaacttgacggaatgccatatgctaaactacagaaagacgaaccggttctatgcctaatccctaggacgaaagcagaatgagtctaacttgacgtataagccgggcacggtggctcacgcctgtaatcccagcactttgggaggccgaggcggggggatcacctgaggtcaggagttcgagaccagcctggccaacatggtgaaaccctgtctattaaaaatacaaaattagccgggtgtggtggtgggcgcctgtaatcctagctacttgggaagctaaggcaggagaatcgcttgacccaggaggcggaggttgcagtgagctgagatcgtgccattggactccagcctaggcaacaagaacgagactccatctcaaaaaacaaacaaacaaacaaaaaaacccaaataacttgacgtatgaaagctgaaggcaggcggggtgctaattataggcccagcctctgctccacctcccataaacagcaagtgctgcccacacacaaggcagtggcgtatctcaccatggagtccgtttcagctggctggctagactgtttgtgcgccaagaggatggtcagcactgctttccagcctggctctgctggggcgctggcatctggttcagttccaccattctccctgctttctttgccaagtgtgatattcacccaagggcaccagtctctatgctgagaggtgggatcaaagaagcttcgggaagatgtgtcctgaggaaggagaaaaagaaatagcattcataggtagatgctatgtaagttcagggaggcactgctgttagttatcaagtccagaatctcacaactacccatacttcgagtgtttatgctctccttcaaactttgcctacacattttcctctcattttctttattttttcactccttttgtgttaaacaaactataccttatcacaagggataagggatacccaacccccaggccatggatgggtaccaggtcgcacagtaggaggtgaacagcaggcgggcaagcaaagcttcatctgaatttacagctgctccccattgtttgcattaccacctgagctctgcctcctgtcagatcagcagtggcattagattcttataggagcaggaaccctactgtgaactgcacatgagagggatctagacttcgggctccttatgagagtctgacacctcatgatctgtcactgtttcccgtcacccccagatgagatcatctagttgcaggaaaacaagctgcaggttcccactgactctatattatggtgagttgtacaattatttcattatatattacaatataataataatagaaataaagtacacaatacatgtaatgtgctcgtatcatcccgaaaccatcctcccaaccgtggtccgtggaaaaatggtcttccatgaaaacggtccctggtgccaaaaaggttggggaccgctgccagatcaggtttgtccctgtatcacaccgttgttccatttgcctgaaatatctattatttctccagaatccactccaaaggaacaaaaaggagcaaaaaacatgactgacattttttccctttggtcatccaactttaaatttattcacatggtctactttttgcattggaccacggaagggctcctgcctgcttctccatgctgcctagggagggcccaatatgctgtttatgctcagccactgctacatgcgaggtggactcaccgaactgctggaggagcagaggcgagctcgcttggctttccgcagagggctagatggtacctccaggccaggggtgtctcctgttcccatgcttcgggtcactgggcgagttctggtggtggggctagcagcctctggctcaggacggtcaacaggactggaagagtcccagctccgagttcgagagacaatgggaccagggctcttttcagcctgaaggaaaggggagataatggaagtacacgaatgatattaatgattatggtcagaaatacttctttctttaatcttttttctttttttttttgagacagagtctcgctttgttgccaaggctggagagcagtgaggcgatcttggctcatggcaacctctgcctcccgagttcaagtgattctcctgcttcagcctcccaagtagctgggattacaggtgcctgccaccacacctggctaatttttgcatttttggtagagacggggtttcaccatgttggccaggctggtctcaaactcctaacctcaagtgatctgcctgcctcagtctcccaaagtgctgggatcataggcgtgagccaccgggtctggctgaatttagcttccccattagtgaacagaaacactatgtggtatcgtaaccaatgtagtgggaagagaagcctatccacctaaattaatttccaactttctaccaacaacacttttgccaagaatgttgtttaaaattccaccccaaataagctaagtgaatacctgctctgagcctggggagaaagtggcatcctggctccgggtcatcatcctccgaggagattcaggcaccagaggtaagcgctctggtcgcccctcaaggcctgggattggggagctggtcaggccaaaggatgcatccaggtcagtcatggacgattcaatctgctggaagccccagagccccaccttcctcatacattgcgaacatgttatcagggagagctgcatggattccaaagaggaactagataggaatgaaaaagagagttttctcaaagtgtaacatttccaaatgactaagtgcaatgtcttgtgagtatgccttatctcatccaatttctggaacagtcaccatgtcctatcagagcctctgtgctccagtctcaggacccagcttcatacttcatcatctctcacatatttcccatagaaagacctcgggttcttagtgtgctctctatggtaagactgttttgcaggcatgttttaaaagtttctcggccgggtgcagtggctcatgcctgtaatcccagcactttgggaggccaaggtgggtggatcacctgaggtcaggagttcgagaccagcctgaccaacaacaacaacaacacaaaaagtttctcctgtccctcttttttttttttttttttttttttttttgagtcagagttttgctcttgttgcccgggctggagtgcaatggtgcgatctcagctcactgcaacctccgcctcccaggttcaagtgattcccctgcctcagcctcctgagtagctgggattacaggcacccgccaccatgcccggctaatttttgtacttttggtagagatggggtttcaccatgttggccaggctggtctcgaattcctgacctcaggtgatccacccgccttggcctcccaaagtgctgggattaaataagtgtgagccaccgtacccaccctctcttgtccctcttaaagtcttttccctttaaacaaaaaacattccttaatctaccaaagagagcatatttaaaatacatcaagatttatttactgtcagaaccaatcttgatgtattttaaatatgctctctttggtagattaaggatagtgggagtctatgccaaattgagcagctggaatggaaatagcaacatgggggcctagaagactccagctggtgtttcctatggtagtttttatcaattaagcggatttttcttcctttctaaaaatagaaaagaacttcctttctatttttccttcttaaaaatagaaaagagcttattttctttccatttttagaaaggaggttcactgtttatagaacacaaattcagcctggtgtggtggctcacgcctgtaatcccagcactttgggaggccgaggcaggcagaacacgaggtcaggagatcaagaccatcctgactaacacggtgaaaccccgtctctaccaaaaatacaaaaaattagctgggcgtgtggcaggcacctatagtcccagctactcgggaggctgagacaggagaatggcgtgaacccgggaggcggagcttgcagtgagctgagatcgcgcacgccactaccctccagcctgggcaacagaatgagactccgtctcaaaaaaaaaaaaaaaaaaaaaaaagagaacacaaattcccagttaagaagcaacagtacaagaaacaaagttcagttgtgaacaccaagaattcctgaattccaattctggttttgttactaattcttattatccattctcctcgcaccatcccccacccagtttttctttgtctctttttctcacgggaaacaccatgtgatttctaaatacgattagtgactgatatatatgggtgtaatgctgttgtcatggttcatgtctccaggcaaaatctgctgactcacctacacgcccagccacacacagagagaatacaggcagtgacgtggacttggatgtctgagcctaatttgattgtagtttttctctcatcagttcggtgatcaagttcatcttcaagcaagtgtaggagaagactgatcttgtcttctgtcaagcactacaagggagccaagtaaaaaacttcgtttcaaccaccataaaaagaaaaattacacattataacatacctagatggtacaagccgaaaatcaggaaggaaattacaaacatgaagatacttctcttcacagagaacaaaatacttccagggacagggctatagtatcacacagaagctttctgaattgccctgaatctgctgactgagaaagatggagtctccctggaactgccaaaactcttgttagtactaaattgttcaatttaccagctgcagattttccctgaaacctgcaaacttcaaacccaaatagtgaagacaaattactgcttatgtcttagcctgacactaaatttacttaaacattaaagaggccaggcgtggtggctcacgcctgtaatcccagcactttgggaggccgaggcaggtggatcacaaggtcaggagatcgagaccatcctggctaacatggtgaaaccccgtctctactaaaaatacaaaaaaattggccgggcgtggtggcgggcacctgtagtcccagctaccctggaggctgaggcaggagaatagcgtgaacctgggaggcggagcttgcagtgagctgagattgcaccactgcactccagcctgggcgaatgagcaagactccgtatcaaaaaaaaaaaaaaaaaaaaattaaagaaaaaaaaattttagagatggggtctcactatgttggccatgctggtcttgaactcctgagctcaagcaatcctcccacctcagcctcctgagtagctgggactacaggcatacatcactgtgccccaggctctaaatttactttttgacagaacaacaaagctcgttagactttatttttgttctaagaaaaataaggaactatgaccaggtggaaaaaaaaaattgccttggctagggacagggttatattcataagcatcagaggttaatagtttcagtctatggccataccaccctgaacgcgtccagtctcatctcatctcggaagctaagcagggtcaggcctggttagtacttggaggggactttgggaggttaacagtttgatgctaaaacccataccactctcttaatttgaagaggctactatttcctacagtaaagcttgtcttcatggagtacccatagggtgattaaatggaacagtaaatattcagtttcaaagtacagattgactagagcatttattttatttttgagatggagtttcgctcttgttgcccaggctggagtgcaatggtgcgatctcggctcactgcaacctgtctcccaggttcaagcaattctcctgcctcagcctcccaggtagctgggactacaggcataaactaccatgtccggctaattttttgtatttttaatagagacggggtttcaccatgttggccaggctggtctcgaactcctgacctcaggtgatctacccacctcagcctcccaaagtgccgggattacaggcatgagccactgtgcccgggctgactacagcatttaaacatttctactcacaaggagaaaggagtttgttactttctttgaaaaatgatggccgggtgtggtggctcacatctgtaatcccagcactttgggaggccgaggtgggcggatcacgaggtcaggagatctagaacatcctgcccaacacagtgaaaccctgtctctactaaaattacaaaaattagctaggcgtggtcgcacgtgcctgtaatcccagctacttgggaggctgagacagaagaatcgcttgaacccaggaggcggaggttgcagtgagccaagatcaccactgtactacagcctggcgacagaacaagactctgtctcaaaaaaaaaaaaaaaaaaaaaaaaaaaaaaaaaaaaagatatgcaataaaccatatgcagtcacatttcagtattttctgttaaatagtttaagtaggctgggtgtgccggctcatgcctgtaatcccagcactttgggaggccgaggcaggtggatcacctgaggtcaggagtttgagaacggcctgaccaatatggtgaaaccccgtctctactaaaaatacaaaaattagccaggtgtggtggcagacgcctgtaatcctagctactcaggaggctgaggcaggagaattgcgtggacctgggaggtggaggttgcagtgagccgagattacactattgcactccagcctgggtgacagaaagagactcggtctcaaaataataataataataatttaagtaataaatcaagataaaactgaatttatgggaagcatatattcagggcaaacttgaatctatgcttccaggttacagccctaaaacttggcccaaataaactgcttatatacatatatgttaaattgaatctatgccatttaaaaaaacatacctaaacattcaaatggaactctcaactgtcaccttcctggtggagactgaaaaggtcagatgagagacagacaagcagttctcttcacagcaattgcatcttcttgtcattaaaagaaatgcttcaggtataaatgctggcaacaactggaggccattgcagcctagtcaggaaaaactcaccatagttttcaagtcctccggccttagggaaggaagctggaggtccaagtgacaaaggctttgaaaacgatctaggaattcactaacaagaatagcaggctcatccaggggcaacatcccaaatcggtctgtggaaaaagtaaattggaagattatattggtgtaaactgtaaaaaataaaaaacacggctgggcatggtggctcatacctgtaatcccagcactttggaaggccgaggcgggcggatcacctgaggtcaggagttcaagaccaacctagccaacctagaaacccctgtctcagcctcctttaatacaaaaaattagccaggcatggtggcgcgtgcctgtaatcccagctactcgggaggctaagacaggagaatcacttgaacccaggaggcagaggttgcaatgaggctgagatcgtgccactgtgctccagcctgggcaacagagagagactctgtctcaaaaaataataataaaataaaataaataaaaaacacatattgaatgattgaggaaatatagtaaaattgatgagctatttgatggtgtcaggaaattattgtttttcattttgatggggctgtaatgatactactgagaccatgtttaaaaagtagaatccatattttttatattttgaaatatttagataaaatggcatatgtgggactgaacttcaaaacaatgcagaggggcagggtgttaggtgttaggaatatagaagaaacaagatcggccatgagttgatcattgttgaagttgagtgatggggtttcattatttatactattccgtgtacttctatatatgtgtgaaattgttaccttaagaaagagaaaacagaacagagttagtggagatggatgcttaaataggtgaaaagtcttaaagaaccatcattttataactaccaagttataacttactgtgagctaagaatgaaaaaaatggcatgttcctaaagtctacacaagagatacaaaaaggcttgcattgtaaggtgaagcttaactgggtaccagagtaaataaagtatacaattaggaattctactggtaatacctaagttggaaaagaaggaatctgcctgaaatctaagcagtgtggaaactgattatatactatagtataattatctctggcattacccaattcatctactgcatacttggtacactggtacaaaggcaaatgatgagtgcagaaaggccttgctaagctacttcctaaagaggtcagtctagtaggcctagaatgaagtagaagctacactgaatcagcctttttttttttttttttttccgagacagagtttttgctctgtcgcccaggctgcagtgcaatggtgcgatcacggctcactgcaacctctgcctcccaggttcaagcaattctcctgcctcagcctcctgagtagccgggattacaggtgcctgacaccacacctggttaatttttctatttttaataaagacagggtttcatcatgttggccaggctgatctttaactcttggcctcaggtgatccacccaccttggcctcccaaagtgctgagattacaggcgtaagtcaccacgcccagccctgaatcagctttaataaagaatgaaaacacgttttggaagggattcataggaaaagtgaagagagaacatgtcatcctagcctgatcgtctaaaaagtaggaagccactcgagtcactggtcttctctcagcctcaaattgacatttagttgctcaacaaagtcactcataatctttttttttttttttgagacaatctcgctgttgcccaggctggagtgcagtggcgtgatctcggctcactgcaggatccgcctcctggggttcacaccattctcctgcctcagcctcccgagtagctgggactacaggcgcccgccactgcgcctggctaattttttatatttttagtagagacggggtttcaccgtgttagccaggatggtctcgatctcctgacctcatgatccgcctgcctcggcctcccaaagtgctgggattacaggcgtgagccactgcgcccagcccattttgtgatgttttaactcttgtttccatcttcccttccccagctcagctctgtggtagccttgaaaaccgacatcccagcggggcgtggtggctcacacctgtaatcctagcactttgggaggccaaggtgggtggatcacctgaggtcgggagtttgagaccagcctgaccagcatggagaaaccccgtctctactaaaaatacaaaattagccaggcatggtggcgcatgcctgtaatcccagctactcgggaggctgaggcagaatcgcttgaacccgggaggcggaggtttggtgagctgagattgcgccattgcactccagcctgggcaacagagcaaaactccatctcaaaaaaaaaaaaaaaaaacagaaaaccaacatccccacaatcatggtgaaaaccagtagcttagcagtcaccggagagcacagaaaagaggtggagctcctccaaagccccattccagagaaccaccattatttgatctgtgtggcagttgcctagaacattatactgtcgcagtgagaacacccttttccccagacaggttttcaaaaatgatcattggcaactgtttaacatcacagttgctttgaggcagcagtatgagttggagcaagtaacaagctgaccaaaaaccttaaaagctgggaaatgaaatgtccataggcaggcttgaaaggctctgacatattccctggaatctagaaggacatgtgcaggtatagagctatacacatgcccagcaaagacctgaaaaggccctaagctctctcatctctggctgatgctgaggttctgcacaagcaggaagtgaaggctaacacagaactgcaaactgcctgcttgactactgaaggtgtgctccccccaccacacacagagctccttggcaagactgggggacttatttgttcaggcatttaaagaaatctctgtccaatcgtcctgtgaaagttgattttgaggccgggcacagtggctcacgcctgtaatcccaacactttgggaggccgaggtgggcggatcacgaggtcagcagttcaagaccagcctggccaacatggtgaaacactgtctctactaaaaatacaaaaattagccaggcatggtggtgggtgcctgtaatcctagctactcgggaggctgaggcaggagaattgcttgaacctgggaggtggaggttgcagtgagccgagaccacgccattgcactccagcctgggcaacagaacaagattccctctaaaaaaaaaaaaaaagtaagttgattttgataatttttgtaagtgttctttttgctctcatagaagattttcagatgcccttcctccaccatccccactgaagacatcctacacagattgagacaagaaacatgaatttgaggccaggtacagttgctcatgactgtaatcctaacattttgggaggctgaggtaggaggatcacttgaagccaggagtttgagatcagcctgggcaatatagtgagaccccatctctaccaaaaaaaaaaaaattagctggatgtggtggcatacgcctgtagtcatagttactcaggaggctgaggcaggaggattgcttaagcccaggaattcaaagctgcagtgagctatgattgtgccactgcactgtagcctgggagagagagagagaggagagagaaacgtgtacttgatagaagaaatggaaggaaggaaggaaggaaggaaggaaggaaggaaggaaggaaggaagggaaggagggagggagggagggacagtaagaggggaaggggggaagggaaggagggaagggagggaggggagggaaggaaaggaagggaaggaaaagaaagaagggaaggaagggaaagatgggaaggaggggaaggagggagggaggaagggagggatggactacctgatagaagaaataatacttacaaatatatcagtgctctcctgcttactaaaattaatttttaaaattaattattattagccaggtggcacttgtaaacccagctactctggatactgaggcagaagtatcacttgagcccaagagttcaaggtcagtccgggcaatagagagagacaccatctttttcctttgctgcagtgcagtggtgcaatcatggctcgccacagccttaacctcccaagcttacgcgatcttgccacctcagcttcccgagtagctgggaacacaggtatgcgtaaccatgcccagctaattttttgtattttttgtagagatggggttttactatattgtccaggctggtcttgaattcctggactcaagcaatctgcccacttcagcctccgaaagtgctgggactaccctggctgcattttagtttaattgtaatgattattctcttatttgagtttcagatattcacaagtggggtaatggatctcctttaagctggctattctattcttttagcattgtctgtagcatttctatagcattctttttttttttttttttttttttttgagacggagtcttgctctgtcgcccaggctggagtgcagtgacacgatcccggctcactgcaacctctgcctcccaggttcaagcaattctcctgccttagcctccccagtagctgggactacaggcacgtgccaccatgcctggcttgttttttgtatttgcaatagagatggggtttcactgtgttagccaggatggtctcaaactcctgacctcgtgatctgcctgcctcggtcacccaaagtgttgggattacaggcgtgagccaccacgcctggcctgtctgtagcattcttgaaagcattcttgctttctagcaacaacaggatattctggatccaagttgatttattgtccttgccccaagacatggaatcagcaactctccaaagagcctgatccttttaatcacagtagactaaaatgagggaccaaaatctggttgctaacaatgcaaagaattgtgggcagaagtgctgctgttactacatttgggccccttctaatagcaaaactggaaaagatatttttttaaacagccttactgaggtctaattgacataaactgcacatgtttgataagttttaacgtgcacatccatgtagccatcactgctaggtttctattttaacaccttgagtttataatttattttcccaatttaatgccgcatattattctatcctgtttttctttcatttcctttttttttttttttaagagacagggtcggcagggcattttggctcaagcctgtaatcccagcactttgggaggccgaggcgggcgtatcacgaggtcaggagattgagactatcctggctaacacggtgaaaccccgtctctactaaaaatacaaaaaattagccgggtgtggtggcgggcgcctgtagtcccagctactgggttggctgaggcagaagaatggcgtgaacccgggaggcagagcttgcagtgagccgagaccctgccactgcactctagcctgggcgacagagcgagactccgtctcaaaaaaaaaaaaaaaaaaaaaaaaaaaagagacagggtcttgctctgtcatgcaggctggaaggcagtgacatgattatagctcactataacttggaattcctgggttaaagggatcctcctgcttcaacctcacgagtagcttaggatgacaggggtatgccaccacatctggctaattttaaaaaattttttctttgtagagacagggtgcccagcctggtcccaaactcctggccgcaagtgatcctcccaccttggccctgcaaaacactgggattacaggcatgagactccatgcctggctggggttattactttaagtccttttatgtcttctaagtttagttctttgcctcaagacttaccccttgcagtttgtactctaccctagttcatgttatctataacatctcttccttcaaaaaatctcgtagcttctcatcacatacatttaataaaatcatggtttggccactgtctacactttagtcttctcttctattctccccacagggacactgtgagccagccctgtgaaactattacagcattccccaaatgtaccatcctttggccttttgcttttacccactgttgctggtctttcaaattcagcctagaggccaggcacagtggttcacgcttgtaatcatagcactttgggaggccgaggagagtggatcatttgaggtcagcagttcaagaccagcctggctaatatggtgaaaccccgtctctactaaaaatacaaaacttagccaggtggtagcggcatgcacctgtaatcccaggtactcgggggtgctgaggcagaagaatcgcttgagcctgggaagcagagtttgtggtgagctgagatcaagccactgcactcaagtctgggcaacagagtgagactgtctcaaaaaaaaaaaaaaaaaaacagccgagtgaagtggcttccttcttcaaaaaatctcgtagtttcgcacctgaacctgggaggcggaggttgcagtgagccctgtgaaactattcagcattccccaaatatatcagcacttttttttttaatggagtctcactgtgtcgcccaggctggggtgcagtgttcaagcgattctcctgcctcaacatcccctagtagctgggattacaggcatgtgccaccacgcccggctaatttttttgtatttttagtagagatggggtttcaccacattggctaggctggtctcgaactcctgaccttgtggtcctcccgccttggccttccagactgctggaatcacaggtgtgagccatcacgcctcgccactttgccttttttcttggactgtattgcagaatgtggatttggagcaagtggtcctgaagcacttattttgtcacccacagattaagattttcctccacaggctacacttgaaggtctcaacactttgaagtctcctcttatggggcatccagtctaaccctctggcttgctacttagcaatgggtgttctgtgatggggtgatttggaaggaaggagtctgcccctttctgagccacaacagtgaagccatttgatctgagcctaggtgggagagatattttaatagataaacattctagctttgatttttctgaagagtaatatgcctgtttttttttttttttccgcaattcaggggattttctttggtgcacttgttgactctgcatgaatttgcaatccaagggaaaagttggagaaagaacaaagttggctttaaaagtcaaggtaaggctgggagtggtggctcacgcctgtaatcccagcactttgggaggcagaggcaggtggatcacctgaggacagaagttcaagacagcctggccaaaatggtgaaacctcgtcactactaaaaataacactttgggaggctgaggcaggagaatcgcttgaactcaggagggaaaaattagccaggcatggtggcgggcacctgtaattccagctactcggaaggctgaggcaggagaattgcctgaacccaagaagcggaggttgcagtgagccaagatcgcgccactgcactctagcctgggtgacagagtgagactccatctcaaaataaaaaataaaataaaataaaataaaatgtttaaagaaatttaatttagcttataattattggcaaatgttagaaaaaaattaccttcaaaattattagttttgcttaataaatttaagcataaagtgaaataactgagtgttcttttatccacacaaatgtcctttgaatgttaaagaaccaaaccaagggatcatataattgaaaggttatatctaagatccatgtaggaggtagaatggataggtcaaagtgggtgaccatagagaagagcatctaaagtgactttcaggtttctggctaggacaactggatgggacgtcagtgccatttgccaagatggagaaagttttaggtataagatgaagagttcagttttatacacattgagttccaggtacctataatattaagtggaaatgtttagaaggtagatgaaaatatgagtcaagctcaaaagagaggtctggataggaattagaggtctccgaggtggtagctgaagttatgaatgagatcaggaaagcaaaatgtacggtgacaagagttgggaaccaccaatagagccctgggcagaccttaaaaacttggacggccaggcgcgggggctcacgcctacaggcctcccagcaattctggaggccaaggcaggcggatcacttgacgtcaggagttcaagaccagcctggccaacatggtgaaaccctgtctctactaaaaatacaaaaattagctgggtgtggtggcacgcgcctgtagtcccagctactcgggaggctgaggcaggagaattgcttgaacccaggaagcagaggttgcagtgagcctagactgagccattgcagcactccagcctgggcgacagagcaagactccgtctcaaggaaaacaaacaaacaaacaaacaaacaaacttggactgagtgcactagacaaggatggaatcaaatcctcataggaccaagttttgttatacaatacaggtaaataactagtaaatcctagctatttcaacagcaggaaatccttattatacaatcatcttcacttaaacaattttatttaataatcccttttctaccaccctttcattgatcaaaggtagaggggaatctctggttattttcaatctattttctccttttagtggtaaatcatggaatattcttagccatcagtgaccctggaattagcctgccatcctactgaaataaaaaatatacctacatggcactgattcctggtcaaggcatgaaatatacagatgaatagtgttgctttttaactatgggtctaaagaatttttttatacttgctcttagattccccaccagagggctctgctgttgaagctgtttactcagcaggaatatgcctatgtgatcaacaaaatattttttatttttcatagagatgaggtcttactatatttattgctcaggctggtctcaaactcctaaactcaagcaatcctcctgtcttggcctcccagtgttaggattatggttgggagcaactgtgcctggccaaagaacaaaatatttttaaaaacccagttgagattacactttgggctctcttattccaaagtgttctgtgcacacatcagtagttcctgattcaagggagagtatgtcctctcatggcccttatatagacaggaaataggaggttggacctggccttcccagacaggcagcctgtggctgtaatgacacccttacttcagtgctgctgtgatagtgtactgttttactgcaataaactgcagatttgtgatcactctcacttggggtcctgtgagtcttcttcagcaaatgaaccctgtttaacttccaccattattgctgttagtactccctctacaggaaacctaggtagaacatggcattgcttggtgtggtgggaaaagcggagggtttgaaatcagattaaacttagttatagcttctctctagttggttttaagacctctgattcttagtttcctcacctaaatgaactgggttatggccgggcacagtggctgatgcctgtaatcccagcagtttgggaggccaaggcaggcagatcacttgaggtcaggagtttgagaccagcctagccaacatggtgaaaccccatctctacaaaaaattttaaaaattagcagggtgtggcagcgtgtacctgtaatcccagctactcgggaggctgaggcaggagaatcgcttgaacctcggaggtggaggctgcagtgagttgagatcgtgccacctcactgcagcctgggtgaaagagcgaggctctgtctcaaaaaaaaaaaaaaaaaaaaccaaaagaactgggttggtagtatctacctcccagggcccctgtaaggattaaatgggataatgcatatatatgtctaaagccttaagcatgtcaaatgcacttcatgaaggtaagtaataacacaagtgaatataagtttttctggaaataatgcaaatagaaaaggagaaaaagaggccgggcacagtggatcacccctgtaatcccaatcccagcactttgggaggccgagacgggcggatcatctgaggtcaagagttcgagaccagattgaccaacatggtgaaaccccatctctactaaaaatacaaaattagctgggcgtggtggcgcacgcctgtaatcctagcaactctggaggctgaggcaggagaattgcttgaacgcgggaggcgaaggttgcagtgagccaagatcgcgccactgtactccagcctgggcaacaagagtgaaactccatctcaaaaaaaaaaaagaaaaggagaaaaagaaagttcaaagactaggttttcacaaacagacaatattagaaatgcaatgatgaaggaaaaatggtgaacaggaattctcaaaaataagtacctggggatgggctgtctggccagaaacagaacttctcatgggcagtacacaaggctttcttcagctcagcacatcgttgcttatctgaaatccacataaacagcaacaccttaaaaaacactatatagattcaaaatccaatgaatggcctctaagagcagagatttaactaaaaataagagaattttaaaatgtgaaaatattatcaagtacataatcttaatatttttcacaaaacaggttttaaattgagatcctaagatcaacaaaggagataccatgtatcttatttttattttttatttttttgagacagagtcttgctctgtcgcccaggcttgagtgtagtggtgcaatctcggctcattgcaacctccatctcccaggcccaagcgatgctcctgcctcagccacctgagtagtgttttgtatttttagtagaaatggggtttcaccatgttagtcaggctggtctcaaactcccaacctcatgtgatccacccacttcagcctcccaaaatgctgggattacacacgtgagccactgcgcccggcccccatgtatcttataaagcagagcattccaaagtgtgagacttcataaaagtcctttgtcactcttcgtctagaagtatacattttggaataataaagtaaacatgctgctgttacctagattacattaagtcaagtccatgctgcagtagctagcttagtttaaaaaaaaaaaaaaaaaaaaaaaaaaaaaaggccgggcacggtggctcacgcctgtaatcccagcactttgggaggctgaggcgggtggatcacaaggtcaggagatcaagaccatcctggctaacacggtgaaaccccgtctctactaaaaatacaaaaaattagccaggcgtggtagcaggcacctgtagtcccagctacttgggaggctgaggcaggagaatggtgtgaacccaggaggcggagcttacagtgagccaagatcgcaccactgcactccatccagcctgggggacagagcgagactccgtctcaaaaaaaaaaaaaaaaaaaaaagactggccaggcactatggcttacccctgtaatctctgcactttaggaggccaaggtgggcggatcacttgagctcaggagttcaagactagcctgagcaacctggtaaaaccccacctctacaaaaaaaaaacaaaaattagccaggtgtagtggcactgcgcctgtagtcccagctacttgggaggctgaggaaggatcgcttgagcccaggaggttgaggctgtggtgagttgtaattgcactattacatcttgctcagcctgggcaacaagcaagaccccatctcaaaaaaaaaaaaaaagattaaaaaaaaagattgaagtacgcattttttgatcaaactaaaatgaccttttttccccccccagaaaaccaggatagtatatatttgagtgtggagaaaaatgtaatttgtaccttatacttacatctgtcaaagtcaaaagctggttgtaaactggcacagagaaaagcttgacagctagagcacttgagcatatcacattccactgtgacccagccatattttgcacagacgagtggagacagctcaaagggcttacctgcccatttcaaagagtatccatgttaagaaaaacaacacagcaaatatatatatatatgtgtgtgtatgtgtgtgtgtgtgtgtgtgtgtatacacatactgttttttttttgtttttgagaaaagttctcactctgtctcccaggctggagtgcagtggcacgatctaagctcactacaacctcaccctctcaggttcaagcaattctcccacctcagcctcccaagttgctgggaccacaggtgcacgccaccacacccagctaatttttgtattttttggtagagatggggtttcaccatgttgctcaggctggtcttgaactcctgaactcagatgatctgcccaccttggcctcccaaagtgctggaatcacaggtgaacactgcaagtatattaaaatgaataagtcataaattacaatcttaactcattctttttttttttttttttcaagacagagtcttgctctgtcaccctggctggagtacaatggcacagtctcggctcggtttctgcaacctccacttcccgggttcaagtgattctcctgcctcagcctcccgagtagctgggattacaggcatctgccactgcacccagctaatttttgtatttttaatagagatagggtttcatcatcttggccaggttggtcctgaacttgtgacctcgtgatccacccacctcggcctcccaaagtgctgcaattacaggcgtgagccactgtgcccggcccaactcattcttaatgtatataggaataaacattaaggagaaaggcaatgagaaaagtggtaaaaactatttttaatgcacaggcccatacttcacagaatgatgaaggtcatttaagtaataagtggaggggaaaagttattaacttattcttgaagaagcactatgtattttatgtgtttaaaatgtttattggccaagcacagtggcacatgcttgtaatctcagcacattgggaggctgaagcgggaggatcacttgagctcaggagttgaagatcagcctgggcaacacggcgacacctcatctctattgaaaatcaaaaaattagcgggatgtggtggtgcatgcctgtagtctcagctaattgagaggctgagggaggaggatggcttgagcccaggagatcaaggccacagtaagatacgatcacaccactgccctctagcctgggcaacagaatgagaccctgtctcaaaaaaaaaaaaaaaaaaagtttattattggttgtctggtagaatatagcatccattaattttcactgaatctgaaatactaggaacttaaaggcaccagtgaaagtactgggatatgcctaaacaataagagatagtcaaagttaaacacacagaaatattttctgccattcacctatgctctcctactgtaccccatccatttttactttccaaagaataaaggcaataaaattatccctccaaaatttgattgctagtatcaatggggatgtgtgagaatgtgttttacacagctaaaagcatctgtaagtatgtatttggaaaggtatcctaaaacatttattactccttaatattaaatgctcagtttttttgtttgttttgttttgttttttgagatggagtcttgctctgttgcccaggctggaatgcaatggcacgagctcagctcactgcaacctctgcctcctgggttcaaccgattctcctgcctcagcctcccgagtagctgggattataggcgtgcgccaccatgccccactaatttttgtaattttaatagagaaggggttttgccatgttggccaggctggtctcgaatgcctgaccttgaacgcctgaggccctcctcggccttccatggtgctgggattacaggtatgagccacctcgcccagcttcagtttttaataatctatgtgggccgggtgcggtggccccagcactttgggaggctgagacgggcggatcacttgaggtcaggagtttgagaccagcctgggccaacatggtgaaaccccatttctactaaaaatacaaaaatcagctgggtgtggtagtatgtacctgtaatcccagctattggggaggctgaggcaggagactcgcttgaacttgggaggcggaggttgcagtgagctgagatggtaccactgcactccagcctgggcaacacagcaagattctgtctcaaaagaaaaattctacctgaagagctcttatttcacaaagcacagtaaaaaaaaaaggataaaatatgaaagaagatgcaggaaagttatacatttttataaagggatataggaatttgaaagacattccaacatcagcaaaggaagaatgaagactggaaaacaaaattcagatacaaatattaaaggagccatgattatctagaataaaagtaatggttaaataaataatcatcatatccaaaatgttgatcaatttatagccaatgaacaaaaaggaaatggatctaaatattttatcaaaatcaagatttaatgcaagaaataatggtagaaggatggttaaaataccttccctttcctgagcaattcagtcttaaagccattaggcggtgaacaaggaagatgtcagagccaggaggctgcgaagaggcagctcagcccagggtgtcagaaccaaagtggtatgtaacaggcattcacttgcgggcagccaagtgtggagtgctaggacctaaatggggtgacgagagattcatgcaagaaaggatggcagcatggcagaaatgggagattaagcacatataggggattgatcaaagtagtaaatatattaaggataacaaattatgtttcacagtgttgaatatgggagggaaaaatagggaaaaggagaaaactagaatgaatcctgtgatgtacaattgcaactggagatgtcagcaggaactcatcgttttttaaaatatagagagaaatggatgtaaatttagatgtgtgtatacatgtgaatgtgtgtgtctgtgtgtgtgtacataaacatatatattttctagctttttcctctgagagggcctgagaacagtggcatcccactagctatgagttctccctgcacccagatcttggcattcattcatgcatttatatagagacaggatcttgctatgttgcccaggctggtctctcctgggctcaggcaattctcccacctgggcctcccaaagtgctgggattacaggtgtgccaccatgcccagttcagatcttagcttttaaataacattctccactgaaaaacagccaaggatccttgtaaaattggctgattccagggatggggcaagaaaaatacaagataagccgagaacaacttgttcctgaaagcaataaagaggtcatgggttatgggacatgtcaaaaggccacagaagccaacctgagggggatgtcactgactaaataaggaacaactggagtatcaaaatatataatgatagtaatgaattataacccattgaataacaaagaaaatattgagtccatgttactacaaataaatcaattacataaagtttgataaggactgggatatttacaaagtttcaaagaacttccccacaaagtactttttatttacaaaggaggaaagagttattttacaatagaaatgccagatactcccttaatcaagtgatcaaagtgatcatcaccataaagggataaatagaaatcacgtgtcacctgacaggatgcaatgagaatgcagcattgcttcacgacactcctgcataacctgaatctaatcacaaagaaacatcaaacaaatgtcattgacatacactctacaacataactgttctgtaatcttcaaaagtatcaagatcatgaaattcaagaaaaaactgaggaaatgttccagattaaaggagaataaagcaacatgacaactaaatgtactgtgtgattctcaactggatacttcaactataaagaatgttattagtataactgatggaaaaactggggtctgaggattggagggtagtaatttatcaatgtcaattttctgattttgatggttgcattctggttatgtaggacaaagtccttgtttgtaggaaatatttgggagtagtaagacatcactttggtggcttactttcaaatagctcagggaaaaaaggttctttgtaatctctgcaacctttctgtaagtctgtaatttaaaaatttttaagaatcactgtaaaaaattaccatgtaagtctttctgtccttgcacacagggaataaagtagtgaaaagcagaagacgtggtgtggtaccacatttcttccgccttcagtctctgctcctttcacagagctacccatcagtaccatgttggccatgttggagtagagtatcctcagcttcacaacctctatggtctataggagacaaaatgacagcccagagaagaatttgccattttcagtggaaaacaagtggcaattactaattatgatgacttgtactttggatctcatttgctgcactttcctttataagacatcaactgggccaggtgcagtggctcacgcctgtaatcccagcactttgggaggctgaggtgggtggatcacctgatttcaggagtttgagaccagcctggccaacatggtgaaactaaaaatacaaaaactagccaggaatggtggtgggagcctgtaatcccaggtacttgggaggctgaggcaggagaatcgcttgaacccgggaggcagaggttgcagtaagccaagatcacaccagtgcactccagcctgggtggcagagtaagactccatctcaaaaaaaaaaaaaaaaaaaaaagacatcaacggcttaagatggatgtttgagctcacaatctctttgatactatgcagccataaaaggaacgagatcatgtcctttgcagggatgtggatgaagctggaagccactatcctcagcaaactaacacaggaacagaaaaccaaacacatgttctcacttataagtgggagctgaatgatgagaacacatggacacatgaggggaacgacatacactggggcctgttggaggtgggagttgggggagggaaagcatcaggaggaatagctaacagatgctgggcttaatacctaggcaatggattgatctgtgcagtaaaccaccatggcacacgtttacctatgtaacaaacccgcacatcctacacatgtaccccggaactgaagataaaagttgaagaaaaaaaggccaggcatggtggctcatgcctgtaatcttggcactttgggaggccaaggcaggaggattgcctgagctcaaaagtttgagaccagcctgggcaacacagtgaaaccccatctctactaaaatacaaaaaattagccaggcatggtggcgggcgcctgtaatctcagctacttgggaggctgaggcaggagaattgcttaaacccaggaggtggaggttacagtgagccaagatggcaccactgtactccagcctagatgacagaatgagactccatctcaaaaaaaaaaaaaagttgaagggaaaaaaggaaacaaaacaatggatcaaattcttgaagtcaggcatatagcacactaggtatgtttctaaataaacttatgacataacgtttaatgtctcttcgtgaaacatgcaatgtgatagctggtatgtgcttactttttcatttgggtaatattccagtataagtttttttttgagacggagtcttctctgccacccaggctgcagtgcagtggcatggtctcggctcactgcaacctctgcctcccaggttcaagcaatttctcctgcctcagcctcctgagtagctgggattacaggcgcatgccaccacacccagctaactgtgcattcttttttttctttttgagatggagtctcattcctgtcgcccaggctggagtgcagtggcatgatctcggctcactgcaacctccgcctcccaggttcaagcaatcctcctgcctcagcctcccgagtcactgggactacaagcatgtgccaccatgcctggttaatttttgtatttttagtagagacagggtttcaccatgttggccaggctggtctcaaactcttgacctcgtaatccacttgcctcagcaaaccaaagtgcttggattacaggtgtaagccaccacgcccggcctaattttgtatttttagtagcgtcagggtttcaccatattggccaggttgctctcaaactcctgacctcaggtgatccgcccaccttggcctcctaaagtgctaggattacaggcgtaagccaccatgcctagccagtattagtttcttgatcaaaaaaaggtgtgtgatttggcttattttatggtcttaaattctgagattttgttaatttttgattcctaggtcaagaccttgttaatagtttataagacagaaattcggggccaggtttggcggctcaggcctgtactcccaaccctctgggaggctgtggcagcataattgcttgaggccaggagttcgagacctgcctgggcaacatagcaagactttgtctacacacacacacacacacacacacacacacacacacacacgggtaggggtgcaaacttggcaggaaaaaaaagcagctggagctactaaagacttctctcaaagcaaggtgatgtgaacagcttttaaggtggctccaatgatccctgccttcttatattcatgcccttgtgttatctgctcctcttgagtatgggctggcctagtgacttgcttctaatgcataaaatatgacaaaaatgatgagatgtcacttttgagattagattacaaaatgaggctggcttgtatcttgttctctcctttgctcactctgatggaagtcagctgccaagttgtgaactttcctttagagaagcccacatagcaaggaaccaagtggggagggacatctctggccaatggccagtatagaactgaagccctctgtccaacagacacaagtaaatgaatcctgccaacagtatgccaatgactgagtttggaagtggaccctttcctagttgttttttttttttttttttttttttgacacggagtcttgctctgctgccaaggctggaatgcagtggcgcgatctcgactcactgcaaactctgcctcctaggttcaagctattctcctgcctcagactcctgagtagctgggattacaagtgagcaccaccacacctggctaattttgttttgttttgttttattttattttatttttcttttgagacaattttcctagttgagccttgaaatgacagtgccctgaccaaccttaattgcagtctgtgagagaccctgagccagaggactcagctaagccatgcctggattcctgatccacagaaattatgaaataaaaactgtttgttgttttaagatcactaagttttggggcaatttgctatgcagcaataggtagctaatacacaaaggaaaatctagaaagagacattatagtagtgtagtctctaataatctaaaaaacattagattataatcctggatctgccatttgctaacaggttcatcttgggcaagtcatataacctgccccaaactgtttcctcttctgtaaaacaagtataataataatgcttattttcataggtttaaggtcaagatcgaatgtgataatatatacaaaaacatactatatacaagtattagttattatttcttcttttctcaggctcttagttttttcttctgtaaaaagaaaaggttagataacctcaactgtccctctgagtgataacatattaggatgctgactttcctatataatttcttaccaaggttttattcttaagtttaaagcatcacagtaagtggtgtaataccttggaggaattctagaagcaggcagaaagtgcaattcacatgaactaaaaaaggatatagaaaatgtttccactctgctaaagaaggcttctttgcttgtagattccaatgaaggttgttccgcttggggtgatccattaactgactgggatgtggcagacgtgtccttcctaatataaagtggcaaaactgttggtaaacctttcacagtaccctctgcttaaatgttatctagcttctctacacatcgtatcataaatcacaccaacgctggattttaagcttcctaaaaatcattttactcatgtcattcctcagcttattattttcaatggttttataatacttactaaataaaatccaaatttttcagtctggcattcaaaactctttacagtttacccatatctaaacttcaatttctacctctacagggctccactaatcctagcaaactattctcctcactcactcactgttctccacaagtatttggcataactttagtagacagaaaataagactcaagacttcaagtatgcattatacaatttgaatctcttcagaaattcgactttttttttttttgagatggagtctcgctctgttgcccaggctggagtgcaacggtgcgatctcggctcactgcaacctccacctcccaggttcaagcaattctcctgcctcggcctccccagtagctgggattacaggcgcgtaccaccaggcgtgggcccggctaattttttgtatctttaggacagacggggtttcaccatgttggtcaggctggtctgtaactcctgactttgtgattggcccacctcagcctcccaaagtgctgggattacaggcgtgagccacagcgcctggcagaaattcgactcttaacagcagaaaaaacaattttgatatttctacctggagggacctttcatacccactccttccaaaaaaaaaagaaccaattagaaaattcgaatcaaagatcttcgggagatttcatgaaaaaaaaatcagggagaaaaaaactcagcaaagcaattctctcattttcagtggaaggcatttcaacagtgcctggggaattgctgaaagacaagcatttatttatttatttagagacggagtctcactctgtcactcaggctggagtgcagtgacgcgatctcggctcactgcaacctccgcctcccaggttcaaccaattctcctgcctcagcctcccgagtagctgggactacaggcgcgggccaccacgcccggctaattttttgtatttttagtagagatggggtttcaccgtgttagccaggatggtcttgatctcctgacctcgtgatctgcccgcttcagcctcctcaaagtgctgggattataggcgtgagccaccgcgcccggcgacaggcattattttaataaaaataggattacatcaacgattatagctcaaaagaaataaacttactctaagactctcagagattcatagagagcctcaagcgggtgtggttctaggccaaaaaaaattcacagcatccataaacttggatgggtaaaaatgacatttatttctctctaaatgacaagatttagcattttcttcaattatgaatgaaggtaaaaacaccatagtagtattagcagtacctgctaatttgtcaccaatggaaataatgttcccacattatggtggttgcatgtcttcaaatacctttgtgctcatcactacttcaaaattatggttgacaacacatactactagatattatggactctttaataaaaagcattgttactgcgtaactttttccttttaccatcttgataactacattccaatctaactggtttcctttataatcctatgtaatttactttaagcatttaaaaatattctgagagttaataagcttctccagagagccaaaggggtccacggcacaaaaaaaggttaagaatccccaattaagagaagtcaagtgaactcattcagttaacggtcctctttacttccaaaaataatgtccgatgacaaaatttcggctgcggttgggaatctggtacaccccgaggggaagatcaaagccgatcaaacatagtaaccagagtttctttcagattctaagaagccatccccactgcccgagtcgccgaccgaggggaacctcccccaacccgccaccccttccccaagccttcttcaatcttccaacgccggacccagggttaactcgtgaactcacgcgtccacgcctccctcttccggggcaatcccctcatctatcagctgccggattttctggggggtcccttctggggagcgaactactgcaccccaattcttttcaacccctacggcaaacgcttgtccctcacagggcgccgccatcttggtccgctgccgagttgcttccccgagagtttgaaggctccggaacttccgtcctgggaggttaatatccgcctcttgaggcagcctggctgggaaagtctaaccgcggggcccacgccttttctcatcattttagaaccttagagcgagcttaaggagggctgtactgtttaggacaatcttgattaatcgtttcctttatcaactagcatatttaggttgataagagatttttagaacgctgtcagtccaaattcagcagggatgaggggctcaacttaattttcaagtaatattaactaatacggccgggcgccgtggctcatgcctgtaatcccagcggtttgggaggccgaggtgggcggatcgcctgaggtcaggagttcgagaccagcctggccaacatggtgaaaccccatctctaccaaaaatacaaaaattagctggacttgctggcgggcgcctgtaatcccagctactagggaggctgaggtaggagaatcgcttgaacccgggaggcggaggttgcagtgagccgagattgcgccactgcactccagcctgggcgacaagagcaaaactccgactcaaaaaaaataaaaataaaaataaattaactcatacgaccctcctaagttgcacctttctacaagcgaggaaatggtgaccctcattggagagcaaataatttagaatccttgttggaaaccgtgttatggatggatttagaagtctgtggcatttgacactattgatactccttccttagtccaacaaatatttattgaaaacgtcctatttattttttttgagatggagtttcgctcttgttgctcaggctgcagtgcaatggcgcgatctcggctcactgcaacctctgcctcccgggttcaagcgattctcctacgtcagccttccgagcagctgggattacaggcattcgccaacacgcccagcaattttttttttttttttttgtatttttagtagggacgggatttcaccatgttggtcaggctagccttgaactcctgacctcaggtgatccgcccgcctcggcctcccaaagtgttgggattacaggcatgagccaccgcgcccggccgaaagcatcctattgatagtctctaggcactagcaatgacagtcgtgagcaaagaagctgtagatcttggtggagttagatgtcaaattttcctatagttttaaaattatgattacaagtgctccaaggatgtaccaaggttataataggagaatctaatttagtttgcacattctcctgagaaaaatcaggtactggagctgagacggatgagattgaagggaagaaatctgtacagaatcttccaacaccccaggttggaagactgatgtgactaaacaatgggcaaagaggaaagtgggatcacctcctacccttccagcaccctacctgtgggctcctaactctatcagtgttcccagcagcaggacctgcaacctattgatccaattacctttctgctcttcctaactccaccaccacccttgtttcttcttttcttagccagcttaaattcattactaattgttatcatcatccctttgcaaaatttgaacatgggttgagacttagttaatatgaaggaaacattgttgatttcactatatgtaataatggcattgtagttatggttcttaaaagcccttctttattagaaatgcatcttgaagtgtttataggtgaattgatatgatgtttggaatttgctttgaagttatccaggaaaacatgtggaggaatagatgaaaaaatattgcaaaattttaaactgtcggacttggatgatagaattgtgggattcattatattattctttctgctattaagtatgtttgacaatatcataataaaaagcaaaataaataagctaaaaaatacatgttcttgaataccctttgaatttccttgaacctctcttgcttaatagtacttacttgacaaaacctcaatcacagttgaagtaagttctctattattgcttctgtacccatacaactaaatatggctaaagagaaatgacaaacttgtctctttatattcttgacttcaagtgggaccttaattctgcccagtaattatactacctttatctagtccacttctcatcccacttttcatagatgacttatttttattttttatttttttaaatttattttttatttttattttgatttttttgcagacggagtctccctctgctgcctgctggagtgcagtggcacaatctcggctcattgcaacctctgcctcctgggttcaagcgattctccttcctcagcctcctgagtagctaggattacaggcacctgccaccatgcttggctaatttgtcatatttttagtagagacggggttttaccatgttggccaggctggtcttgaattcctgacctcaggtgatccgcccaccttggcctcccaaagtgctgggattacaggcgtgagccaccatgcctggccacctggctaatttttatatttttagtagagacagggtttcaccacattcaccaggctggtctcgaactcctgacctcaagtgatctgcccacctcgtcctcccaaagtgttaggattacaggtgtgagccactgcacccaccttcatagatgactattatatacctctctcctcaaacaccttcaatacttccacttatccatcctccctttctgctaatgacacactcctaggaaaatactgactgtacagttagccatggtaacaaccagcaatcagagccagttttaagttcaattgacccatgattactcatcacagtgaatgtgtttttgtaaacccaatgaatgacaacttcttgattcagccaatcacaaagactcacttcaataagcactcctctgagtgccagccactcaacaatagtttcacccaagttatcacttctacaaatgatgctaacacacacctttgaaagtttgccaatctctgaactccccactttctcaaagtctgatagattagtagtctggtctgcttgaagactgtgcctcacctgcatggctcttactgtttatagtaagcaagaaatttggctttgtggtttttttttttttttttttttgagacggagccttcctctgtcgcccaggctggagtgcagtggcgcatctcggctcactgtaagctccgcctcccgggttcaccccattctgtggcctcagcctcctgagtagctgggactacaggcacccgccaccacgcatggctaattttttgtatttttttagtagagacggggtttcactgtgttagccaggatggtctcaatctcctgacctcgtgatttgcctgcctcagcctcccaaagtgttgggattacaggcatgagccactgtgcccggccggctttgtgtttttatttcgcatgatgaatggtgttctcatcatcctctaaccgtactttaccttccctcctgttactattgatcagtggttctcaaatgagtgtgatattgcctgccacaggacacttggcaatgtcaggagacatttttggttggagtggtgatagaggccaggaatgttgctaagcattttacaacatccagaacagcctcgccacaacaaaaaattatctcacccaatatgtgcacaggttgagaagccctgctgtaatctatgtgcctatctaaggccaaacttacacattggatctaattccccttgcctactcaagaacattgtccaccaattctcccctccactgcacatttccattagcagcaagatattacttctcccatcttaaaaacatgcaaaacaggccaggtgcactggcttatgcctgtaattccagcactttgggaggccaaggggggcagatcacctgaggtcaggagttcaagaccagcctggccaaaatggcgaaaccctgtctctactaaaaatataaaaattagctgggcgtggtggcatgcacctgtagtcccacctacttgggaggctgaggcatgagaatcgcttgaatccaggaggtggaggttgcggtgagacgaggtggtgccgctgaactccacactccagcctgggcaacagagcaagactctatttcagaaaacaagaaaacaccttctctgcttttatttacggcaaaggtccttcaaaaattatctatcctagcgctgggtgcagtggctcacctctttaatcccagcactttgggaggctgaggtgggtggatcacttgaggtcagaaattcgagaccagcctggccaacatgatgaaaccctgtctctattaaaaatacaaaaaaaaaaaaaattagctgagtgtggtggcacgcacctgtaatcccagctgctttggaggctgaggcaggtgaatcacttgaacctgggaggtggggttgcagtgagctaagattgtgccactgcactccagcctgggccacagcatgagactccgtctcaaaaaaaaaaaaaaaagaggcctttggccaggcatggtggctcacgcctgtaatcccagcattttgggaggccgagacgggtggatcatttgaggtcaggagttcaagaccagcctggccaacatggtgaaaccctgtctctaccaaaaattacaaaaattagccgggtatggtggcaggcgcctataatcccagctactcgggaggctgaggcaggagaattgcttgaatccaaaaggcggaggttgcagtgggctgagattgcaccattgcactccagactgggcgacaagagtgaagctccatctaaaaatgacagagagaaagagagagagagagagagaagaaggaaggaagaaagaggggcttttatactttttattcattgctgtgtccccagtctttacaatacctcatggacatagtagactctcaataaataattgttcaattaatgtacacaaatttccaaagaatttggactttatcctaaaagccaacggcagccattgaaagactttaagtggcacggtgacatgaacaattgtgcattttgggaaaagtcactataaagactgtgaaaaatggattggagccaaaagaggatatggagtgactgttaggaagttgctgataaagccttggcagaacagaggcaatggtgggtaaggctggggtgaagacagctggaagcgagcagatacaagatgtagtttggaattagaaacaacaggacttggtgatggcttgtacatgacaggtgaggagtagtttttttctgtttgtttgtttttgtttgtttgtttttttgaggcggagtctcgctccgtcacccaggctggaatgcagtggcgcgatctcggctcactgcaagctccgcctcccgggttcacgccattctcctgcctcagcctcccaagtagctgggactacaggtgcccgccaccacgcccggctaatttttttgtgtttttagtagagacggggtttcaccatgttagccaggatggtctcaatctcctgacctcgtgatccgcctgcctcagcctcccaaagtgctgggattacaggcgtgaggcactgcgcctggccaggagtaggttttaaggggaactccaggcctgaacaactgattgatagatatatcagtcagccctccatattcatgggtcctgcatccatggattcaaccaactatggacagatgtttctttttctttttcttttttctttttttttttttttgagacagtgtctcactctgtcccccaggctggagtgcagtggcgtgatcagagctcactgcagcctcatatccctgggctcaagcaatcctcctgcctcagcctcctgagtagctgggaccacaggcttatgccaccactcccaactaatttttaaaaataagttttggtagaaatgttgcccaggctggtctcaaactcgtgggctcaagcaatcctcctgcttcagcctcccaaagttcttggattacgggcatgagccaccttatctggcctagaaaaaaaaaaatatatatatatattttataaatatatatataaatatatataaatataaatatatattataaatatatattataaatatatatatttatatatttataatatatttatatataaatatatataatattatatttatatatatataattatatataatatatatttatatatattatatataatattatataattatatataatattatatattaatatataattatatataatatttattatatataattatatataatatataaatatattaatatataatttataatatataaatatattaatatataatttataatatataaatatattaatatataatttataatatataaatatattaatatataatttataatatataaatatattaatatataatttataatatataaatatattaatatataatttataatatataaacatatataatatataaatatattttatatattatatattataaatatatattatatatttataatatatatatttatatttataaatatatatatttataatatatatatttatattataaatatatatatttataatatataatatatatttatatatttaaatatatatttatatttaaatacatatttatatataaatatattaatatattaaaaatatattaatatatttaaatatatatttatatattataaatatatatatataatttatttatttattttgagacagagtctcgctttgttgccctagctggagtgcaatggggcaatctcagctcactgcaacctccaccttctgggttcaagtgattgtcctgcctcaacctcccaagtagctgggattacaggtgcctgccaccactcccgtttaatttttgtatttttcagtagaggcagggtttcgccatgtttaccagactagtcttgagctcctgacctcagatgatccgcccaccttggcctcccaaagtgctggaattacaggcatgagccaccaagcctagcctagaaaaaatatatatgtatatatatttttgagatgcctgcctcggcctcccaaagtgctggtattacaggcgtgaggcactgcacccagccttgaaaatatttttttaatggatggttacatcagtattgaacatgtaccggcttttttccttgttgttcttttaacaatacagtataacaactatttatatagcatttacattgtatcaggtattataaataatctagagatgacttaactgatacacatatggaagtatgtgtataggttatatgcaaattttatgtaatggacttgagcatctgtagatgttggtattgaagaggagtcctgaactaatcccctgaggatatacagcgacaactatatgtatattgatgtaatagatatttatttatttatatctattatgtataatgtatatatatatatatatatatagtgtgtgtgtgtgtgtgtgtgtgtgtgtgtgtgtgatatttcagtttttttccccttaatactccagcatctggcatatagtagatgttccgaatatgtcaatttttttttttgagagagagtccttgctccgttgccaggccggagtgcagtggtgcgatctcggctcactgcaacctctgcctcccgggttcaagtgattctcctgcctcagcctcccgagtagctgggactacaggtgcatgccaccacgcccagctaatttttgtatttttagtagagacggggtttcaccatgttggccaggatggtctcgatcattagacctcatgatctgcccgccttggcctcccagagtgctgggattacaggtgtcagccaccatgcccagccagaagatgtcaattttaagacaggaatcaataaacacttggaaaatttccaagtttcagatagtcacttgcccagtgtgatgtgaagaaaagagttttggagagagagatggtctcttattctgcttccatcactagccatgtggccttggggtcaaataacttctggatatgagattaaatgaaagaatgtatatgaaaatgtttgatacgtagtaggttcttggtaagtgctagttttcttcctaagcattttagtgaccattacctcaccttctttcaggaaggaagaactaatctccccagccgctgggcataccagcagcaggaagccctactgtccttggctgtcatctcctttgatagctacttcattgaaggaagccctttctcctgaggtcacctccactcccttcctcagggcatccagtaactaatccagacagttataaaaggcccagctccgtgtcccaactcaggacaatgctaaagggccatccagcctcagggtttcctggagggtctcccttgagactgcatcatagcccagctcctccccctgcccagatcagcttccttcccgtccttttgaccccaagaatcctccccaaaaacctcctgcatgctaatctccctctcaggagctgcttatccattttgtttatcctggggaagtagacagttctgccgattgctccagctgtcagactgtctttattgtatgtatggtgttttgttttgttttgttttgttttgaggcggagtctcactctgtctgtcaccaggctagagtgcagtggcgggatctcagctcactgcaacctctgcctcctgggttcaagcaattctcctgcctcagcctcccgagtatctgggaccacaggtacagaccaccatgcccagctaattttgtatttttagtagagatggggtttcaccatgttggccaggatggtatctttcccctgacctcgtgatctgcccgcctcggcctcccaaagtgttgagattacaggtgtgagccactgtgcccagccgtatgtatttttttggtttttatggttttttttgagacggagtctcactctgttgcccaggctggagtgcagtggcactatctcggctcactgcaagctccgcctcccgggttcaccccattttcccacctcagcctccatagtagctgggactacaggcacccgccaccatgtccggctaattttttgtatttttttttttagtagagaaggggtttcaccgtgttagccaggatggtcttgatctcctgaccttgtgatccgcccacctcagccttccaaagtgttgggattacaggcgtgagccaccatgcccggccagctgtatgtatggtttttaatgtgagaacacacaaacattcggccaggtgtggtggcccatgcccgtaatcccagcactttgggaggccgaggcaggcgggtcacttgaggtcaggagtttgagaccagcctggccaacatggtcaaagcctgcctctactaaaaatacaaaaattagctgggcatggtggcacacacctgtaatcccagctccttgggaggctgaggcatgagaattgcttgaaactgagaggcagaggttgcagcgagctgagatcgcacctctacactccagcctgggtgacagagcaagactctgtctaaaaaaaaacacacacacacaaatttaagctgataagcttttactacttcataggacctctcctcttagaaattaatcaaacatattatatttgcgagtataattttttcatgaaatagaaaaatgtgtcaactagcaaaatttagccaggagctgtggctcacatctgtaatcccagcactttgggaatcctaggtgggtggatagcttgaggcctgaagtttgagaccagcctgggcaacatggtgaaaccctgtctctacaaaaaatttaaaaattagccagacttggtggtgtgcacctgtagtcccagctactcaggaggctgacacagaaggatcgcttgagccctggaggtcaagactgcagtgagccacgactgcctcactgatttctagacagtgtcagagtgagaccctgtctcaaaaatagaaaaaaaagcaaaatttttatttttagtgaaaatttaatttatata

SEQ ID NO: 211 - DNA, 35082 bp, Homo sapiens
aggctgaggcaggaaaattgcttgaacctgggaggcagaggttgcggtgagctgagatcgtgccattgcactccagcctgggcaacaagagcgaaactccttctcaaaaaaaaaaaaaaaaaaaatttggatcagttgtaatcacaattctcattctaatgcagcctttttcttgtgatctacaggaaagaaaaaggaaatggaaaactataacgtcactcttattgtggtaatgagtattttgtaagtatttgttgtgaatgcttattttgcttgtttcagcatttatctttaactagtttccaaaagaatttgaatgtatttgtatattattgtgtagaaattgccactatttgactattgccggcctacaaaaatagcaattttataggtttcagatttttagctttatatatgattttcagaagaattgttaaatttgaggaaatacaaagtactcattcaacagatgtttttattttttagctaatctgattaatttctatcatcataggtttttatgggaagttccataaatttaaagggaatatttatatatacatgctggggaagtgccaataatactattttactctatttgattggacaaatggttcttacgtaactctgctgtgcctaagaatcacttggggtgcttgctaaaatgcagatttcttgacccctgtctcagagattgattcagtaattcttgagtaggcatcaggaatcagtatttttaaacatacaccccaggttattctgatgcaagtgatatgagcattacatggtgaaaaatactgggacaatgtctgaatcccagggtattctataggaatccactcagccagtcatatttagaacactaatatctatatgcctctatatgaatcttgaggcactatgttagatttaattgaattggttctgacttagtgatatattgaaggtgataatttttggattggagcttcaatattagcttttttttgtctaattatagatttcagaacatagaagatgtttgttgttcctttgggctttatggaagatttttatgttctgcttaaatcagttttctacgacagttctgaatagcaaatattatcagtgttcttttgcattactttacagaaaatgtttactcaaaagttggaatattaatctgtataccatttcaatgccataataacttcaaagattggattttcttgctactatcttaagtttttaaaaataaatcttcttgatgggtaaaagtgaataagggcaagttaatattttaatagaaaaagtagacagatatgatgccacctgtatatttgcatatatatatatatggtatgtaaccattcacttgaaaggctgctgtgaaaaccaatacattaagttcatttagcatgtaacattttatatatgacaccattaatgtatatttgggacttgatacttcctttgtgcaagatgaactagaataatttttgctgaatggtaatttttttttttttctgacttccactgggagtaagaggtacatcatgctctacctgagatcagctacatattgatcttcatttccttttctgaaaggcagcattatgagcgtataattgcctaagccaaaggcacccaaaaatagatcctaaaagcttatctggtagatttcaaagctggtggtctcacatcaacactgactagtattcctagcagaggggagagatgtcacagataccccaaacctgtgagttcggattattcaaggacttgtattgtcactctaattaccttccatcttttcctcaacctccacttaatacttacaagtaattatttcatataataaaatagggataattgatttaaataataacaacaatgaaaaacagtgtagacaatacacatttttgaagcttttgcatgtatattctgcattagcaatgctttaggtctggaaaagtgtggattaacatataatttgctctgcctagtgtgttgttattagttttgttgaatgtgacactgtttctgaagctgtcaaagatagaacatgctgctcagtccttttaccgtctccgcctccaagaagagaaatctttaaagtaagtctttttccccctgacctgtattcaccatattatttcagtaattcttcagttgcagaaaacttaatttcagtttcagagactgtggtctgctaactatcctgtagccataaacagcctgtttttgtttgtttaattttgtgttttgtttgcaaatttatggggctctgatgatttctggaaatgaaaaaaagatcagaagctattctccagattttgaagatggcatttttctttcagtttagcctctgatatggtgtcaagagcagaaactattcagaagaataaagatcaggcccatcgtttaaagggagtgctccgagactccatagtgatgcttgaacaggtaggcaactcgatacatcacagtacttagtatctttgtcccagtatgaattagttgctcttctgtgtatgagagaatatttaccctactatcgtttgaaaaaatccccctgctagagccaactacccctgccagtctctagtatgcaagggtattacatttattatgtagtcacttttgtttatttatttatttacaaaatgggagtatacaatatacactgttgtatatcttttttcaattagtaatatattctgaagatgtttccatatcagtgtgtatacatctacttcatttttattgatctttctaaataaaattcgatgcataatattaagctctttttacaggaatggtagctattacatacactgtccattattttacttttatctattaaccatatatcttggagatacttccatctcagtatataaagcaaacccccttaacagctgcataagattcaactgtataaatgtaccataattatcttactagtatttttaccactattgccaattatctttacagacatttaatatttgcagacatttaatcccctaattttctgtttataaatctctcagaatctttattcacgtaggtactccattgatgaggtcttctgatggctccagtcaggtccagtggccctctatgccgggtgcacagctatcattctggggttcctattgtctgtgtgtgtcttctgtttcctatatcctgtgttttcctttcttagtttacttcctccttttaatggagcacatccaacagtagcttcctgagaagagaatttggaggtaaatattttaagagttcacctaactgaaaatttttcattctactttttctcttgcttataaatggtttgatgagaactttgaaggcattgctccattatcttttggttccagtattgctattgagaattctgaggctattatcactcttgattctttaatctggaaactcatgcctataattctggaatttttcttgagtcatatagttgattatttccttccctcattttctctctcctgaccttctacaactcctgttattcagatgtcagccttctgttggatgggttatgtaatattcttaccttttctttccatctcttagtctttttggtctgtttctgggatattttatcaattttatcttcaaattcttccattgagtttttcagttttcgctaacaaattttcagtttcaaagagctatcatttttctgaatgatttcttttctttgtggtgttgcaattttttttttttttttgagatggaatctcactctgtcacccagtctggagtgcagtggcacaatctcagctcaccacaacctctgcctcccaggttcaagtgattctcctgcctcagcctcctgagtagctgggattacaggcgcgtgccaccatgcctggttaatttttgtatttttagtagagacagggtttcgccatgttggccaggctggtcttgagctctcgacctcaggtgatcctctcacctcggcctcccaaagtgttgggattaaaggcatgagccaccgtgcccggccatcttttttttttttgagacaagagtcttactctgtcacccaactggagtgcagtggcatgaacacggctcactgcagccttgacctcctgggctcaagcaaacctcccacctcaccctcccgtagctggaacttcaggtgtgagccaccatgcccagctaatttttgcagtttttgtagagacaaggttttgccatgttgcccaggctggtctcaaactcctgggctcagcagatctacctgccttggcctcccaaagtgttgggattgcaggcatgagccactgctcccagctgcaattttttttttttttttaatggctaccatatctttatctctctgaagatattactgatagttaacattttttaaatcttcttctggcatactcattttgcatcaagatcttcaccctcgttttaatttctatctttaaggttagagaatttctttagtgtttggtagcccttgcttatcttcttgtgtggatctgaagctctttacatatggattgggctggtgtaccccaaacttctctgtagatctggctgggctcttggctgagaaatcctggttatcagcacctttgggtcagtgtccacagagaagactcctccagtctccaacctggtggatttagggctggctgcagcgttttaggagctgagcggaagagggataggggaaggaaaggcagaaaggatggtcccaggattcagtacatacattttcctgtattacccttgtttctggtatgtactgctatccttaacaatgccttggtgtccctcaagccaggcagccagagaccctctgttttatcctgcacggaaaataaaattccagacttctgcctaggtagtaggaaaggtcagatgccgaaagtttcatgcaatccttcctttggctcttcctctttattctcacttccagagcttcctggtcattaacacctgagccttttgaggattctttagggttaattttgttggttctcagcattacttttactttagaattcagcttttccaggcctgctgagtcatccatctgctttccagtttccaaagttgcattactgttgtctccttttccattttccttgcccttatagctttatgccttctaaaaaatctctttattagtagagtttgagggagcaaagttggatgtgtgtatttattccactcattcactcttcagctcactcctgcctgatgttcttcccgcatggtttccccaactaatattgcttgagccaaggtccccagtgacatctggcttgtaaaaagaatgtaccttttttcagtcttcatcctacagtgtcagcatttgacagagctaaacacttctttcttgaaatgtatctaatgtatctaatcttgctttctttaaaaccataaaaaaatctttttgtgatgtaatttacatacaataaaagtttttattcacaaggttgtgcaaccatcatcactatctaattccagagcattttcataaccccacaagaaaatctgtacacattagtagttaattcccatccctcactccccctgacccctggcacccactaatctaatttccattactatgggtgtgcctattctggacatgttatatacatggaataatacaatacgtggtcttttgagattggcttctttcacttagaaaaatgtaaaactaatttttgctagttaaaaacatctccttggctgggcacagtggctcacacctgtaatcctagcactttgggaggccaaggcaggcagattgcctgagctcagaagtttgagaccagcctgggcaacttggcgaaaccccgtctctactaaaatacaaaaaattagccaggggtggtagcaggcgcctgtagtcccagctactcgggaggctgaggcaggagaattgtttgaacccaggaggcggaggttgcagtgagctgagatcatgctactgcactccagcctgggtgaaagagcgagactccgtctccaaaaaataaaaataaataaaaaataaaaatatctcctctgcctgacttcctcctggcccaaatgctccagggctctgtgttagattctctttccttctctattactctccctttaggtgatcttattcacacccctaactttaaataaccacacgttccaatgactcctgtcttagtccatttgtgctactataacaaaatcctggagactgggtaatttataaagaacagaaatttattgctcacagttctgaggctgaggagtccaagattaaggttctggcatgtttggtgtccacctggcagaagggactgaaggacaaaaaaggggactatttagttccctgaagctcttttataagagcactaatccattcataggagccgtcatgacctaatcacctcccagaggccacgtctcttcatgctgttgcattggggattcagtttgaacgtgaattttgaaggggacacaaatgttcagatagcagcaactcccaagtccgtatctctcacctcgacctgagctctagactcatacagtcacttgcctacttggcatcttcacctggatgactaacaggattcccaaactgattatgtccaaaacagaagtcaattttcctctaatccaaaacctaattctctagtgggtctcatttcagaaaatgatgctaccatccaccagctgctcaagtcaaaaacttaataaaatatctaagtatatatttatgtatgtgattatttgttttattaatagttctggatccctgactagtctgtaagctccatgaaggacaggacagtgcctatttggttctccattgtatatccagtgcttagaacactgcccaacatgtgataggcaagcaacaaatatttgttgaatgaatacaaaaaaagagtaagacataattcctgctcttgagttgcacacaattttcttagagaaatgagatgtccaggtgtattgttaatgacaaagattacaaaattcagtgtcaaagtgttaagtagtaaggataatgctttgggagtttataggcagaatgactggggaaaactacatgaagagtgtgaatatgagtaagttttaggtgaagaacatgaggatgagagcatgcaaaggcactgaagcaaacttgagttgtttaggggatagtgaggagaccactgcaacttcagaaatcttttaggaaaacgagtctgtcactacgcttaatttgattaatggacctattgggaggtagactatgtagcagtaggaagaagtacaatactccagcaaatgggaagaactctgtagcaatcatactgatagataccccaaagaatcaggtattttgtatttaacgttttatttgggcatcagtataaacaaaactatattaagtgtcactgtaaattttgggcataaaaaacagaaattttcaaatctgattagaaaaattaatctgattttgaaaattaactttgtttacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctgagttgtagtttttcttctttttctacttaaaaacaaaactagaaagcctgcggtagtgaaacgtgtacatgggcccacactctttaaagaaattttgtgcaataataaaacccaaaaaggactctcatctcagggcagtttcatctcaaatacacagacgactggaacaaaagtactagcgaggcctgctggtccaatgtaaaggctgctagccagaaatcatgaaacgaacaggttgctaaatgaacagatccggcagcagtgatgggcctttaagagaaggtcagcgaaactgggggaggtacttggataacattttgcggtggaaagctccctcaccgcctgttgccggagtctgaatgaaggctggcggctccacggtctcacgtagttcggaaatcctccgggttcccgggtttcccgtatttccgtctccgcacctcgtccgcaccccggggctccggaggctgtcccaccggcgcgccgcccgcaggcaccggcggcgcccggctgccgcctctggggcggggcggggcgtggcgtggcggggcaggccggaggtgcgggacccacctcctgcccctgcctcctggacgcgctctcgggagccgattttccccttcccggcgccagggccgcgggccaggaggaggagcctcgcccgcgggcaccgcggggaggcgggcggcgcacgtgcggacaggcggggaaccccggcgccgggggcggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtaacttcccttccaaggtcattctcctggcggggtggtgcgcgaggcccgcccacgtcctccggattggcgggggcgggagaggcgcaccctgcaaggggcccgaccagttgggctggaccgcgacccctgagcactgccagggagcctggtgtgtcagccgctgctagcgggcatatgcttcgcctttccctatagccccgaggctgagttcccaccagcgcccaggcttggagcggagaccgctcggccctcccagcctgcacccgcaggtgagcgcaaccgcccgcgccccggctgtcccggacgcgtggtcggctgtcgccataggaacggctggtgcccagacggcgcctgcccaggctgggaaggggcggtgaaggcagctcagacctccaagaaccctggagccccctgtgtggccaggcggagccacagaagcctgatgaaaacgggaccccctccccctctctcttctcatttttgattgctcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcggtaagaacagagcatttcttgacgctggccccatcacccttctgagaactgccatgtgtactttcaacctagccacccagaatgctagaatttgctcttgattctatttccaagcatctaaaatgagagttggcttctgtgtcaagtgtgaggattttagaaagatggattacgcagtagtgcacagctgtctgtctgctctgttttataggatattatttttcgtttaaagagagatgagggagagaacaggcagtttaaagggatagtaggcaagttagtataaaataaaatgcaagccagcagaatctgtaagtttaaaatgaacacaatagttccagaaagttcctgccttctcagaggtctcagcatttagagactgactacttgggactgggtggcacctgaccacagagggccttgtgggttgaaatttcattttcctgctgttagtactggtcttgccccttgtttctggggaggaactccagccagaaggcatgtatctcccctggattcacagttttcagtgcgaccagcaacactcttgattgatcatactgtatttggcttttattttccaagtgatggaaattactatccaaaaagagaatttttaacatcactgaaaaaatttggtgtcggacagtgaataatctggttttaatccattttctgagtaattatatatttaaaaatcactgtcaatggaagtcataatgtgggaaggatagggatgttggaaacttgcttttcccattaataattatttctggttaaaaaagtcattgcaactgccaatttgttgacttagaacttgatacattaatacagccatgaaaagcattccctggggtctgcagtctagtaccagccttgactattaaaaacccagtgaaccctttgtcgttcttacttgacagtgtactgtgtagtcttttttatggatgtctttgaatataggttctttagatttagtctgaaatctatactgagaaaatagagcactttgcactaatgaatggagaaatgatgctgtttccataaccaccatcactcaagaccgcagctcttccattaaccttgctaactcttcctccctcctagccctggagaccttggctgtcccctgaggcatctcctctgctctctctgtacccctctcctctgtgtttccaccgtgcctgctgctctgtatgattcccaattagttatctctaagttctagtcttacctttaaaaattgtctaaaatcaaagttacctttccttaaactctaccttttcttactagcctgtcttaatttgttcaggctgctatgataaaataaatacctgagactgggtaatttgtaaacaatatacatctattgctcacagttctagaggctcagaaatccaagatcaaggcactggcagattcagtgtctggtgagggcccttttcctcatagatgacaccttcttggtgtgtcatgacatggcagaaggggtgaataagctcatagggctctattataagggcacaagtctcattcatgagggctgtgccttcatgacctaatcacctccttaaggtctcacctctgaatactattgcattgggaatgaggtttcaacataatgaactttggagggacacagatacttcctggctccctaaaatttatgtccttctcacatgcaaaatacactgatttcatcctaatagccccaaaagtcttagctcatcccagtgtcaattcagaagtctaagtccagagtctggtctgaatatcatcatccaaatcagatatggatgagtttcaagatacgattcatcctgagacaagttctcctccacatgtgagcctgtgaaatcaaacaagttaggtgcttccacaatacgatggtaggacatgcatagaatagacattcccattccaaaagggaacaacaggaagaaaggagtgttactgacaggtcctaacccagtggggcaaacaatgttaagccttaataaggcttgagaataatcttggacttgatgtcctgccttctggacacactgggttggcggttgggcccccaaggctctgggtgtccccgccaccacagctttgttgcgcacagcccacactgcagctctcatgggttggagttcctacaggtgcctccagctctcccaggctggagttgtatgcttgtggctctacggggctcttgggggtgaccctgtccccacagctccaagcaggcattgcctcagtggggtctctctgtagtggccccaccacaatgacagctccactgggcagtgccctagtgggggctctctgtggtggccccacccctgtggcagtcctctgcctcggtcccgaggctctccagggcatcctttgaagtctaggtggaggcagccaggcctctacagctcctacactctggatgcctgcagcattggcaccctgtggatgccaccaagatttaccacctatgcccttcagaggggtggcctctatggcatacctaggcccagtggagccacacctggagctgccatggagggtgcaccagaatgtagggagcagagacttcagatggcactcagcagtacaccctgaagccccatgggtgccctgggccctcttatgaaactgtctgccctcaaagccctggcacttcaggtttgtggtgggagcagcagccccaaggatctccgaatgccttcagggtccttccattgtcttgatgactggcacggggctaatccatactgatctcatctacatccttgctgttctctcccaaacatgctttctcatttgttacaatatagacaggctgagaattttccaaatctttgttttactccccttttgattatgagttttgtctttaaattatttctctttggctgggcgcggtgactcacacctgtaatcccagcactttgggaagcccaggtgggcagatcacctgaggtcaggagttcaagaccagcctgaacgacatggagaaaccccgtctctactaaaaatacaaaattagccaggcgtggtggcgcatgcctgtaatcccagctactcaggaggctgaagtaggagaatcgcttgaactcaggaggtggaggttgcggtgagctgagatcgcgccattgcactccagcctgggcaacaagagcaaaactctgtctcaaaaaaaaaaaaatttctctcctgcattttaccctaagcatttatgagaagccatgcagcaccctgaacactttgcttagagatttctactgccaaatattcagtttaatcactcttgagttctactttctaccaaacagtaggacacaaacacaattccactgagttctttttataagtgtccaggatcacctttcttctaatttccaataacatgtttgtcacttccatctgagatcttatgagaatggcttttactgtccatatttctgcgagccttctgttcattacctcttagggattctcgaagattgaggctttctctgcagctctcctcttctgccagaatcacccttgacagtttgttcagatagtctaggatttttcccagcatgcacttccacactcttctaacctctacccgttacccggttccacagctgcatccacatttttagatatctgttgtagcaacatcctacttcttagtaccaatttctgtcctagtctgttcaggctgctgtaacaaaataacttaggctgggtaatttataaacaacagatatttattgctcacagttctggaggctgtgaagtccaagatcaaggcagcagcagattcagtgtctggtgaggtctcctcagcttcatagacagcaccttcttgctgtgtcctcacatggtggaaggagcaaacaggctcccttggatctcttttttagaggcattaattccactcatcagggctctgctctcatgacctaataccctcctagaggccccgtctcttaatactcttgcattggggattgggtttcagcatatgaattttgggggcataaacatttagaacatagcatagcctaagtgtgcaaaacagtcaaccaatatcattccattcaccaagttcagtgatttgactcatactagtttgatctccattcttctctatgtagccctgtccctgtgggactagtctactccctgggctcatgccaggtatgtgctgcacacatttctttccactggaaggccttccttactccctctctattcatacacatgctagctggacatcaaggttgagcacagatcccaccttttccacaaagacccctctgaagactccacccagaagtattgatgctagtctgagcactccttataatgtttgatcacaagagtttattgattattgctgctttgtcacttacctaatagttcttaaattcccatgttgtcctcataactagattgtgatttgttttgagattcttatgaccgtacaggtcataagatgtaaacattacttgcagcatgtgtctgtacctatgtatttgtttaggggagaaataatcttgactttaagtttttaaacatcttgttcctattttaaaaaatgacatgtgaatctgaaaagcttaatttagtagtaaggaagtaaaatgcttggtctttggtagcttttatcgtttatcccactgtttggcattcagtgttctgtagcttttaattcaacaaacccacatgaagtccctcctctttgtgctttttctgaatagatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggtatgttggaaacatttggagacttggaaagtgtaaattcatgtaaaactctagttacattttatcttcccttgtgctatcccaaaatttctctccttcccagctttacaccttgtagatatttgtgggttgttgtgatgttcccacttagtcatcagtttttcgagtttcacaaatttagttccttcagtcatttcctgaaggagaataacagaaaacttgtggggttttttttttctcaattttcttttgaatgactcctcatttatcttttcctttctaatagagaaatatctacagttgaatgattttttaaaaaaagaattgatcagaaacagtataagcatatttccctgtgctattcctttttaaacataaagctcaagaaagtgtacccctatttttaggtgactcttttgtccccttgccatacatacttaatcgtttttgatgctaccgatgatttccacttaacattattgaatcgaggtcccaccagataaactctctatttgattatttgcagagaaatgggcttttgtacctgccagttggccagtaacaaacgaaggtacataaggctccgtaaaatatgaagtgcaatgtttaaagataatgttgcagcttcactaaatacatctaaactaaagggactataattaattcagatatgaatgctgtaagtagcatgtttgcagtttattgctcttcaggcagtcgtgatcaatgaattaatgcttttcgtgtctaggattctggtcctgtagcgtacctcctcctcagaaggggatgcaggagagggtgagggtgcagaaaaggctgagaggcattggcgtgggcctcaagtgcatggctcaagtgcagggcagctcttttctgggtccttgtctttagaagtaaacaggtgttttcatttttagatgttctacttctgtgtcttcacttattcgtgtgtgtgtgtgtgtgtgtgtgtgtgtgtgtgcgtgtgtgttccatttacaaatgctggtttgcagaaggctcacctaacagcagatatgtgcccactggagcatcctggcatgcagtgggtagaaggcactccctctacattctgccccacaaatggccatgacacagaactgtttttacctgccaaagagcctgcatgttatcaagttgttcttccccctacgctatgtttctaacctctttggatctttatattactcttcatatatttaacatgaattttcccatactatgtaatacttctgatttagcatttttaagttttcataattctatttatctccctttccttaacatggtgaggacaatgttagatctccatagctgggtaatattgatatttaggaagatttgttagccaggttctgctttttatacttagtcttgtccttaaactgacgatatgattccactttgcgaagagtagagaatataagactgcattcctcagggtgcaagtttttaattccctaaaattgaaaaataagagaacttcttaataactggaatttacattttccctatttaaaaccttgtcttggctgggcgcagtggctcatgcctgtaatcccaacactttgggaggctgaggtgggtggatcatgaggtcaggagttcaagaccagcctggccaacatggtgaaaccccatctctactcaaaatacacaaattagctgggcatggtggcatgtgcctgtaatcccagctacttgagaggctgaggcaggagaattgcttaaccgggacccgggaggcagaggttgcagtgagccaagatcgcgccattgcactttagcctgaactacagagcaagactccgtctcaaaaaaaataaagctttcatgtttattatgtaagttatatcaagaactcttaaaaatgtgtttgcttttttatttctctatgctgttttgaggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacaggtgagcagtgggtaccacagtatggaggccccctgggaagtaatgggtgttgccattgacagggactattactacttggttaggagttctcaatcaaaacataggccaggctatggaaatgctgggtatccctggaattgccagcaaaattgtgcattggtgatgtgtgtttttcaagggtgctgttaaaaggattgttgacctttaaaaagtgaagaactagttctctacaaacaggaccaggcctaatcagggacttccagagtcaaatgaccactcataggctcaaaagtcgcaacagtgaaacagaaacaataaacaaaaactagcagccccagggcacatatgtgcctattttgtcataacgatcagaaaccttctcactttactgctgctttctgatgttttttagtccaatcttaatttactgcttccgacccttttgagatgtgctcgacatctctataaccttgcttttctttctaacctctcttggtttttcctgttctactttctttctttttttaatcaccactgatgattactgtgatatgtaggtcaaaatttccttaggcccctttatagattgtgaagatttccaggccatggcaaaatttgggattcttccgcttcggcctcagcgccccctccctgaatgctggggcccccctctgcccatgctctttattcccttcccttcatcatcctctctgacataagtgctctggggtatctgtggtttggcccttttctttattctcactcttcattttcagaacaatccttgctttctttacaaagtatccctttgtggcatttgtttttattagcctgtggacagatctccccattgtcatcctagaaccagacacctgtgggcattattagaatagattggtcttcctcagattaagtttccttcctcactgtgtggagagtatctccagcatgtgaatgaaattctctgctaacgctgcaggtgaggcccgtcctgaagcacagcatgtctgtgcactctcggtgcggaggcgagggaaccgaggaatacagtcctgccattgcttctcaccctgctctgtgcaggcgattcacagcacctcatctttttggttaggtccttggatttaatagtctttgaggtcccttcagcttttacaaatgaagattctgaatgaacttatttctaactaactcttaatttgcgaatgttggaaaatcatcaaatggcagaggctaactggcagcctgtctcattagtgagcctgagaggagcttccctaccttgtgtgattgtgttgggctttaggagggtgaatttggaatgtctcggtgttcctacatccaggtaagcacagggctgctggggttgggagtcgtccatcgtcttttcattcctcagcattggactggaaagaatggagattagtaactttagcactgttcctcggcatccacctgcagcttcctagaagacatttatagcagtcccttggtgcctttgttttctcatgagttagatgtaatttacgaattacttgtttatttaacaaacaggtgttgaacgctgttatgtcaggcagcgtgctgggtgtgtggagggtacaaaatgcaaaaaacagtccctgctattctagtgtaatatactagaaaataggcaccagtaattatagaataaacacacacattctcctacttaagcaggttattggcattctgagtatcttccagttcggagggttggggaagatgccaaagtctttagtaataagtaaaaaaatgtgtaaaacgtgagaatgatgacagttttctgaatttgacaaaaacggcagccctgacagcctttttccctctcctagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggccagtacaataggggcttcctgcggaactggcaccagttctccaccctgggcacacgtgcattccaccaccctgccgaggacattgtctgaagtgccttctatgtggctctctgagggatgatggctcctccttccgtctcccttccattttacacttcagtgtccatttctatccccagtttcttaaaggcattatagggccatgctcaggtttagagactggagtgggaagaagttaatttttctgacgccacaacttaagagacttttatactgaggcagtaaaagtagagccattcctttccagtcacctttttaattgactcagttgcctgaacttgagaaggatgtggattgctaatgcacaaattgatagaagcaattcccatccattagtatggaggaaagagtgttggattaggatagtttctagtccctctttcgattcttaatagccatgtgacccctagctgagtcactttcccaagtctcagggtcatctgcaaagtggggtactgatgcctgccctggctacctcacagagccgtcatgagggtcacgtgagggaagatggatgtggaaagcactaaaaaacaactcaagagccatggaaatacaaagtattaggaaaatattatgatggaagaaaaacgtttatagtctagaatattgaagccaatattattagggtaatcagttttcagcatataccttgttgtacagttatgagaatttctccttcttattagacatgaactactcaaacagagaagatgaccagatggattgatgctaagttgtctcatcttgaaaagacagttgacaacagttataaagataattattgctagtgtaatgtagtgtggccatgagtttaggtgatgagttcttctatttatattttataaattctgcttgggtttcttataaataactccaacaggcattcatgtgtttttcctcttcccatgtttcaccaggtaaggtgctagcacacttgtgactgtggctggaagaggagaacagacactcctgtggggatgctttactctcttttctggtaggaaggctgagtaacatcacgggctcgattattttcttcatgtatttcaaatgctgtcagttatagcactaaattgtgaaaatcagccttctggcattcacattattctggtatgaactttgaggagttgagtgacatcttcccacttaacttgcacattaattctcaattacccctccctaaataacagtatctcactaagagagaagaaacagggtatatgtggtttccactattaatggattactgttcttccctggctcttccgacaataacaagttgtttctttaatcatatcttaaaaccgaaaatgtataaaagattaaatatttatgtacaatgggttgttctactatagaattaagatgagggaatttcagatgaggaaaatacccttttgaaatgttagttttgaacatgtactgttgtgcaatcccaaagataattcatgactccttaaatttgccttggcttatagcttaatatagggaaaatattgccagcgttttcagtcattctgtgcatgctgctttaagcaagagatttatatttgttgagaggaaatattgctacttcctgcacttccaccctctgcagccagcaccgtccctactgttgccattaattggagctgtccttaagatggtcaccatattcttattcaggctgttgtcattttccccagagatggtttgtttaacgaatgataggctctgtgcctggggatgttagcagactctggggtttgtacagtgatgccttctccctggcccagagctgaatattcatctagaattaaagttggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaatagctggtgtttcttggagtgtctcctgaagtcttctgatttctgaaaaccctgcattatacctgtgctgcctctgtggctccctcaatgtctctatcctgtggccctgtccctagccctaaactgttatgttcccggtggcaatttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaaactccatctctaccaaaaaaaaaaaaaaaaaaaaaaaaagttagctgggcatgtaatcccagctatctgagaggctgaggtgggaggatcacctgagtctgagaggtccaggattcagtgagccatagtcaggccactctacctccagcctgaagtacagtgacagagtgagaccctgtctcaaaacaaaaaaaacacagaacaaacaaaataataaaattggtatttcatttccgggtgctaatatcagccagtattttgtaaatgtactgtagttaggtttaaactgttagtgattttgatggaaagtgatgtattatgaattacttttagttacattttctttagtggccattcatcttgaaaaacacaggttttttttttttttaaatgacaactgtataatcctattaaaggaaaagctgtgtgggaacagccatgtcgtagaagaaataaagttcaattcaaggtgtttggtcatatcacacatcctccgtgataaaagtatcttaagtcgtgtagcaggtggtacagctagatatcctttctaggaagtatgagacagtaacaagaacattcacttaaaaaaccacagaattttattttgtcaactcaaattttcagcacaccaaataagagtaatcatctcaggactgcacaggactttctcattttaccatatgcatttatggactacttgaatttgttatataataaatgtgtattttataatgaaaaattatttttctagcaggtaattctctaacacaattcatagaagagagcattttatcagtctttatagcatcttaaagatgaaaacattctttgaattcaagataggtatctcaatatctagatcaaactgagctgagtactagaagacaaactgagtgtattattcagcagttgcaggtgggagcatgaacagataatttaatgaattgctggactgtcatgatagagctattaccttttggaatgtccttcatgcttatcaaggtgcacggaagagaagcatctctggtgcctcagtttctctgaaatcaggataagctgctgtcctctgcagcagctgtgtagagaaccttttcatacatggtctgccttcaggggtggtgaaagtggacgaggtctggtggggtgcgtgtcactgatgctactgcactagaaggctgagtgccttggcccgcccttcctttccgagcactcacccctgtttatttctgtttcattaaggtcacatcagcaactcctgtcgtgctatacggacacattttcttcacaggctcagtcaggcaaacacttgtcctttttaaagtttactatgctaaaaatatataggatatatttgaacagacgatctctagaatgttcctttggatgatcccactgtgataaatgctatagtgaatgactagcaatccaggaaaagtcaaagaagggaataaaaattctcaaaataattcctttgatctaagaagtagctcgtagagaataaaccaggtgtatgtatgtatgtgtgtgggtgggtggagataacacacatacagactagtcgagcttcctgtcctaaatattacactaatctggctcattcgttcaccagacttgtcttactcaaggaccaagtatctgattgctgatatagctcgtggtaccttccaggtacctggaagtctggaagaatttcaactaccttcctacgaagttgctgtcgcctttcttcttttactctttcctctttcataaattttacaaacttcttccatgtccgaagggtgatccagaggatcctcctttaagaataaagaaggaaaaaagtgaaatgttgagaaaaagttggctttccatctatagcacattaagaactttataaaaataattcttatgttaataaaatgctgtataaaaggtgtggaaatcacaatcgggattatgacagtgtgaaatgctgtgaaaaaaataaggcaacaaaagggaatgagagtgactgattgattgataggttatttttatttttattttattttatttattttctttgaggcaagagtcttgctctgtcgcccaggctagagtgcagtggtgcaatctcggctcactgcaacctctgcctcctgggttcaaatgattcttgtgcctcagcctcccaagcagctgggattacaggtgcctgccaccatgcctggctaattttttttttgtatttttattggagacggggtttcaccatgttggccaggctggtcttgaactcctggcctcaagtgatctgcctgccttggcctcccaaagtgctgggattacaggtgtgggccactgtgcctggccagttatttttatttttgattgagtggtgaaggaaactgaggaggtgacatttgagcagagcaccaaatggcttccagtaacccaagctacgaggcacactcctgagttgatctgattatagcatacatattgtacccatgccaggaccagtgatgctggcaagggatccagaaaccacaaccctcaacgcaaaaatgatggaaaattgcgtgcagaatgtgccaaagttacaggcattgaggcctcagtgcgtagacatattttaaaagcctgctggtaacctgacctccaacagcagcaataacaacaaagaaccagtcttgaatatcagttgagaaaaaataccctaacatcaggttctggaaacatggtatggaagactgtttaagtgagtgtctgtgctgtcacagggaagcatgcaatggccttttaggatttattagtgtccaccacagctgaacactaggggcatcaaggtaagccaggtaccgtctgccccgggagaggctgaaacaggtgaccagagtttccatacagtgggaaggtacagcagtggagagcagcacagaggactacccagtctggtggtgaggagcagacctttttgaagatgatgtctgaactgaatttttgtcaggcaaagaaaaggctttcctagaggagagcacatcttgagtaaaggcaacgaagcgagaatagcatgccgtggtgtgtgtgtggagttacagtgttgaaacgaagtgcagagtagttaagcttatattttcacaactataggcagagatgggatttgttctggcctcttgaccatctgagggagtcccagaatgcacatcagtcctcattaattttatggctgttggttaatatttttgataatgctgatttttgttggtggaggtactgctttaaaaaaaggcatggctgggtgcggtgggtcacacctgtaatcccagcactttgggaggttgaggcgggtgactcatttgaggtcaggagttcaagactagcctggccaacatggtgaaaccccatctctactaaaaatacaaaaattagcccggcatggtggcaggcacctgtaatcccagctacttgggaggctgaggcacgagaatcacttgaacctgggaggtggaggttgcagtgagccgagatcaagccatggcattccagcctgggtaacagagtgagactcttgtctcaaaaaaagaaaaaaagaaaaaaagaaaaaggctccaaggaatggatttacttcattgcttgcttttatccattcagtccaccatttacagcttcctgtgctcggctgtgggcacactcccagtccttgaccctgtctcccattctcagccattcacatctctcttttggctacactcctgttctctgacgtctgcattttagctcctgctgttctaccctaactgaaaaatgttctcccctttgggtgaaatcttcctagatcatccttgcctacatttctctttctttccctacatttctctttctttccctacatttctctttctttccctgaactcctaaaacatattcatgatcactggtttggcacttatttatagcctatctatagctatctttttataatatttttattgatacataatatacatattttgggggtacatgtaattttatacattcatgtaatgtgtaaagatcaaatcagggtatttgggatatccatcaccttaaatatttatcttttatttaccatggggacattcaagttattctcttctggttattttgaaatgcacaataggttattattaactatagtcatcctactgatctattgaacattaggccttattgcttctatctaactgtatattgtacccattaatcaacctctcttcatccacctcccaacctctaccctttccagcctctggtaaccaccaatgtattctctatcttcatgagattcacattttttagctctcccacatgagtaagaacatgtatttgtctttctgtgcttgacttatttcacttaacacagtgacctccagttctatccatgttgctgcaaatgacaggatttcattctttttcattactaatattccattttgtgtatataccatattttctttatgcatttatccactgatgggtgctcaggttgattccatattttggctattgtgaacagtgctgtaataatcacggacatgcaaatatctcttggatgtattgatttcctttcttttggagatatacctattagtggaattgctggatcatatggtagttctaattttagttttttcaggaatctccattctgttctctataatggctgtactaatttacactcccaccaacactgtgtgagggtttccctttctccatatcctcaccagcatctgttattcactgtctttgataaaagccattttactggcataagatgatatcgcattgtggttttgatttggatttctctgataattagtgatgctgagcattttatcatacactttttggccacttgtatatcttttgagaaatgtctatttagatcttccccccccttttttttttagggcgtcactctgtcgcccaggctggactgtagcagtgtgatgttggttcacttctaccttcacctcctggactcaagagatcctttacacctcagcctccccagtagctgggactacaggcacatgtcatgactcctggctaatagttttttgtttttttttttttggtagagatggggttttgccatgttgcccaggctggtcttgaactccttgactcaaactatccacccaccttagcctcccaaagtgttgggattatagatgtgagccactataatggacttgcccatttttaaattggatttttttttgctattgtttgagttccttacatattctagttattaatcccttgtcagatggcattttagtccacttgtgttgctataaaggaacacctgaggctgggtaatttatttaaaaaaagaggtttattggacttgcagttttgccagctgtacaagaagtatggcactagcatctgtttctaatgaggacttcaggctgcttccagtcatgatggaaggggagctatcatgtgcagagatccaatggcaagagaggaaagcaaagaaaaagggggagggaggtgccaggttctttttaacaaccagctcttccgtaactaatagagtgagaatgcactcatttacagaggatggcattaagccattcattaagcaatccatctccatgacccaaatacctcccattagactccacttccgtccaacattgaggatcagatttcaacatgaggtgcaggggacaaacatccaaactatacagacagtttgcaaatactctctctctctttctgtgggttatctcttcacttgattgtttcctttgctgtgcagaaactttttagcttgatgtaatcccagttgtctatttttgctttggttgtctgtgcttttgaggtcttacacaaaaaatctttggccagaccagtggcctggagcattgtctcaatgttttcttctagtagtctcatagtttctggacttagatttaaatctgtaacccatttggatttgatttttgtgtatggtgagagaaaggggtctcatttcattcttctgcatatagttctcctgtttttccagcaccatttattaaaagagtgtcctttccccattttatgttcttggcacttttgtcaaagatgagttggttgtaaatgtgtggatttaaatctgggttctctattctatttcattggtctatatgcctgtttttatgccagtaccaagctgttttggttactatagctttgtagtaaattttgaagtcaggtagtgtgatacctagagctttgttctttttgcttagtgttgctttggctattcagggtcttctgtggtttcatataaatattaggaattttttttctatttccgtgaagaatgttgttggtattttgatagagattgcattgaatctgtaaattgctttgggtagtattgccattttaactataagaagtcttccagtgcaggagcatggcatatctttctatatgtttgtgtcctcttcaatttctttcctcagtgttttatagttctcagtatatagatctttcacttccttggttaaagtggttcccaggtattttattttctttgtagctagttaaggtgggattgttttcttctttttcagattgttcactgttggtgtatatattaataaatgctgctgatttttgaatgttgattttgtatgctgcaactttactgaatttgtttgtcagatctaacagttttttttggtggagtctttaggtttttctaagtataagagcatgtcatccgtaaacaaggctaatttagcttcttccttttcaatttggatacattttttttaaagacagggtttctctgtcacccaggctggtcttgaacccttggcctcaagtgatccttccatagtggcctcccaaagccctgggattacagccatgagccatcacatctggcctggatgcccttatttttttctcttgtctaactgctctggcaaggacttgcagtattatattgaataaaagtgctgaaagtgggcattttggtcctggccaggatgttgatttttcttttttattatactttaagttttagggtacatgtgcacaacatgcaggtttgttacatatgtatacatgtgtcatgttggtgtgctgcacccattaactcatcatttaacattaggtatatctcctaatgctatccctccccgtccccccaccccacagcagaccccggtgtgtgatgttccccttcctgtgtccatgtgttctcattgtccaattcccacctatgagtgagaacatgcggtgtttgggtttttgtccttgcgatagtttgctgagaatgacggtttccagcttcatccatgtccctacaaaggacatgaactcatcattttttatggctgcttagtattccatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtaacgggatgggtgggtcaaatggtatttctagttctagatccctgaggaatcaccacactgatttccacaatgattgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcttgtgtcttttggctgcataaatgtcttcttttgagaagtgtctgttcatacagatgttgaattttattgaatgcctttttggacatctcttgaaataattatatggcttttgttcttggttctgttaatgtgatgtatcatgtttattgatttgcataagttgaaccatccttggatccctgggataaatcccacttgatcatggtgaatgttcttttcaacgtgttattgaatttggtttgccggtatttggttgaagattttgcatttgtgttcatcagggatatgtagttttcttttttcttatcatgtccttgtttggttttggtatcaggctaatgctggcctgatagaataagtatggaagtattccctcctcttcagtttttttttgaagaaattgagtagaatttgtattagttcttctttaaaagtttggtacaatttagcagtttgaagccattaggacctgggcttttcttttaggtgagactttttaattacagcttcaatctcattacttattagtggtttgttgaggttttctgtttcttcatcattcaatcttggtaggttttatctgtctagaaatttatccatttcttctatgttttccagtttattgatatataggtgttcataatagtctctagtgattctttgtatttttgatgtctcagttgttatgtctcctttttcatttctgattttgagtcagaaaaagtctcaattcatttatttctgcttagatttatattatttcctttcttctaataatttggggtttggtttgttcttgcttttctatatttccttgaggagcatagttgacttattttttgaagtctgtcaacttttttgatgtgtttattgctataaacttctctcttaaaagaagttactgcttttactataacctatagattttgatctatgatatttccattttcattggtttcaagaaatttttaaattttttcttaatttcttcattgacccattggttgttcaggagcatgttgtttaatttccttctatctgtgtagcttctgaagttcctcttactgattcctaattttattctattgtggtcagaatagatacttgatacaatttctgttttttgaatttgttgagagttgttttgtggcctaagatatggtcttattatggaggatgttccatgtgctgataaaaagaatgtgtattcttcaacagctggataaaatattctttaaatgtcagacctatttggcctggtttctggtttaagtttgatgtttccttgctgattttcttctggataatttgtccactactgagagtggcgtgttgaagtcccctatgattgtattgcagttatctctccctttattgtttgctttatatacttgggtgcttgatgttgagtgcatagatatttataattgttatatcctcttgctgaattgacctctttatcattatataatgacctttctttatttctctttatagtctttgacttgtagtcagttttatctgatataagtatagctattcctgctgtgtttttggtttctacttgcttggaatgtctttttctatctctttcagtctatgtatgtctttacaggtgaagtaggtgtcttataggcagcatacag

SEQ ID NO: 212 - DNA, 43012 bp, Homo sapiens
cctgggttgtgtgtctgtactctatctagcctgggtgacagagcaagatgctgtctcagagaaaagaaaaagaaaaaagaaaaagccaggcgcagtggctcgcgcctgtaatcctagcattttgggaggtagaggcaggcagatcacttcagcccaggagttagagaccagcctgggcaacatggtgaaaccccatctctacaaaaaatacaaaaactagtcaggcatggtggcatgcacctatagtcctagctactcaggaggctgaggtaggaggatcacctgagctcaggaggtcgaggttgttgtgagccgtgattgagccactgtactccagtctgggtgacagagtgagatcctgtctcaaaataaagtaagaaagaaagaagctaaacaaacatcagtatggggatagatacacaaattatggcactattattacatgtaataatagtgttaaactaagcatagtgaatgcccaccaatttcagagagtggtggtccccaggaagggaaggagaggaataaaaacaaatcaagaggacttcatgtttaagtgttatactttattgttattattattatatttagtattttaaatctatttttaaaattaaaaaaaattttttttttttgcagagatgagctcttgctatgttgcccaggctatgttgctatgttgcccatgcctgtaagcccaaagtgctaggattacaggcatgaaccaccacatctggcctgttttggggttttaaaagagaaaccgaaagactggaaatgtaagtgagtgggtctcaacttcctcttctggagtttctcactgtcaagagatggggacaagagtcaagttatttaagggtgaaatctggcaacagacatggtgaagattgaaaagccagacacatctcatcaaagccccatctgcagtcaaaagaatgaggaaaaccatggggccaggcatggtggctcatgtctgtaattccagcactttgggaggccaaagtgggcggatcacgaggtcaagagatcaagaccatcctggccaacttggtgaaaccccatctctactaaaaatacaaaagttagccaggcatggtggtgggcgcctgtaatcccagctactcaaaaggctgaggcaggagaatcgctggaacccaggaggcggaggttgcagtgaactgagatggagccactgcactccagcctggtgacagagcgagactccttctcaaaaaataaaaaaaagaatgtggaaaaccagagaactgtagattccttttgtttatttgtttgttttatgagacagagtcttgctctgtcaccaggctggaatgcagtggtgccatctcagctcactgcaacctctgcctcccgggttcaagcgattctcctgcctcagcctcctgagtagctgggattacaggtgcatgccaccatgcccggctaaatttttgtatttttagtagagatggggtttcaccatgttggccaggctggtcttgaactcctgacctcaggtgattgatccgccttggttcccaaagtgctgggactacatgcgtgagccaccgcacttggccagattcctttttgaagggactaattcatacttaggtagggaaggagtccctaggatttagaagacagaatgagagctgaaaataatgaaatctgattataaattgtaagaaaacaggggaagtaaatatatcatgaaaagggtcaccgattagtttggaatctcacttataacaattctgctgaattgtctcttactttatggttgtcctccagataagatgggagaaaaaataaaataaaaaacttgttcagtttctcacagcatttattgggagcatttcagattaccttgaaggcatcagtaaggaattctccattttttttcttggagaattgtaagatgaaatggaagatctatccccaagaagggcagatgaaccaagtaaggcaacccactcttgggcaagagggatcatctctggagcaagactcaggtgtgatgtttcctaacatgagcggggctgttgagtggagtggtcaccggtagattatttgcagtctctgtggcccctaggagctcaattttcaaagctgctcattagctagatgtgtacagtactgtcatttcttcccctaaggcagctcaaatccttaatgagcacaggtcagacgtgagcacaaagggggaattcctggatggttgactttctgaccccaagggacaagctgtatgtcattctcttccaaccacatttcctcttatcccgagggtatctcattcttggatcctaggatcggacccctagggagctggtggaatcctccttagacagaatcccagctttctctgagtcagaaattgcttttttttttttttttttttttcaaaccaagtctcactctgcgccctggctggagtgcagtggcgtgatctcagctcactgcaacctccgcctcccaggttcaagcgattctcctgcctcagcctcctgagtagagtagctaggattacaggcacacacgacacctggcaaatttttatattttcagtagagacgaggtttcaccatgttggccatgctggtctcaaactcctgacttcaagtgatccacacacctcggcctcccaaagtgctggaactataggcacgagccaccgcacctggcatcaggtatttctttataccaacacaataatggcctagtacagtaagtttttggaaaagaaatggtgacataatgttgacaaaatgcagataaagcccaaacccagtctgaaacaaatgaagaacaaaacctaaagttgatagggtatgaaatggtgcagtgatggtgacaaaaaatggggcctgtgtgggtttctctttaaatattgaccctaaacttgggaagacaaggggaaaaatgtctgcattcataatcaaaggaatgatacttccatcgtttgatattttatgtagtttactaaggaatgattctattacgattggaaattacattgacaggcaaaagctattatgtatgaaaaatgagaaagaattagacaatggcttccaacgtaaatattaaggagaacaggtctttaagaagacagttctttcaaaaaaaaggccaagcgtggtggctcacgcctgtaatcccagcactttgggaggccgaagaggcagatcatttgaggtcaggagtttgagaccagcctggccaacatggtgaaaccccgtctctactaaaaatacaaaaattagccaggtgtggtggtgggtgcctgtaatcccagctacttggggggctgaggcaggagaatcacttgaacctgggaggtggaggttacagtgaacagagatcgtgccaccacactcaagcctgggtgtcagaaagaagacaggtctttaagatcctaagtaggaaatgataggtaaaaagtgaaagatagggaaagctgaagctatatgaggaaactcatagtaaatgttctctgctttccccttaagcttttcttttttcttttctattttttttttagagacagggtcttgctctgtcgtccaggcaagagtacagcgatgccatcatagctcactgcagccttgaattcctggactcaaggaatcctcctgcctcagccgcccaattgactgggactacagatatgcaccaccacatccagctatttttgtgtgtgtgcaaaaatgggaactcactatgttgcccaggctggtctcaaacacttgatctttccacctcaggatcctaagtagctgggatagccaccgtttcgccaccatgcccagcctaaaatcaagacatatgaacaagagaattcacaagttttctgtttctctgttgcaccaaaggcagttccatcatgacccatccagtatcttctccttctggattcaaggtgtttttgatcttgggtcttgattttgtgtggcatgtacaacctcaaagcaatatggtgaactttttttacctgctctatccctaatgtatatccacattattgaactgcattgctcaccatttatcaaaactcccatgctgccctgacacatctctggcttctcatctgaattggcatcaacacagagacctaatgcattcaagtcattggcacctgactcctgttctttaaacacccagctatgccatgattcaggataatttattttcttttatttttgagacagagttttgctccttcacccaggctggagtgcagtagtgcaatctcagctcactgcaacatctacctcctgggttcaagcagttctcctgcctcagcctccctgagtagctgggattacaggtgtgtgccaccatgcctggctaatttttatgttttagtagagacggggtttcaccatgttagccaggctgaacttgaactcctgacctcaagtgatctgtctgcctccctaaatgctgggattacaggcatgagccactgcacccggccccaacttcttcaccctttcggccttactgcatctcctctcctaatgcatagaggcctccaagccatctattcttcaaccatgttgctatttatttatttttatttattttgagatggaatcttgctctgtagccctggctggagtgcaatggcgtgatctcagctcactgcaaccctcacctcccgggttcaagcaattctcctgcctcagcctccctgagtagctggtattacaggtgcccgccaccatgcccagctaatttttgtattctatttatttattttgaaatggagttttgctcttgttgcccaggctggagtgcaatggcaagatctcggctcactgcaacctctgcttccaggttcaagccattctcctgcttcagcctcctgagtagctgcgattacaggcatgtgccaccatgcccaggtattttgtatttttagtagagacggggtttctccttgttggtcaggctggtcttgaactcccaacctcaggtgatccacccaccttggcctcccaatgttatgggattacagccgtgagccaccgcgcctggccaacctcatttctttaactaggtaactgagattcaatcatatattttccaaaacctcaaattccctactctctgtcctatcataatacctgccctggaaaacgctaaccatctgtctctcctgcctacataattctgccgccacgcggtgatatgggaagcgctaaaaaatttgagatcacctactctaaaggggccttcgacacttcaggaaatttccagtgggcaaagatcttttcatgatttctgcaggattttgaattcacaccatctcaacttccctcttttttttttttttttttttttttttttgagacagagtcttgctctgttcccaggctagcgttcagtggcaccatctcggctcactgcaacctccaactccctggttcaagctattctcctgcctcagcctcccgagtagctgggattacaggcacgcgccaccacgctcagctaatttttgtatttttttagtacagacgaggtttcaccatgttggccaggatggtcttgatttcctgatctcgtgatccgcccgccttggcctcccaaagtgctgggattacaggcatgagccactgcgcccggccacaacttccctgtttaataacaaatgattttacaacttactgcagagagaaatagtaacgaccatgagaaagatttctcaccttctttattttttctcttatcctagattcgagagatttctcaccttcttgacactagtgcgaaagtagtccagtaacaacatcaccagttctttcttctttcactctgcaagcaatgagatgtctgccttcttatctacagccagtatctcctgcttttttttttttttttctttgatacagagtctctgtcacccaggctggagtgcagtggcacgatctccgctcactgcaacctctacctcttgggtccaagagattctccggcctcagcctcctgagtagctgggactacaggcacgcaccaccacgcccggctaatttttgtatttttagtagagacggggtttcaccatgttggccaggctgatctcgaactcctgacctcatggtccacccgccccggccaaagtgctgggattacaggcgtgagccaccgcgctcggccatctcctacttttctatgcaagggtttctcatcattggcacgactgacattcaggacctggtatttctgttagagggagtagggcattctatactctaaccactagatgtcagtagtatcccgggtagtggtaaaaccaaaggcgtctccacaggtggcacaattgtccttgttaagaatcaaaacgtgcctcactcataggtgggaattgaacaatgagatcacatggacacaggaaggacatcacactctggggactgttgtagggtggggggaggggggagggatagcattgggagatatatctaatgctagatgacaagttagtgggtgcagcacaccagcatggcacatgtatacgtatgtaactaacctgcacaatgtgcacatgtaccctaaaacttaaagtataataataaaaaaagaaaaaaaaacgtgcctggcgccgtggctcacgcctgtaatcccaacactttgggaggccaaggcgggtggatcacttgaggtcaggagttcgagaccagcctgaccaacatggtgaaatcctgtctctactaaaaatacaaaattagccagccatgatggctaattacaggcttcatacctgtaatcccagctactcgggaggctgaggcaggagaattgtttgaagccgggaggcggaggttgcagtgagccgagatcgcaccattgcactccagcctgggcgacaaaagtgaaactaagtctcaaaaaaaaagggacccagcgtggtggctcacgcttgcaatcccagcattttgggaggatgaggcaggtggattgtttgagcccaggagttcaagaccagcctgggcaaacatagggaaaccctgtctctatgaaaaatacaaaaattagacaggcgctgtggcatgcacctgtagtcccagatacttggggggctgaggcaggaggatcacttgagcccgggagatcgaggctgcagtgagccgtgcactgcagcctgggtgacagagcaagacttgtctcaagaaaaaaaaaaaaaaaaaaggcatgatactggcataaaaatagaaactaaaggaacagaacagagagcctgggaataaatccaaacatatatgatgaactaattttcaataagggcaccaagaggacaaaatgggaaaaggatagcctcttccgtaaatgctgccaggaaaactagatttccacatgcaaaagaaggaaatttgacccttatcttacgccatacacaaaaatcaactcaaaatggataaaagaccaaatatatatatatatatttttttgatattacaccaaaagatcagactacaaaagcaaaaattagtagacaaatgggactacatcaaattaaaaagcttctacatagcaaaggaaacaatcaacagaatgaatcggcgatccacggactgggaaaaaatatttgcaaaccacatatctgataaggggttaatatccaaaatttataaagaactcttataaatcaatagcagaaaaacaaataacctgattttaaaatgggcaaagggtctgaacagacgtttttccaaagaaggcataaaaaaggccagcaggtatatgagaaggtgctctacatcactaatcatcagggaaatgcaaattaaaaccactgtgagatatcacctcacatccttaaggagaactatcatcaaaaagataggagaggccgggcgcggtggttcaagccggtaatcccagcactttgggaagccgtggcgggcggatcacctgaggtcgggagttcgagaccagcctgaccaacatggagaaagcccgtctctactaaaaagacaaaattagttgggcgtggtggtgcatgcctgtaagcccagctactcgggaggccgaggcaggagaatcgcttgatcccgggaggcggaggttgcggtagctgagatctcaccattgccccccagcctgggaaacaagaacgaaactccattgcaaaaagaaaaaaaaaaaggaaaaaaaagatgagagatgaatgttggcgagggcatcaagcaaagtgaaccctagtacattgttggtgggaatgcagactggtacaacctttgtggaaaacagtattcaggctcttaaagaaatctacaacagaactactatatgacccagcaattcctcttttgaatatatgcctaaaagagatgaaataatcacctcataacgatgtctgcactttcattttcattgtagcattatttacaatatccaagttacggaaacaacctgaatgtccattgatgctcacatgaatacgaaatacaaaatagcagctatgtagtctgaataatattctatctcttttgtatttatatatgatgtcaacattaatatcatataatattgatatatatttcatattatattaaatattaatataatatgttgtatataaatatatacctattacataatagatattcccattatgttatatatcatgtaatatattatatgtaatatatgtatataatatactatatgaaatacatattatatattatatgtattattatatgtatatatgctatatattatggtgtatatattatgtattatgaaatatatattacgttatgtaatatagattatatattatatatgaatatcttatatccatatatattccatacatacattttatatgtgtgtgtatatatatatatacgcaccatggtccatcccctcaataatatattttccaaaacctcaaatttccttctctctgtcttttataatacctgccctggataatactaaccatctgtctctcctgcctatataattctgcccctactggttacatgggaagccttggtttcctaaagtgttgagattacaggtgtgagccactgtacccagcctgattctggaattttgtatatgcagactcctcctgctaaaataatatatattatatataatatatattccataatatatataacatacatacatatattattttagcatatattatataatatacggtaataatacacataatacataattataataaatatgatataatatatattccattgtataaaacatataatatatataacggaatattattcaaccttgaaatagaaggaggtcctgacatttatcacaagatgggtggacctggaggacattacgctaagtgaaataagccagacacaaaaagaaaaatattgcatgacgtcacttacatgaggaactttttttaatcaagagagacagctcaaatacacagaaataaagaatgaggcagttggggaagaaaatgggaagatgtgggtcaaaaaatacaaaatagcagatatgcaggatgaacaccacacaggtgatggtgattttacgcccttcccaaggtgtcattcagaggcacgtggtctccatctgaccctcactggtgatattgatttgatcacctggtccagatgttgtccaatttcttcgctgtacaatttctattactttttctccattccaacatacgagcagtttatagagaggcatttaaggcaattcaaatattctgctcgtcatgcaaatgtcccccagttgtgtcatgtagatgacaattcttgcctgattcaacctttaccactacgatggctacaaaatgctgtgggttgtggttgaaaatttgagtcttgagtagaaattggagaaatatgctggaccgtcagattccaccggggcacggccgccatgccaatccaaacttcaaaactacaattcccagcatcctctccgccccgcttccgtattagacgccgccaatgaagtcccgcgagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtgtaagccctgctttccttaacccttctccccctcagttccaggggtcacgggaggcctatctggcggtgaggactaagagggtacgagggtcgggggctaaagagctaggcatccagacgaggggtgcgtttagatctcgcgatcagcgatatgaaaagctggggacgcgaaggataaaattggaccattgcagctagtgatgagagaagcattggtcacctgatcctgaaaagccctaagtctctggtgggggcggaaaagcccggctgaagtgaattcaagagtttgggggcagttcaggagattggggggcgtcaggatttggacatcgcgaggagaaatcaccttctttctgcgctgtagtcaattttatctcgtgaatgtcagcacattggtgttcttattagcacttaccttgagtaccttttatatttttaatttaagaccttctggttgcacttttttatttattttaattttagtggactcttgtaaatagcctatatgtatatttactattcagttcaacattttgttaattaacttgagttagtccagttatacttatcgtgattattaatattttccattgaattttaccgtcttattttgtggtgtgtcctttcctatgcacatattttaacactggaaaataggacatacatgcaaaaaaagtatgattacacacacacgcagacttacacacacttaaaaggacaacagtaaagcgaatttacaaaccaggccaagaaagagattattaaatctcagaaagctgtgtgcctcttctaaactgcatcctcctctcccaccaatactgtctccgtggatttgactgcgtatacatcttttccagaaaatatatttcctaaattttggtaattatttgtgaatgaactcaggcgcttcagtatttttggaaacaatctttttctgtattgattcaagcacacctttgtaatttagagatttctaaatatcttgtagatgaagtacttacacctagccattctttttcaggaatgtcatggcttaaattctagtcagttcaccaaattccacatactggacttttgttttcaagttgtggtgaatctatatttgaactttgggaatattgtcgtttttatgccattgagttgcagttaattgatttacatcatttatttacatcttctttaatgcctttcaataaagtgttttttgttgttgttgttgttttttcctttttgagatggagtctcacccttgtagcccagactggagtgcaatgacaatctcggctcactgcaacctctgtctccctggttcaagcggttctcctgcctcagcctcccgagtagctgggaatacaggcacccaccaccacacccagctaaattttgtatttttagtggagatggggtttcaacatgttggccaggctggtctcgatctcctgacctcaggtgatccaccggccttggcctcccaaagtgctgggattgcaggagagagccacgatgtccggctcagtaaagttttataagtacctgcaaaaaggatttaggttgtttttgttatatttattcttgggaactttgttttttggtgctcagaaaagtctaacttttgtgtagtttgttggatgttcttcgtagacaaggaaaatgtgtacaattcaaaaggaaaatacaaatatttattttatacagacgataaattgtcttttttgtttgtttgtttgtttgtttgttttttgtgctggactgggtggggacttcccttgtcattgactggagtttggatggcacactctaggcaagcctgtttgttttctgatcttaaagggaattgtcatttgtgtctgccgaaggcttttctgtcgaatagtttttattaggtcaaggaagctcccctcttttcctacttgagtttttcttgtgaattgctgcaggcttttaacaagtgattttttttttttttttgccattatgtatctgtttattgatacattttgtatctgtttgatacaaaatctatattgatagttttgtatctgtttattgatacatttctagtaccttaaattatggcactcagtactgctgtgtaacaaattaatgagtgaataatataattttttttctatcctgtagtgtggcaaattaaaccaattgattttctcttgttacattgaatttgtattggtaaataatttggaaaggacatgttactatttgttacttttggcttcggtttgctaatactttgtttggtgtttttggatctatgcttgagtgaaatgttccttttctgtttcagatttatgccagcctcataaaatgggatgagaagtgttctgttttctaaactctggaatgttttgcataagaatagaatattttgttccttagaacgggagtggtacctggaaaaaccatttgggtctggagttttctttgtggaaagttttaaagctattgtttctgttcttttaaggtttgtggggcattcaggttttctgtgttgttatgatgagtaaaatttctttaggaatttatttattccatctgaggtttaaatcgtatagtcagggttgttcataacatactcaaatttttaatgcttgctgcatttgtaatgttatccacttttttatttataataattatatgttgctttttacaaaaataaattccatcagaatgttgtcagttttcttcttaaagaacttctggcttgattgaaccactttatgatatatatgttttctattttataactttctgattgttatcattttcttcctttttgggatgtttctttccagtttcttatgttgaatgcctgtcacatcccaaagaattgcagtatcatactttattgtattttaattataaatatcaaatatcatggcttctttggcatgcagatttagaatttttttcttttaattttcatttctgtgactttttttctggttatcttttggtcattgtttgccaactgcattgctctgtggtcaagcattttctgagacaaacatggccccatgagtgctgtctcatcatgttcaatctgcacatagttattgaactgcctgcttaaactggatttgtgagagctctggtggtggcttcatccatttctccttagaattctgtccccccttttttttttttaatttttgtgttttccttttttttgaggctgtgttttatacacacaggcacacacacacacctctttttggatttataactttttattatgtaatacttcatttttctctatgagcctttttgccttaatctattctgtctgatactaacattcaaaccagctttctttttttttttttttacttgccttatatatccttttatttccattcttattgtactcttttttctttctttctttctttctttctttcttttttttgagacggagtttcactctttttgcccaggctggagtgcaatggcgcgatcttggctcactgcaacctccacctcctggaatcaagtgattctcctgtctcagcctcccaagtagctggaagtacaggcgcatggcaccacacccagctaatttttttattttcagtagagatggggtttcatcatattggtcaggctggtctcgaactcccaacctcaggtgatccacctgccttggcctcccaaagcattgggattacaggcatgagccaccgcgcccggctcttattgtattcttatattttagatatctcttgtacgtagcatataattggattaatctattctgtgaatattagtattttagttaaagcatttattctgttagcatcttctgtattaatatatttgaatgttacatttgtcttctgttttttctctagcttcttttgtgtatttttgtcattctccttttttattttctgtacattttgaatttatttactctattatttcagtggttgttctaaataattcttacccatgctcattcactaaatctagatttgcatatgttactctcctgatttacatggttttcttatgcattttcattctttctttattgatatatcatagttgcacatattgagttctttttttaaacctcagaagaaattattattgctattgcataccatcatttcttgtttcattatactcacatgtttatcactttgagcactttacttggttcttacactttttggtgtaattcttccactgtttgctttggttctttaattacttctttctccctgaggtatgtctttgatgatgtctcttttctgtgggttgcaagcccacaggaactttgttttttggtgctcagaaaacacctctttctctctttctcagtggacatttttggtggtaatagaattttatatttcagaactatgaagatgttccattatcttctggcttccactgttaatgatgagaagtcagctgtcagtctaatgtttgtttgtttgttttctgagacagagtctcactcttgttgcccaggctggagtgcaatggcgtaatctcgtctcactgcaacttctgcctcctgggttccagcaattctcctgcctcagcctactgagtcgctgggattacaggcatgggccatgacacccagctaatttttgtatttttagtaaagacaaggtttcaccatgttggccaggcagcggttttaggagcctagaaatgtgagtttttcgttttgttttgttttgagacagggtcttggtatgttgcccaggctggtctcgaactcctgcgtgcaagtgatccacctgccttggcctcccagcatgctgggattacaggtgtgggccaccatgcccaggcttactttgtttcttaatggagagatatttacggtgtgttttaacaagacctccaggtgactcccatgtaacttaaagtttgagaactattgcttaaaaggtaacctgtctttttctcctctggctgctgttcagatattctttttaccgttggtattatctggttcattgtgcttaagattttatctctcttcaatctgtttatattttccttcaaaatgaaaaatctacagccactatattttgcagtgattgcctaggctccttctctgtctctcatcagtaactccagttagaaatggttcaattccttatcttctgcccccacgtggttcttagctgtatttatgttcctcaactctttttctgtgcttcccttgcatttattgctacaactggctttgaaacttcagccttcataaaaatttcatgtagagtttattaaaatactgattcatcagcccaccccaaagagaattgaactgagatatgatctgggtgtcagagttacttaaagtgttccaggggacgcttatgcagcagactatatttaagaaacaaattattattattattattattattggctgtgtataatctaaaagctatttacttagggcttttgttgtgggtttccattttgctttttttttagcaattgtaattgccctttagaaatcataaatttttaattttctgaatgttaatttcttgccagcacatgaatttgaaacctatcatctgtctgtactttgtgttgcatttgaaatagttatgcatggaaggtttaattggggcacctaggttgcttgttggaaacagaattcctaccctgctccccaccccctgggacatctcatctagctggttgaaaggagggtatattgatttactaatgtaatgcatttctggaccaagaaaatggcatatgatgttctcacaacctttgttgccttctctgtctctcgctatatatatattgtatatattatttatatactttttttcttttttttttttttgaggcagtgtctcatttctgtcacccaggctggaagtgcagtggcatgatcttggcttactgcaacctccgcctctcaggttcaagcaatcttcccacctcagcctcccaagtaactgggactacaggcatgtgccaccatgcctggctaatttttttgtatttttagtagaaacggggtttcaccatgttggccaggccagtcttgaactcctgacttcaaatgatctgcccgcctcagcctcccaaagtgctgagattacaggcatgagccaccatgctgggcctatatttacgtgaataacagtggtagaaatggttctagcaagggcagaaataccagtcagtaaaagtaacaaaataattattctctctacagtatttacatctgcaaattctgaatatcctgggatactgtgattaagttgaatatggggataaaatcaaatattgggagaattatggtcctgagaaagctcataatggaacagttttgggcaacatttgttttggaccacaaacttgatggaggaggcagatcttctaaaactgaggagcagggctggagcaagggtgaggtttgtgagtgcagagccagggagccactcgctctgagccaaccttgtgcttgtctgacaccagaagtgcttccttaaataccacactcttgtctagcagccttggttgcctcatcccagtcctggccctggtgaggagaaaaacagatcccaatgagaatagagtaagatgtgtagaaatagaaaaatagaactgctttcaccatgctgtaaagaaaattaaaagagaaattaagcaaccccaacagctctgaaaaattaacctgtccgttctaactcatccatggtgacagcattccaatgacactggtttttttttttttttttttttttttttgagatggagtctcgctctgtcgcccaggctggagtgcagtggcacagtctcagctcactgcaagctctgcctcctgggtttcacaccattctcctgcctcagcctcctgagtagctgggactacaggcgcccgccaccgcgcccggctaattttttgtatttttagtagagatggggtttcaccattcacaggatggtctcaatctcctgacctcatgatccgcctgcctcagcctcccaaagtgctgggattacaggcgtgagccaccacgcccggctgatcctggttttgtttcatgtatcatgtagaaacggggcagaacgtctctgagttcatagatcctacagctgttctagacaccctgctccacatcctgctggggtcgcttagatgctgaaatcttcctgctttatttgtattcatggccaccagttctttgagactctctgatacagtttggatgtgtatccgccccctccccccctccaaatctcatatggaaatgtaattcccaatattggaggtggggcctggtggggggcgattggatcaggggggcagatttctcatgaatggcttagcaccatcccccttggcactgtcctcgtgatggcgggtgagttctcctgagatccggtcatttacacgtgtgtggcacctcctcccaaccctgctgtcttgctcctgcttcaccatatgctttgcctgcttcccttttgccttctgctatgattggaagcttcctgaggcctccccagaagcagatagcactgtgcttcctgtagagcctacagaactgtgagccaattaaacctcttttcttataaattacccagtctcaggtatttctttatagcagtgcgagaatggactaatacaccatcacccagcactgacaacccctgaaagtgatagaatcactcaggtgagaacttggccagaagctccactctgagctctggtttgcatcgttgcaaaacatcgacaaggttccacagactgaattgatgtgggtgcgctctctaagctccagccctctggacactttgtccttcatggagggtggtggtggatgttggccccagggtgttgggctaagccatagggctgtgtcctagtacctggattactgtttaatttcacaggaccttctgaggagatcccagaccccctacattccataggcccctcctttatggtctcccaaggtctgggtggctgtctcagtatgaaggcaaatgtagatcagcttgctcatcatccattcattctttcattccctacttattgtcttatttatatcaggcactggaatggtgaatgaaatatcatcaaagtaaaaagtctctactcacctggaatgtattttctagttgggcatacaggaaatcaaaacaagtaaactacatagtgtgcatggaggagacagcagagagataataatgcttacccggtgttctgtgtcctgtcctacatttcccaggatccttggagctggcaggggcatgtgactagttctggccaatgggctgcaagtgcttcagggtcaaaatatagacgacagaatgcatagttgtccagcttcctgctcatcatctatgaccaacatggccaagggtatcagttggttcagagacaagtggcatccttgaacaacaggaaaacttttgacatcagcctgggttgaacaagtgacatgagcaaggcgtaaactttccattttattgagtcattgagatttgggtttgtctgtttttgcagtaaaaaatagagcctaatcttacacagaacattacttggaaattagtgctttagggaaaaagaaaaggagtggagaattgggattgaaagaagcaggggtttgcattttaaaaagtggccaaggcgggtggatcagctgaggtcaggagctcaggaccagcctggccaacatggtgaaaccctgtctctactaaaagtacaaaaattagccggacacagtggcacacctatagtcccagctacttgggagcctgaggcgggagaatcacttgaacccgggaggcgcaggttgcagtgagctgagatcacactactgcactccagcctgggtgacagagcgagactccatctcaaaagaaaagaaaagagtggccagtgaatgccagatcaggacaggtaaagttgaataaagatctgaaggatgagagggggccaggcacactgagaatgtgggggaaacatttcaagcagaggagcagcaggtgcacagaccctgaggtgggagcatggctggcggggcctgatgcacagcagtgaggcttctgtggcttgggtgagggaccagtggcagagcgagttgtgggtgaggcggcagggacctgggcccttggtctgagtgagatgggacaccatcagaggatcttgaacagaggagcggtgtgatcttcattttacccataaagttacggctgtcatggaagctaagggaagtcagggacagcagctgggagaccagttaggaagcagttggaatgttctagaagagaagcgatgccttatgccaaggcagtagcagtgtaggtggtgagaagcaaccagatttttgtattaagttttaaagttaaggctggcaggatttgctggtgatgcaggtgtggtttatggaaaagaaagaggagagttgaaggtgatgacgagcaaggcttttgacttgagcccctgggaggctggagctgccatcaacgtggggaggctggtggcagcacagttgtaggtgtttaatgtgggatcctgttggctgttgcagtagggatactaagtagccacctggctgccactcactctgagtcattctgggtggggcaggtgccagggagcggagagtggcacccactataaatgaacaattctgttaagtaattgtgaaatcgtcagtggtcattttattttaatgataatggcattttagagtgaatgtttgtttactgagcctatagagttccatacataacccagtgttaaagtcttcagtttccagatgagaaaactgagttttgatgaactgactcttgggaggggaatgagcagaactgtgggcttgcattaaaggggagtctactgaggcctcagggacagggagaccttcacagaagtgcaatcagaacctgggtgtcagcacctccaaatggtgggggtgtttcacaatgtggacctgtgggagatgggggagaggggcccaggggaaccctgacctttaggggctgggcagaggagggatctcaagccagagtcttcaaaagagcaaccagagatgtgagcacagactgggatgagtgggctatggctgcaagagcagtggcattcccaggaagagggagatagattcatagtgagcaagatgatgtgtcaggaggtcaggcaaaggaagggtcaagatgtagtgtcaaggagttcccacataggggacagtacaggtgacataggtcactttgagaggcaacaagatgtggctccgcagtcacgtcagctgggctcacaacttccacctatgaccttgaccaagtgtctcggacccttggtgccttattctctgggtacttgagaataattccgggaggttgtgaggattaaataggagtggccctggaaagactcaggagaatgtctcataccttgtaaacactacacatgtcgttatttgtagaattggcattaatgttggtggggaaaggtggaatgggacctgcagaagcttgttagttgagcatgaatgaatgaatggtaggtgaggatggagatactgtgcctcaggaactgagcctctgtcaccctctctccccttcctcagcagtgacttaatgtcagaacccaaaggcacaatgactagaaaagggctttgtaaaaagaatgaaagcgtcatgcatctttgagttggcccaagatcaaatttggtgttgaataatgaatccccaaggcagagtttatacgttaaaacacacttcctatattattgttttgaaatgtttctgaatatctaaaacaattccaatagcagaaatactaattgatgttgaaaaagattgttataaccctggtaatgtttaaaagtggtaatattgattattgatctgagtcagatgttaaagtagcagcgtcacggttcttacatcagtgctgtcatgagagtcgcggtggaagccagagagaggaggcatgttcatacaaagcaaattaaatcccctcccgaggtgtgggccaccatacctcaccaatgtattgtggttttgatgttatttccttaatgactgatgttgttaatcatcttttcatgtgtttacagttcatttctgtaaatttggagaaatgtctgttctgttcaagtctcctgcccacttttttactgggttgtctttgttgttgagtttataatgatattaaatccctatcacatacatgatttgcaaatattttccaccattctgtgtctcattcactttcttgataatgtccttgatgttaattctaaatgtttggtagggttcaccagtgaagccccttggtcctggactttttttttttttttttgagacggagtcttgctctgtcgcccaggctggagtgcagtggcgcaatctcggctcactgcaagctccgcctcccaggttcacaccattctcctgcctcagcctcccgagtagctgggactacaggcactcatcaccacgcctggctaattttttgtatttttagtagagatggggttttaccgtgttagccaggatggtctcgatctcctgacctcctgatccacccgcctcggcctcccaaaatgctgggattacaggcgtgagccaccgtgcccagctggtcctggactttttatttaatggcttttgatgactgcctcagtctcttgttataggtctctcaattttctttttcttctagagcctgtttgggtatgtttcaaggaatttgatacatctagagcattgatccccaagccctgggccacagacaggtaccggtccctggccttttaggaacaaggccctgccgcaggaggtgagcggagggcaagtgagtgaagcttcatctgtatttacagcggctccccatcactcacattacccctgaactccacctcctgtcagatcatcagcagcattagattctcataggggcgcagaccctattgtgcactgcacatgcaagggatctagattgcacactccttatgaaaatctaatgcctgatgatctgtcagtgtctcccatcacctccagatgggaccatctagtttcaggaaaacactctcagggcttccactaattctatattatggtgagttgtataattattttaccatatattacaatgtaataataatagaaataaagtgcacaataaatgtaatgcactcaagtcatcccaaaaccatcccccctcacctcaccatccatggaaaaattgtcttccatgacaccagtctctgatgccaaattgggtggggactgctagtgtagatgatctaatgtgttggtgcataattgttcatggcattctcttacagccctttgaatttccgtaaggtcggtagtaatgtcccacttccactgatgattttagttacttgcatctttttttgttagtaattctagctgtagttttgtcacctttgttgatctttttgaaagaaccaacttttgttttcattaattctcctattctctatttcatttgtctctgctttaatctttatttcttcacttttgctttccctaggtttagtgtgtcaaggtagttgtttttgtttgtttgtttgtttgtttgtttgtttgagactgagtctcgctctctcacccaggctagagtgtgatggcacgatctcagcttacctcaacctccgcctcccgggttcaagcgattctcctgcctcagcctcccgagtagctgggattacaggcatgcaccaccatgcccagctaattctttgtatttttagtagagacggggtttctccatgttggtcaggctggtctcgaactctcgacctcaggtgatccacccaccttggtctcccaaagtgctgggattacaggtgggagccactgcacctggctggaactggtttttgtatgagatgtcttactggtggcttttcctaggcaaagggaataagatctcgagttcctactggaacctaagtgttagagatggggattcaggttaaatgagtggatgtgattacctgggcaaagcatgaggcatgcgaaggaatgggtaaagaatggctcttgagcagaatcagcctttagtggtgaaagaggacctctggatggtccagatgatccagagaagcagggaaagaaccaggagacagttgtagaggagccgagaatagagaatgattctcaaagaaaatagacaccacattttcgtgagactctaagactgaagtgcatttactggattcactgacacgggagtaaattgtattttctgtgaggatggggatgatggtagtggatgctgggtgtactgaattgggagatggtgaatgtagactgctcctaagtttttgctcggaagggggcactaaggggagccagggcaggcattggtttcaagatgggatagacctgagcatgtgtccatgcataggaaattgtctagcagggcgagaaatgaggctgaaagtaaaggagagccaggtagtgcgagggtccagagacggggatgggcctggagcagatttgaaaggattgccttgagaagggagggcagacatctctttgtcatagaaggaaaggaggaggtcatagatcagttgtgagaagactgtttaaataactagaagcaagaaggtaagaaagcctcattttttttctttcttttaagcagggtttaatatatgttcaagaaaatgcataggtcttacttaggtgatcagtttgaatttttgacaattgtgtacactgtacatctgaaaataggtaagtttctatcatcctagaaagttccctttgcttctttcagtctatccctgtcttatcctccattgaagaaacccccttttttttttcaattctatcaacttaattacgttttgcctattcatggacattatattgttggaatcagagcgtttcttgtgtgtccagtttcttttggccagcatcgtagggatttctccatgtagtgtgtctgcatagtttctttttattgctgagtagtattccattctgtaaacattgcaatttgtatatccattctctggttgatagatgtttagattgtttacagtatttggctattaggaatcagactactacagacatttttgtacgagtctttgtggatataaattgtttacagtttctcttatataaatatctaggagcagaattgttggatcagatagtcagtgtgcttgttaaaaactgccaaagtgttttccaaagtagttgaactatttcacactcctaccatcaggatatgagaggtgccagtgtgccccaaactcagcagcatttagtattggtagtcttttttattttggctgttctagttttaatttgcatttctctaatgactatgatattcaacaccattcgatgtgattcttactggttttgtgaaatgtctgtttattaattaaagtcttttaccctttttgttgggttgattttctttctttctttctgttttgaaggagttctttttattttttccaataagccttttgcactcctatctaggagttctttaatctgaatacgaattctttttcaggtgtatgcattgcagatatttttttcccaatccgtggttcactgttcattttccttttttctttttctttttttgtttttagagacagaatcttactctattgcccaggctggagtgcatgatggtagctcactgcagctgttctctatgaatttttaagtttctgattcatctcaaaagatgtttaaattcaaattcagtgagtggaggaggtggcagaagcataggtggccgcgaatctctaaagtgagagttgatgtgagaaggttgcacaggagactttgcccagagagcagatttccaaatcattgcctgtgaggtgaggctgattctagtgatgatgcagtccaggccatggcccaagggtgtatatgttggtgtggagtgtgggtgcaaagggcattggagtttggaactcatggttgatcctgggtggaccatcttcatggatagagccatcctaaatgatcgcaggcctcgaaggtgaaggaagagcagaagtctaggaccagagtgtttaatgagtgagggggtttaacagagttgtacttggtggaaaatcacttaggaagagtaattctgaacccacttatagcagatcaggggctgtccccccaccacatcaccacattgctgagagagtttacctaagtaagataaaagtccaggatcaggcagatcttgctgctcaaaagaggaaatgccaaaaaacaaaactcagagttttctttggtgagcaggagagacagatagcctttcactactcccgatgttctttcatttgctacagatgccagcttggagagtcacgtgagagcaagagagtagctttctggttgtcctggtgccctgctcaggcaaactgactgccattctctgaggatggcagctctgtcccccacatttggtaagttcttgggtcagtgcgtgccctgagaaagtgagtgcaagtggcccctgccacttgatggggtgaaagatacgtacaccatagagggctgctgggagaggatgggcaagtggaaaaggggtgggaacagagccccagcagccaccccagtgactgtgtctgctgagggtcttggtgggtctgggagcaggccagtgtccttatcattcatgcatgaagagggtgcaggtaatgggtaaccctgagttatctcatttattattttgatcactttcagcaaggtcacaactctagctctcagaacttgcatttcttcactcctaggttggaactatgtcacttcttatgagtatgtagcccaccaccctctttatgtttttggtggaacagggctgctctgacttgttatgaaactgatgtgtgcaagagaggtggggggaggaagagagagagaggattgaggatgtgaacactcagaatcagtgtggagcagtttcctggtttacaagtgttgtattatgagacagggcaggctctgattctcatgaaccctgttttctcctccagccacgtccacccaggattccacctgtctccaggactcagaatttcctgtttcttcaaaagaccattcctgtccccagaatttggacctgttcgtgtgcagtggtctggagcctcacacacccagtgttggttcccaggtgcactaagatctctgggtccctagagcaggagaggcacttcctggaagaccccaccagtgcatgctggaattcttgcagagcttcatctcagccagtggatgccagaacagggcccaagagagagccaaggaatattggggctgtcctggtgttggggaagttaggggaagtgatttatgtagcatctgtttccctcatgcttgcaaaatctcaggcccttgctcagccccagagacggggggaaataaagggcaaagctctcggagtgggctagaactggagggagattagtcccttgtcagggttgcatctgaagtgacggcacaggacaagatggcctcaatggggagagaggatgtctgaggactgatgcctggaggaaatgttgagccccgtagcaggccatctggaaatcctgtgttgggtctctcatgcccggtcttcaacctcagccatcttaccatgaacatcgttaggctggttcctcgctgaccccaagtttgtgtggcgttccaggaatcggtgactttccaagatgtcgctgtggactttaccgagaaggagtggcccttgctggattcttctcagagaaaactgtacaaagatgtaatgctggagaactacagcaacctcacttcactgggtaaggccagtgccatttctccacttattcatccatgaattagatgtttttgtttgagtatgttctgtgacccaggaactatgcagcggttcagaacgcagctgtgaacaagcagccccagcacccatgcttaatggggcctctcctgggtatcgaggcccatctattgcagggaccatggtggttctccggtgtgtgtctgagcttggcatgggcttctgaaatacgaaatccccattcttttggagggtcagtgtgtgggtacttgtgatcttatttcctatttctttttttttttttttttttttatttttggtgatgaagggttctcactatgttgcccagactgatcttgaactcctggctacaggcacgagccaccatgctttgcctgtggttttgttttctatcagtcaaaaacttttactgtgttccttagaaattttggcaccaccattttgctgctcctaagtcagacttgtccaccctcagaacactgaagacccaagtgttgagcccaggctactggaaggggttgtcctctgcatggccctccctcaacctgtgtctttcccgtgagtgtagggtatcaggtcggcaaacccagcctcatctcacacttggagcaggaggaggagccgaggacagaggagaggggcgctcaccagggcgcttgtgcaggtgagcgagccccaggcaaagagcggtgctgtgactctacctctattcagtgactggggtggagggaggtaggttagggagtgtcacccagggaaattgagagatgctccttccctctttttgcccatccattctctgacaaatcttttggtccacacactccttcatctttgactttcacattcccattattgggctctttgtcccattctttcatatttgatgtttctgatcatccgctttctgtcattatcaacatcatctgaattgccttaaatttcttttttcttttttttttttttttttttttttttttgacggagtctcactctgttgccaggctggagtgcagtggcatgatctcggctcactgcaacctctgcctcccaagtagctgggactacaggcatgatgccgccatgcctacctaattttagtattattagtagacatgggtttcaccatgttgtccaggctggtctcgaacacctgacctcaggtgatccacccacctcggcctcccagagtgctgggattacaggcgtgagccactgcaccaggcctgaattgacttaaatttctacccctggcattgccaaatatctcacatgaccagattttttaacaattgcttttgcaccacttttccttacatagccttaggatctgccaagaaatccacctgtcattgtcaccatcatcccaccattttccttttccaacaattaatacttttccaatttgtttcagattgggagactccatctaaaaccaagtggtcacttcttatggaagatatttttgggaaggaaacgcccagtggtgtgacgatggtaagatttccgtgggataattctggatcttccttccacgtctgaggagactggggcagcctaggttagaaaagcagttcaacaccagggcaagcagcttccctcagaggagactgtgtttcagagacactgggtattaccaagatggagacaaccctaaagctaacctcaagctactttacctagagtgtctctgagtgaagatttttatagctgtgtctcagatattgagtgttggggctcaatgcagtttttgttttattttatatttatgctgtacacttacttatcaatttagttttggtggtgtttattttttggggggcagacagtcttgctcttgttgcccagtgcagtgggcaacatcttggctcactgcaacctctgcctcccaggctcaagccatcctcccacctcagcctcctgagcagctgggactataggcgtgtgccaccacacttggctgatttttctattttttgcagagacaggatttcaccatgttgcccaggctggtcttgaactcctggagatccatcagcctcggtctcccaaagtgctgggattataggcttgagccaccatgcccagcctcaattcagtggtttttgtttgtttgtttttgttgttgtttttgttttttgtttttttttttgaggcacagtcttgctcttgtcacccaggctggagtgcaatggcacgatctcagctcactgcagcctccacctttcaggctcaagtgattctcctgtcccaccctcccgagtagctgggattacaggtgtgcaccaccatgcccagctaatttttgtatttttagtagagacagcgtttcaccatgttagccaggctggtctcgaactcctgacctcaggtggtccacccgccttggccttccagagtgctgggatgacaggcgtgagccaccttgcccagcctcaattcagttttaagcagtgaagaaatgctatatgcaaaaagctttgaaaaagtaacacatgtggagccttgtggcctggcattcacctattgtccttgatggagctcaaatggggcagggacagcacgtttgcacggcagatggttacagctctagtcatagtaatgtgcttctatctgttcatagcagtgtatgtggggatgacgcttagggttgcaatgaatatgagaattgcctttgtcagcacttacgtcttaaccaacaggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatgggggtctccctatgttgcctaggctagattcgaactcctgggctcaaacaatcttcctgcctcagtctcccaagtagctgagaatacaggcatgtgccaccacacccagcttgtttttctatttcatttgtttattggtgggagggggtttctacacccagctggatgctgcctggagcccatacacctggtcattggtcagttgtgtggtttttttttgtttttttttttttgtttgtttgttttttgagacagagtcttgctctgtcacccaggctggagtgcaatggcgcgatctcggctcactgcaagctctgcctcccaagttcatgccattctcctgcctcagcctcctgagtagctgggactacaggtgcccgccaccacacccggctaatatttttttgtatttttagtagagatggggtttcaccgtgtgagacaggatggtcttgatggcctgacctcatgatccgcccaccttggcctcccaaagtgctgggattacaggcgtgagccaccgcgcccggccatgttcagatgactgattagcctatcaaaggcattcttccgtttctttatggtggctttgatttctgatctttccttctgattctttgagtctctatttttctgctgatgatgtagggcagatgagcccccaaactgggggttagcccaggagggttcttggctttgctcaggaaagaattcaagaggcagccagcagtaaaagaaattgggtttattgaagcagcagggcacagcagagtggctgccccttgtggagcagggctgactcataggcagtatacccagggtagcagcatataggctgttggctagcagtatttatacccagttttaattacatgcaaattaaggggtgggctattcagacagcactcctcattcaccttccaccatgattgtgaggcctccccagccatgtggaactatgagtccattaaacctctttatgaattaggcagtctcaggtatgtctttattagcagtgtgagacacagttgctccggcctataaatgacacatagttttaagtctgtttcctgcagttctcctatgattggccagggttttgattctgttttgtttttttgcattttcaaattaagggtagatgattctgagggtcttgctccagctctgtctcaggcccccccaccagctatccctctttcttgcagtttacctaacagagccttggggtgggcatgtgtgggaccgtggtgctaagatttaatgctttttctcattttactcatagttatgttgcaattttggcattctctatgtcttaaaggcagtgttgaaggtatagttttgtgtagaagattcataggtgtggagttacttcacagcatttgaaaggggatttggggaggttgcttaccactcactggccattgtttttagttacctggaagtctcctcaccttagtttttggagatactttggctgaatatgttattttattttattttaatttattttttgagacagagtgtcgcccaggctggagtgcagtggcatgatctcagctcactacaacctccacctcccaggttcaaacgatcttgtgccttagccacctgagtagctgggattataggtttgcaccaccatgcctggcaaatttttgtatttttagtaaagttgaggttccatcacgttagccaggctggtcttgaactcctgacctcaggtgatctgcctgcctcagcctcccaaggtgctgggattacaggtgtgagccaccgcgcctggtctggatatgctttaaaggggtcatttctttgtcttctggcctccattgttgctgactaaaagttagcgttattcttaacattattcccctgtaagtaatgtaagtaatgtgttgcttgtcactggctcctcttcagataattatcttgggttttcaacagtttgactctgtgtcttggtgcagtttcctgtgcatttactctgcttggggatccttcagattcttagatacgtgagtcactgtctttcacaaggaagtatttggccattatttcttcataattttttaattgtggtaaaataaacataacatgaaattcactgggtttttttgtttgtttgtttttgttttttgaggcagagtctcgttctgttgcccaagctggagtccagtggtgcaatcttggctcactgcaacctccacatcctgggttcaagcaattctcctgcctcagcctcctgagtagctgggactataggtgcgcaccaccatgcccagctaatatttgtatttttagtagaaatggagtttcaccatgttggccaggatggtcttgatctcttgacctcatgatccacctgcctcggcctcccaaagtgctaggattacatgtgtgagccaccgcgcacagccccattttaatcattttttaggtgtactgttcggtggcattaagtacattgacaatattggctaccaccactatccattttcagatctttctcttcattccaaaaaattatgtacccattaagcaatcactcctcaacacttctatcttcagcccctggtaacttgtaggtagtgtccatgaattttgtcagaagtagaataataaaatacgttgttttgtgtgcgtctgccttatttcattaaaagtaatgttttcaaggcttatccatgttgtagcatgtatcagaatttcattcccttttatggcttaataaattctgttgcatgtatgtgtcacgttttattcattcatctattgatgaacatttgggctgtttctacctcttggctattgtgaatcatactgatattgatgatttttttttcttttttcttgagatgcagtcttgctctgttgcccaggctggagtgcagtggcgcgatctgggctcactgcaacctctgcctcctggattcaagcaattatcctgcctcagcctccaaagtagctgggtactcgccgagtagcctgccaccatgcccggctaatttttgtatttttagtagaaacggagttttaccatgttggtcaggctggtcttgaactcctgacctcaggtgatatgcccgcctcagcctcccaaagtgttgggattacaggtgtgagccactgcgcccagcctgaagacagcattcttagcatgaaggatgcaaagttgaggcaaaggagatctatccaaaccaacctcattacactacggcttctgagccacttctctacctgattaaccaccctagcccacacccttggttttatcccattagcgcagtttacttgtctgtccaattcagtttataagtgtttggctcttaactgcttttctggcttgtttccttatgaggaaccccatgccacataaaactttcattaaacaaatacatgtgtatgctttaatcttgttaacctaatcgtatgtcggtgtaattatcaggcccagcaaggatcctaagatgatgaaggtgaaatcttgttgcccctacaatatggacattggatgcaagtgtctgtgtgagttcctgctttcaattctcaggaattttccgaagttgttttcttcctcattttctccttttgggactccagctgcgccacaggactctgaagttcctgtttcatttttctaatgtgtttgttttccagtttgtatgacttctactgatatatcttaaagttcactaactcttctgtcctcttcatctgtggaatccatttagtgactccttaaaatccagatgtctgaggtccttaggaaaacaggtgcttctccctgttgtagcttgaatttgctctgaatgtggtggtcccctaagccaataacacaatgcctcctggcctgccctggccacccagggaggaatgaagggagaggtaggtgtagtggtaataagccttgctgtgcacagctttgtgtaataactgaaaagggtgatgtgttttcctgctcccatccccaagcctgatttcttcaagatgcagtaactgggacgggtgcagtggctcatgtctgtaatcccagcactttgggaggccaaggagggaggatcacgaggccaagagttcgagatcagcctgaccaacatagtgaaacctcatttctactaaaaatacaaaagttagccgggcgtggtggcgcgtgcctgtagtcccggctactgggaagctgaggcaggacaattgctcgaacccgggaggcagaggttgcagtgagccgagatcacaccactgcactccagcctgagcgaaagagtgagactcggtcaaaaaaaaaaacaaacatgtagtaactgacaccccccacacatgccctcccctccacctcctgttatttcattagaaaccctgccaaggaacaaggaaatcctacaaagaaggtgtctcaggtacccatcagcagccatgcagtgatgacaagtgggtctgatgccattaaaaggttgttttcaaaccaccttctgttgcaagcagaacccaattgcacaggaatccaagctccatgatggagctttggccattgtttttagttaccaggaaggaaaatggcaagattgagattaagcctggaggcccggcggggacctcatggctgtgaagaccctggactcctgtgttgctggagatagtgtttgtgctctcacatggtctgctcagccgtctttctgccattcagcacaacggaaggacctagtgtgtttccagggtgggagcctacgagtggtggactctgactttgacattcgggacagatttattccttaattttcttccttacatacttggttcatctgagggcctcagactccctctccaacagccttctaccctctcccatttccacattttcatttttgagcttccttagctaagtggttttactttcttccctttccatctctctctctctctttatatttctttctctagatttttaaaattctgtctctctcttttctccaatttctccatttccctcttttttttttttttttttttttttttttctttttctaagtcagggcctgactctgtcgcccaggccaagtgcaatggcatgatctcagctcactgcaacctccacttcccaggttcaagggattctcttgcctcaccctccaaagtagctgggattacaggcacacaccaccacacccaggtaattttttgcatttttagtagagacaaggcttcaccatgttggccagactgatctcgaactcctgaccgcaagtgatcctctcccattttggcctcccaaaatgctgggattacaggcgtgagccactgcgcctggccttacattgttattctgcacacattggccattgcgggcatcgttccttacctgagtgaacacatccatgcattcctaatatgtgtgtcctgggaaacctgggtttggagtttggagtttggagtagagaggccaagggtttgcagtcaggcaggttacttgcaaaatatttacgtatcagtcagatacattggctcatgcttgtaatcccagcagtttgggaggctgaggctgggggatcacatgaggtcaggagttggagaccagcctggacaacatggtgaaatcccgtctctactaaaagtacaaaaaaattagctgggcatggtggtgcatatctgtattcccagctacctgggaggctgaggcaggagaatcacgtgaaccagggaggcggaggttgcagtgagccgagattttgccactgcactccagccttggtgacacagcgagactgtgtctcaaaaaaaaacaaaaacaaaacaaaaaaaaattatatatatatatatatatatatatattatgtattgtgctaagtttcttctttgtaaaagcccttgggggactgttaagtgtgtgtctcagcttggatttgggtttttttagaccagagatccctggtccctttggaggtgtgagtatgagggtatttgtgtctcttgagaaggtctaagagttgccatcagtttggtggcagggtatgttgtacttagagatcttgtcagaatggataactcattttacctccatcacttacgaaatgacttttatcagctacattaaaatgctagcaatgtcatactacattctcataaatactgggaattaactaatgactttcttgtccaggtatttataggctttggcaaggcagcagtacacaaaactggtcccattcatagtaatcttgacgttaaactttggagccagagtacaagcgaataaataaacactaggaagaaaagtaaatgcggagaagaataaatgctgtgaggaagagtaaagttgaggaggggaacagacagatgggattgacccgttcaacctgtgcagtgtacagcgtatactcttttttttttgagatggagtctcgctctgtcgccaggctggactgcagtggcggcgatctcggctcactgcaacctctgcctcccgggttcaagcggttcgcctgtctcagcctcccagatagctgggactacaggcacctgccaccacgccctgctaatttttttgtattttagtagagacaggggcgtacactcatttttggccactttacctttttaggaaacaaaatcatcacagaaatcctcaagaggcagctttcctgtacatttcagtttctcctaaaacagaacagggctgggaatgcttactgaggaatcatcaaagcatttctttctgtcatgacaagagcaattccagcttgctccatgagaccctgcttctctcactgtatttggttttcaggttgcaagatttgaagaacacttgtcaaaactcgacggttatttctgttttcaaggactgtttgatctgcattttcttccagtccattcatttctatctggtttggcctccaaggtcttaatcttttgcccaagaaaacgcttacatttaagcaacatgagttccttgatttgtctgtagcccaatgctactttcttgagttcagaataaaagctgattattattattatttattgttattattattttgagacagagtcttgctctgtcacccaggctggagtgcaatggtacgatctcggttcagtgttacctctgcctcccaggctcaagcaattcttctgccttagcctcaggagtagctgaggttacaggtacccaccaccatgcctgacaaatttttgtatttttactagacagaattttgccatgttggccaggttggtcttgaactcctggcctcaagtgatctgcccacctcggcctcccaaagtgctgggattacaccagccttgggacttgacagtttttttttttttttttaagatggagtttcgcccttgttgcccaggctggagtgcactggcgcgatcttggctcaccataacctctgcctcccaggttcaagtgattctcctgcctcagccttcctgagtagctgggattacaggcatgtgccaccatgcccggctaattttgtatttttagtagagacggggggtctctccatgttggtcaggctggtctcgaactcccaacctcaggtgatccgcctgcctcggcctcccaaagtgctgggattacaggcgtgagccaccatgctgggcccttgacagttattttgacctaacattggtgataatttttctctacctcaaccaagaagatggcggattggagcacttttttcatagattgaccagtcttcccaacaacactggaggccagtcatttactttctgcagagaaagagacatgtcaaagagtcaacttaccagctggaaactgggactagtgtcaagtgcttactctgacattcagctcttgtttcacctcttgacccctttcatgcctgcatcaaccagtggatctgctgggctcagagcacatgacaaaggggcttgtggtgttccacttggcttcctgaaatcccttcctttcccctggcagtgcttccacgcaggactttgagtgtgtagtcggggcagtttacatccccaagtgaaaatgctgaacgttcagcaagccttggtcaaaagttttcctaggctcactagtgaagaaatagcaattactcactggctattgccaggattgagaaaaagaatgtgtaccctagaggccgggcccaaggggaagagagtactttctctcagcattgagtaaaatcggccattttttaaatgagccttgggaaccagcataactggtccctttgtgcccaatttctccatcccgataatgaattccatggataacctcagtggcccatgacagttgcctctcattgcacttccctgccagttctcagaaagaaagtgtcacacagtctctggagggaacttctaattacaggaacacagtctgcttgtctgagtcttgttttcagttcttggaccctctccagcagggaaaatctctgtcttgtgtaacctttgggtaacatccaatccactcaggaattcttccctgctagggaacctattgtatatacccaatgaatattagctaagtgccttacacttttaattaggttttgggaagaaagatcaataagacaaagtactgcccttaagaaagtaaaggtctaggagaagagcgatattaacagtaaataagacacctagtatggcaggtgaatccatttgggaggccccagatgaggaagatgttgaactgggggccatcaagaaaatctaagtagaagagatgatgcaagctcagtgtagaaggatgattatgattgtgattatgattatttggagatggagtctcgctctgttgcccaggctggagtgcagtggcgcgatctcagctcactgcaacttccgcctcccgggttcaagcggttctcctgcctcagcctcccgagtagcagggactacaggcacacgctgccatgcctggctaattttttgtattttagtagagacaggttttaccgtgttctcaggccagtctcaaactcctgagctcaggcaatctgcccacctcggcctcccaaagtgctaggattacaggcatgagccaccgaggcctgccttgtagaaggctcattaagagttcaggagcagaatcaaataagcatgctaatcctgagtgcaaaggcactgaaaaaatgacagtatattacattctgtagataaaagacaatctttggagtaagaggcagacttgaaaggtaatatgggacagattggagaacacacacatttcctttattctctctctttttttaaagactcggtctcattctgtcacccagattggagtgcagtggcatgaccatagctttctgcagcctcaacctcctgggtttaagccatctgccaacctcagcctcttaagtacctggactataggcacacactaccatgcctgactaattctattttttttatttttgtagagacacagtcttgttatgttgcccaggctagtctcaaactcctgggctcaagcaatcctcctgcctcagcctaccaaagtgctgggattacagtcatgagccactgtgcctggctcacacacatatatctatatgttagtctactagtttcaatgtaaatgttagttggaaatcgatggaaacaaattgatattcaatgaagtttgcagttgagcaaggtaactggttcccagttgcggaatggaatgaagggtcctgtttctatgagcttttgtttcatagccacccaaaacatggtggtttaaagcaaccaccaggccgggctcagtgtctcataatcccagcagtttgggggccaggcaggaggattacttgagtccaggagttcaagaccagcctgggcaacatggtgaacccccgtctctcaaacaacaacaccccaccaccttttatttagggtttgtttgttgacaatttgggctgtgcttagcctgagagttctcttgactggcttctgcagtcactgtctaggtgg

SEQ ID NO: 213 - DNA, 79246 bp, Homo sapiens
taacatcaaccattcaattttccccattcactggaatgactactattccatatccacaacaagagctgttgggttgagggaaatcagggtggagatgaagcaaaagtgaagagaaaacattatctaacccacgcatgcagcaaaacaacctccctatggatcaatatgtaattatctaaagtataaaatacttagaaaatattaatatttatctcatactatacaatatggaaattataaggaaaagacaaaagaatacccaattacttatatattccctacataaaaatatatacatttatatggtaaaagattgcattatcgcagtgtaaaatgaaaataggaaaacatataacaatatgtaaaacaagtgacaatatgtatgttagatttaatatcctatagtaaaacagggtaaattaaaactataaaatagaagaaaatttaaatccaagtaaatcatatgagccaaaaactaaataaactaaataaatataatcaataagcatttaatacatcttgactcagtttagatataaaagaaagaaaaatcaaacaataacatggtggttttgccatgatgtcatcaagcgtaaaaagataacctttctcaatagagatgcgtctcaggtttgtgggtctgagtccctcatggactgcaggtgagagagtgaagagacacagccttttctcaattaaagtagaaggatataaatatatatatttatttttgctatactttataatatacaaacacatatggatgattacaccctaatatttgctgtgattctacagaaatgcatgactctcaggagacatccaaaagacagcaaatatctcacacgaaactgaatagtgaacttcatcctcaatgaaccacagagttcaccattctgagtatatcgttcaagttattttcctattttccttccgcaggttctagcatgtattaacaccgtgtgtctaaagtcatccctgctggtcatctggaggaatctgagaaggggcaggtctttcttctgactctcagagcagcaccctctgctggacagggctgggcacctcatctcaagcccaatctgatccaccaacagggtctgttatctccggtccggggaagaggtgggcctctctccatcctgggaggagcgctgagcttctccttcatccagggatgggccccagggacgcgccagtgggactgggagaagccaccctcagcagggaagacagagatgcctgcgtggccgaggcctggaaggtctgcaccatggtgcacagaggccccggagctgggtgaggccagaaagctgctctggggtcagcggggaatgtgcctgctgaatctgcaagcacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatgggtctgcgtgatgtggctgctgtgcccacatcagagggtttttgtttcttttccaaagtcaagctgcactaatctagaccagggatccccacccctgggctgcggaccggtccccatgggtggcctgttaggaactggaccgcacatcaggaggtgagcagtgggtgagggcgcatgaccacctgagctctgcctcctgtgagatcagcagcgccactgcatctcagaggagtgccaaccctactgtgaactgtgcatgcgaaggatctgggttgcatgctctttatgagatcaaactaatgcctgatgatctcaggtggaacagtttaatcctgaaaccatccccccgtctgtggaaaaactgccttccaccaaaccagtccctggtgccaaaaacgctgggaaccgctaatctagacagttctctgctaaggaagcacatggttgagaagcatcagaatcgttcccacggaccatgctccggagtctcagcaggctcctgcaggtgagccccactggcctctcctcttccttctggacctcctcagctttggtaatggaaagctgcatcctcttctgtccccagttcctctctgggtgtcaggatctctaaaaccctctcagccgctgagaaatctgtctgtctgtctcacagtgtgtttatccgtgcatcatgaaggaccctcatacggctgacgtgccttggctgatgcgaataacactgcagcaagcgtgggagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggcaactccatgttttttagaatttttaaaaatataattgctctaccaattgactgtcccaacaacaacgtacaggggtattttttttcctccgcatcctcaccacttgttaccttttgtctttttaataatagcaatcctaagacatgtgaagtgatacctcactgtgattttgattggcattttccagatgattagtctattcaggccctttactttttttcgttgttgttgttgtttttgagatggattctcactctgttgcccaggctggagtgcgatggcacgatctcggctcactgcaacctccgccttccggggaggcgtgattagccgccacacctggctaatttttgtactttagtagagatgaggtttcaccatgttggccaggctggtctcaaactcctgacctcaggtgatccactatgcttggccttccaaagtgctgggattacaggtgtgagccaccacgcccagcccctttgctcatctttaatagggttattactattatcatatttgcttttgagttgtgggtgttccttatatattttggatataaactccttatcacgcatagggtatatatggtttaacatattttctcccattatcatgccccaatatcactaagttatatttcacagctccctcttgaacacctgaaaaaattcctaatatatttccatgtgtctgtatccaggttattgtggtttttgcctgaaaacacatttatatatgctgatattccccaataactaatatattttttctctgtttttttttgagacggagtcctgctctgttgcccaggctggagtgcagtggcacgatctcagctcactataacctctgcctcccaggttcaagtgattctcatgcctcagcctcccgagttgctgggattacagacacatgccaccacacccggcaaatttttttgtatttttagtagagacggggtttcaccatatcggtcaggctggtctcaaactcctgacctcaggtgatccacccgccttggcctcccgaagtactgggattacaggcgtgagccaccgcgcctagccctaactaatatattttaaataactttttgctcttggcacatggactaaaaccacatcactaggccttcaatgacgtccaatgtctgccatcttatttccactccagctccgccccaggcatagttgcttttctttttattgaagccttctccttttttttttttttttgagacagagtttcacactgtcgcccaggctggagtgcagtggcgcgatctcggctcgctgcaagctccgcctcccgggttcacgccatcctcctgcctcagcctcccgagtagctgggactacagaagcccgccaccacgcccggctaattttttgtatttttagtagagatggggtttcaccatgttagccaggatggtcttgatctcctgacctcctgattcacccgcttcggcctcccaaagtgctggattacaggcgggagccatggtgccccgccaaagccttctccttgccaagttaattaaagagaatgttttcttcatcaaattagaaattacatcctcagagaagctttccagtatttgtagttcttacaggccacatttattacaagtttatagactccaaacttcttcactgaacagttaataaaaaggacacaggcttattgtaaaataattcatttagtgcctgccattctgattacactagaaatttagttctcctgctccgcgttctgttatgtgactgttcaatgcattacttaaaactgcaagattgaatagagagatcagcttctaacattgatgaatgcaaaccacaagaaaccaagtctcctctgcaaaatgatgaaaacactcgcaaagtcactaaaatcaatcatttcagacttctgaaatttaccaaagccacagaacaaagtgaaaagtatctatcccacagaaagtaccaaacttcagtaagacagcagcatttgtgtcattttaacatgggcatttctgtcaccctccatccttcgttcattgtggagcactgactttgtttggttggttgtttgtttttgagacggagtttcgttcttgttgcccaggctggagtgcaatggcgcgatctcggctcattgcaacctccgcctgctgggttcaagcaattctcctgcctcagcctcctgagtagctgggattacaggcatgtgccaccacgcccggctaattttgtatttttagtagagacggggtttctctgtgttggtcaggctggtctcaaactcccgacctcaggtgatccgccttcctcggcctcccaaagtactgggattacaggcatgagccactgtgcctggctgccctgacttctttcgaagctccttttaaaccctttctgtctccatcttcatgttcaccacagtattatttgctatggccaagacacggaaacaacctaaatttccttcaaaggacaaatgggtaaagaaaatgtgatatatacacattaaaatattattcagccatgaaaacacagaaattctgccatttatgacaacaagaaaaaagctggtagatgttatgccaagagaaataaggaagacacagaaagagaaatattgcatgatattcatttcttcatttctggggaggcctcagaaacgaggtccttactaagatgtggcaggctagttttgtattttagactgctcattaaaatatgtatttattgggccgggcgtggtggctcacacccataacgccagcactttgggaggccgaggtgggcggatcgcctgaggtcaggagttcgagaccagcctggctaacatggtgaaacgctgtctctactaaaaatacaaaaattagctgggcatggggtgcgtgcctttaatcccagctactcaggaggctgaggcaggagaatcatttgaacccagcaggcagaggttgcagtgagccgagatgggccactgcactctggcctggacaacagaacgagactccatctcaaaaaaaaaaaaaaaaagtattaattgcctatggttttaaaaaatgcaagtagtttctgaaggataaactgaagactcttaaacagagcacttctgttttctgagtcaacctttcttgttcagagaatgaaaagatccaggatgcctcacctaacacccaggagggtccctgacttcctgattctaggccctaaacctatgtccaagagaaaagttacatctgtagtccagagctttttaaatatagttatccaggcccctaaacagcacaagaaaatggaagctaactccttacaacttgtgaaagagacaaagtagctgctgcttttttgttgcttattttggattaattaaagtgacatcttttttattctactttcttatttaaaaattaaaaaacaggttgtgttgacttacacacttctccataaaaatacaatatattgattcaatatgaaatgtctactttagtgccagataaattgagaatttgtataccaaattttaacaaatttgatgttctcaaaagaaacagcattattcactttgtttcagatgagactgggcttatgttcacaagtacacactcacagagatctaattccacaggcacacgtggtagagtaggctaagatcatcatggacagtaatgacttgcaatgccatttgacaaatcccccaacagagctctgtaaaaccactagaaaacgcgcacaacagcacaaccatcaaaatgaaaacacctgatgtacagagttgtatagtagttgtatagttagtagttgtatggagcacccttgacataagtaactccatcttagaaaaagactccatcttacatttcatggggcactttgccaacagggacaagatgttttgcttagtaaataaataataaggactgcatccaagcagataaggacataaacaagcacattcttccactatcagtcctccccacaggactctggccataaaagaagctgggcttcagcagctcaaaacggccatcttaactgccaaccatcctgctgtcatttgtgataagcacttgacatctgctgccaaagtttctacccacatcaaagattcttctttgcaagatcaacagacaactcagcccagaccaggagactgtttatgtcttcattactctccccacgcaggttcaagtctgctgagatttggtttatctctgatttattagggagaattggctcacacgatcacaaggcaaagtcccatgataacccatctgcaagctgaggaagaaagaagccagtagtggctcagtccaagtccagaagcctcagaagcaaggaagccaacagtgcagccttcagcctgtggccaaaggcccgagagcccccagcaaaccaccagtggtccagagataaccaggtccacacacgtttgtatctttccacagtgtcaggctttgattgatgctatttcaatcacaaaagccatgagccgcctggagttcccaaagaggcttgtgatggttaatattaagtgtcaacttgattggattgaaggaagcctaggcagctggtaaaggattgtttctgggtgtatctgtgagggtgttgccagaggagactgatgtttgagtcagtggatggagagaggaagacccaccctcgatgtaggtggacaccatgcaattggctgccagctcaggtagaacacagaaggcagaagaaggtgggatacctttgcttgctgagtcttctggctttcatctttctcccgtgctggatgcttccttctgcttctcctgcccttggacatcagattccaggttctttggtctttggactcttagacttacactggtggtttgccgggggccctgtggcctctggccacaggctgacgactgcacagttggcttccttgcttctgaggcttttggacttgaactgagccactactggcttcttttttcctcagcttgcagatggcctatcatgggactgggccttgtgatcgtctaagccaattctccctaataaacttcctttcctatagacatatatcctattagttctgtctctctggagaaccctgactaatacaaggcaattctctttggtactgccccttcacttggtagtcagagccatagacacgcaggctcaagccacttcacaagtcagtcaatattgcaaaccatacatagtagtgtacttaatcaatatatataaatgttatagattaaacatttcacaataaacaaagtaatgtttaacatcaagagaaaagagataggagaaaagggttaacaagtcagtccaaggagagtaacaaaacccttggtcagggctgggcaggcccattggtcttgcaagaagtctttgaggcttcagcagcagatgccaagtgctcatcacaaatgacagcaggacggttgcagttaagatggttatttcaagccactgaagccttgctccttttatggccacagagtcctctggggaggacagatggtggaagaatgtgcttgtttatatccttatctggttggatgcagtctttattatttatttattaagcaaaacatcttgtccctgttggcaaagtgccctgtggaatgcaagatggagtctttttctaagatggagttacttatgtcaagggtactctatacagtagtcttacccacacgttcatagaaacatacaatctcatccatgtcataatgaaggccaaaaacctcacaggcgccctcccttacctgagctccaggaggctccctgatgagtccacacaatcacaaatccagtcacacccaccaatgattctctcccaacaacagcatatattttttagggcaaagcatctcacaccccagtgtttgtctaaattgcaccatttcggaagccccctgctcttttgcagaccttggtcaaagtgaaacatttcacaggggttcaggcagtgagaaatatcctgcctaaccacctgaccacaaggcgaacaaagacccaattaaagaaacattctcatcatgtcctactgggcaaaggcccaactacaaaaaccatccctatcatatctttcttggcaaaggtccaaggaacatcctgatgagatcccaccggaaaaagggccaaaccgcctgatcataagaacatcttgtcaatatcctgccgggcagcaagccatacagcccaggcctctcccgcccataccaaggtaacactcacagagacatctgaagagccaggcagtgctcccaagtctgggacagcatcagagaacgaaacgcaaagtcctgcccttacagagagagccttggcacagacccagtcaggaccaggtcactcccgtggaacctactcaaggtccctacacacatgcctggagctccccaatctactggggggtgggggaaagggcagtgctgaaacgtccccaaaatctcacatgtaaacaccctacctaacactttctagaggcatttccagctcggggctgtatttccaagaacgctctggaggcacagctcttttctaaggagggccatgttgcatgctgggaaatttttgaacttttcccaaatcacagcttttaagctttccgggcttattattattattattattattttgagacattgtttcactcttatcgcccaggctggagtgcagtggtgtgatctcggctcactgcaacctctgcctcctgggttcaagcgattctcttccctcagcctcccaagtagctgggattacaggcacacaccaccacgcctggctaatttttgcatttttagagcgatggggtttcaccatgttgggcaggagggtctcgaactcctgatctcaggtgatatacccgcctcggcctcccaaagtgctgagattacaggcgtgatttctggtcgtttcagactacatttccttcccagaaggacgcggggacacgccttccctatggacggatcccaaatgcaagttgtaagcaattataactgtaggcccctagagcctgaaccacttttcccaggaattttttgtggtgcgccttaggagcaagcaaagtttcagggcaggagaaggccgacagggcttccagcatttgaagattctgccagtctgaaatacgctttcccagaagtctatggggggtgcagctgctctaacagtgggaggagacaccgacgaaaagcattctgacggccgcgcttccagcgctaaggattcccgcgtagtgagcatttcccagaggtctctggggcatggctccattagggccgtgtgcagttgcctgcagggaaacactgatgggcgcccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagaggtacctgacatgggaggcggggaggtggtgagaggggcagctccatgtttcagaaccccagttcctagagttttccagcatttctctgaaaaactcacatgcctgtgccctcttatttctgattgattttaactgtggtctggggacaagtgtgccctattttctttctttgttttttttttttttgagacagagtcttgctctgtcgcccagggctggagtgcagtggtgcgatctcggttcccaggttcaagcgattctcctgcctcagcctcccaagtagctgggaccacaggcgcacgccaccatgcccagctaatttttgtatttttagtagagacgggatttcaccatgttggcataggtgatctcgatctcttgacttcatgatccgcccccgtcggcttcccaaagttctgggattacagttgtgagccaccgcgcctggacgtgtgcgctattttctaacgtagcttgtgatccagaaaggtcctggtgcctcattcttatcttccttttcccctccggccagctggccttcaggaaaagcatcccggaggaggaagaagaagtgttatatgtcctaaagtaaggtttcaggtgagttagctttttgttcattcaatgatttgtatttatacaacttaagactatttactttccttgggcccatttcttcccaaatagtcatttatcccactaattcctccccaagggatgtgacagggcggtgcaggtcattcctccgtgtatactccattgacctaccctcttctaaaatgtctaaaaattgtctaagaatctgatggtacagaagagattaattctaacactttatattacagtgtggtttggtaaggaagggatttatttttgggtggaaggaaacaccagatatctttggtcttttgtttattttttattattgtagttattttttaacatggttaattttttaaatttttatataattggcaaatgacaaattgtatttattgtgtatatgtttttatatatatgtatacattatgagatgattaaatcaggctgatgaacatatccatcacctcactaattattatttttgtcatgaggacatttaaactctactctcttagcaattttcaaatatactatattttttttttattttttttttcttttgcccttgtcccccaggctggagtgcaatggcatgatctcagctcactggaacctctgcgtcctgggttgcagcgattctcctgcctcagcctcccaagtagctggaattataggcacccaccaccatgcctggctaatttttgtatttttagtagagacggggtttcatcatgttggccaggctggtctcaaactcctgatttcaagttatctgcccgcctcagcctcccaaagtcctgggattacaggtgtgagccaccatgccctgcctttgtcccaatttttaatcaaatttttttttcacactcttgagttgtgtgagtttcttatatatcgtgaatattaactgcttgtcagatgtatggtttgcaaatatttccttctactccataggttctgtcttcactctgttgattgctctgctgtgcataagttttttaatgatgcaattcatttgtctgttagccaccatgcccagccttgatttctttttcaaatagttgttagtctatagggatactattttttttttatactttaagttctagggtacatgtgcacaatatgcaggtttaatccataggtatacatgtgccatgttgttttgctgcacccatcaactcgtcatttgcattaggtatttctcctaatgctatccctcccccagccccccaactccgacgggccctggtgtgtgatattcaccaccctgtgtccaattgatctcattgttcagttcccacctatgagtgagaacatgcggtgtttggttttctgtccttgtgatagtttgctcagaatgatggtttccagcttcttccatgtccctgcaaagggcatgaactcatccttttttatggctgcatagtaatccatggtgtatatgtgccacattttcttaatccagtctgtcattgatggacatttgggttggttccaagtctttgctattgtgaatagtgccacagtaaacatatgtgtgaatgtgtctttatagtaccatgatttataatcttttgggtatatacccagttatgggattgctgggtcaaatggtatttctagttctagattcttgaggaatcgccacactgtcttccacaatggttgaactaatttacactcccaccaacagtgtaaaagtgttcctgtttctccacatcctctctagcatctgttgtttcctgactttttaatgattgccattctaactggtgtgagatggtatctcattgtggttttgatttgcatttctctgatgaccagtgatgatgagcattttttcatgtgtctgttggctgcatagatgtcttcttttgagaagtgtctgttcatatccttggcccactttttgatggggttttttgtttttttcttgtaaatttgtttgagttctttgtagattctggatattagccctttgtgagataggtagattgcaaaaattttctcccattctgtaggttgtctgttccttctgatagtagtttcttttgctgttcagaagctctttagtttaattagatcccatttgtctattttggcttttggtgccattgcttttggtgttttagtcctgaagtccttgcccatgcctgtgtcctgaatggtattgcctaggttttcttctagggtttttatggttttaggtctaatatttaagtctttaatccatcttgaattaatttttatataagatgtaaggaagggatccagtttcagctttctacatatggctagccagttttcccagcaccatttattaaaaacggaatcctttccccatttcttgtttttgtcaggtttgtcaaagatcagatggttgtagatgtgtggtgttatttctgaggcctctgttctgttccattggtctatatctctgttttggtaccattaccatgctgttttggttactgtagccttgtagtatagtttgaagtcaggtagtgtgatgcctccagctttgttctttttgcctaggattgtcttagcaatgcgggctcttttttggttccatatgaactttaaagtagttttttccaattctgtgaagaaagtcattggtagcttgatggggatggcattgaatctataaattaccttgggcggtatggccattttcacgatattgattcttcctgtccatgatcatggaattccatttgtttcctcttttattttgttgagcagtggtttgtagttctccttgaagaggtccttcacatcccttgtaaattggattcctaggtattttattttctttgtagcaattgtgaatgggagttcactcatgatttggctctctgtttgtctgttattggtgtataggaatgcttgtgacttttgcacattgattttgtaagggatactattgattttttaatgttgacgttgcatactacaactttactgaattcatttattatttctagtcattttttgatggagcttttagggttttttatatgtataagatcatgtcatctgcaaacaggaacagtataacttcttcacttcctatttgattggcttttctttttgttgcctaattgctctgcctaaggcttctagtactacattgattagaagtggtaagagtgggaatcctcgtcttgttcctgatatttcaacttttcaccattgattatgatgttagctatgtgcttgtgttatatcacctatattatattgaggtacattcctcaatacctaatctgttgagagtttttgttaggaaagcctgttgaattttgtcagatgctttttctggatctattgtgatgatcatatggattttatccttcattctgttaatgtgctatatcagatttatagatttgtatatgttgaaccatccttgcattcctgggataaatcccgcttgatcatgttgaatgatcctttttatatgctactgagttcagtttgctagtatcttgctgaggatttttgcttttaggtttatcaaaggtactggccggtgatttttcttgtcttgcagtgtccttgttgggtttggtcatgctgttcttataaaatgggcttggagatagtcccttctcttggattttctggaagagtttgagaagcattgtattaggtcttcgaatgtttggtagaattcagcagtgagggcatcaggttctggtctttcatgggagatatttattgcttattcaacctccttacctgttgttagtgtgttcagattttgtatttcttcatgattcaatcttgatagattatatattactaggaatttattcatttcttctacattattcaattttttggcgtagaaattttttttttcttttttttttgagacggagtctcgccctgtcaccaggctggagtgcagtggtgcgatcttggctcactgcaagctccgcctcccaggttcacgccattctcctgcctcagcttcccgagtagctgggactacaggcgcctgtcactgtgcctggctagttgtttgtattattagtagagacggggtttcaccatattagccaggatggtctcgatctcctgacctcgtgatccgcccacctcggcctcccaaagtgctgggattacaggcgtgagccaccgcgcctggcccgggaactaattttttttataccaggcctgcattgattgcattataagaaatataacttgctgggcgcagtgcctcatgcttgtaatccagcactttaggaggccaaggcaggcggatcacgaggtcaggagtttgagaccagcctgaccaacatggtgaaaccccgtctctactaaaaatacaaaaattagccaggcatggtggcatgtgcctgtaatcccagctacccaggaggctgacacaggagaatcacttgaacccgggagttggaggttgcagtgagagccgagattgtgcctgggtgacagagcgagactccatcttaaaaaataaaaaaaaggaaatataacttaaggaagtcctgaatttaaaaaaatgattactcaaggtaaaaaaatcagagttatgaaggtgctggtaccttgtagttattaataaatgtttgaatggataggcttgtgggaagcataacaagtgtatctcaaaaatgtccacaccctaattcatgaatgcaggaatatgtgatgttgcacggcaagggaaatttcagttgtagatggactgaagttattaatcagctaaccttaagatagggagattatcctgaattgtgccagtgggcccaatgtaatcacagggtattagaagtagatgaggggtgccagaagaagagaaagaggtgaggatttactgttaactgtatttactgttaacattttgttaacaggtatgtgtcctgtctcccactcccccactaaacacgtgtgtatgtttgtttctggaacattaaatcctgctaattgatcatgtagatgagttaaagactcttcaaatcttagtttgtgaaagaaatccaacccagccatgggtcacattacatttgtgtacatgtggagaagagagaggcaggccagttatctttctcttgctttgaaaggcttcacgtttacaccttatagaattagagatacgccatttcaaactaatcccatgacagcagattatcaagaaagcctttcagaattagattttctatgattttaatgtttctttgacagagaatgataatcagtgatatctgatgccttccaaatatacacaagtaacatttccatgattatatgtacaagtaacaaatccaaggtatatgaaatccaaatatatgaaatgactaagatggcaacaatttgaaataattacacgaatctcccatatcacatagaacacatgattcagtctcttgctaatattcttgatttggtatctcttctcagattagattctttaaacttgatttctgatgcagaatcatgtctctatttccctagttgctggtaaagagggaacattttcttacgtgtcttagaatcgtttttgctaattctgctgattcaaataaattcatgcttaacatcaggcttggaaagttatttttagttagcattcatgatattgatagctgattgagaagcacatattttagcataagaaaacagcagcctcatgtttcttttctaaaaatggattaagggatatgtaatgtcagtgatctttaataaaaacagctaacttatgtaaagtaattgttatgtattactatgttttatgtagattatcttacttgataattgagatagccatatctcatggtatttatattccagtttcaccagtgaggaaaaagacactgcgaggttagtaactgtcagagttcagaatcacaccctgaaagttgtactgcagagcctgtgttcttaatttctccaaagtacctctgcccaaattacatgtacctttttaaatctactttcttcatttggtaatacatcataaatgctttctcaattatatggatcagtatcactagtaaatgtattttatgtcatgatatagcagatcataatttatttaatctgtcctctactgtcagatatttctttttttttttctgagacagagtctcgctctgttgcccaggctggagtgcagtggcgcaatcagagcccactgcagcctccgcctcccaggtttgagcgattctcctgcctcagcctcccgagtagctgggactacagctgcctgtccccacgcctggatgatttttttgtatttttagtagagacgaggtttcacaatgttggccaggctgctctcaaacaactgacctcaggtgatccgcccaccttggcctcccaaggtgctgggattacaggcatgagccaccgcacccaacctatttttttgatttttttaaaattattctctgaaggctgggcgtggtggctcacgcctataatcccagcgctttgggagctgaggcgggtggatcacgaggtcaggagatcgagaccatcctggctaacacggtgaaaccccgtctctactaaaaatacaaaaattagccgggcgtggtggtaggcgcatgtagtcgcagctactcaggaggctgaggcaggagaatggcgtgaacccgggaggtggagcttgcagtgagccgagatcatgccactgcactccagcctgggcgacagagcaagactctgtcttttaaaaaaaaaaaaaaaattattctctggagaagtggaataatatcaattgattgcatcaatgacagtgtcctagttgtggtattacactgtagttcaatcatcattggtataaatcaggtaaaaggtaaacaggatctctctcgctgtattgtttcttacaactgcatgtgaatctttatctccattctaaagaaaattcacagagaaaaaattccctgaatattcttgcacaaacaattgtgtatgactatagctgtgtccttcagataaattttgaaaaccagtattttgagtcaaaatcaagacttgttaagtgtctgcagtacgccaaactctgtgatattagcacgaagaatgagagaataactaaaaggacacagctgctacctgtatgttgtctataacccagcaaggaggggaaactgagtagaagcagctcagggcagcctgtgatcacggactgtggggaattccaggtgatgtaccttgagaggtgctaggaagggaacatcattctgacagcacccgctcgggtaggccattcttgcattgctatcaagaaatccctgagactgggtcatttataaagattatattggctcatgcttctgaaggctgaaaaggaagcatggtatcgacatctggcatccacttggcttctagggaggcctcaggagcttttactccactttacttggaaggtgaagtgggagcaggcacgtcacatggcaaaaggaggggtaaggttgggacacagcgctggcgggaggtgcgggggatgccatgtacttttaaatgaccagattttgcaagaactcactcaccatggccaagacatgagggatctgcctccataacccaaacacctcccaccaggccgcacctccagcactggggatgacagttcacctcccaccaggccccacctccagcactggggatgacagttcacctcccaccaggccccacctccagcactggggatgacagttcaactggagatttagacggggcaagtattcaagccataccgcccacggatgtcgatttataaccaaataattctgaattcacaggttccatgtgtaggtaaatacaatttgttttataacttgtatttttctaataatgtttgatgcaaagggaagaccaatagggtaaggcgaattaatgcttgtctgctgggccatcatggcttgaaggacaagttcagaggtaaaattcacactcccctcagacgtaaaaggaagcagcctcaaaacaactgtcggtatgtacagggcatcacttggcattttggccatttttccagtcagtgctccagcacatgtggaaatatgtgtctgtgtgtgcatgtacattggcatccgcaggggtaaccgggacctgatgtgtgagtagaagacgcacttgcgtgggcgtgtgtggggttgatgtgccagctctgtccccataattgtgacaggtgtgcgagtatcttgggggcaatgggacccatgcagggtgaccatccttacagagggaggtcagctacacagtctataaccccagttaatacaatgtagaccccaggaatctctgaaacactctgatcccagtgccctctgacttctgattgtcatagatatggcctgagggcagctgtgccttatgaggtattttctaatgtaggctgcgcacctagaaagaccctagcttctcagtcttatcctcctctttcccctaaaccaacattcttacgaaaaagcacgccttgagaggaggaatcatttacccatcttaaaatcaaggttcaagtgagttacgttttattcattaaatgattagcgtttataagacaggactatttactttccttgcccctaaatattctcactataacaacttatcccggtcatcctttccaaagaggtgttgggggttcatacagggatatccctcaatgtactccccattgaccaagtctctcttctgaatgttattcatgtgcctctttggcaaactgtgtagctttttctgtgtgctctgctcttctaagaatctgatgatatagaaaaatatacctcctggagcttaacattagtgcgtgatattagaatgtggtttgctaaggaaaagattcgtttttaagtggaatcaaacaccacctatctttagtcttttccctaagcctgattttcatatcacagccagaaagtagatcgtttgagtacgtgacaaggttgtcagctttgtgaggcttttaagagtggagtttgagcaaacttctgtgtcatcaaaggcataaatgttttccaagtaatcaataaattgaaattttttctgtttactagattttctttgaagctgacagcctcagagttgtttttttccacttgctttgtgtgcacagtgagaagcaatgtggtttgattttgagtatgagttctggatctaggacagagttggcaaatttttttctgtaaaacgttcagcagtaaagggatttatgggccacatatagttctgtatttttcttctttttatttatttattcggattattgttgttttgtttattaaaatgacatcctttattttttatttttatttgataaataacaaattatgtgcttattatgtacaacattatgttttgatatgtgtgtgcattatggagtgatgaaaccaaagtgaataacatacccttcaccttactagttatcatttttgtgattagaacatttaacatctctcagcaattttcaaatatacattgttattcattatagtcaccaggttataaaatagatacgcagaatttattcctcctctctagcctttgtagccattcatctccctattcccacccctgtcccagcctctggtaaccatcattccactctttgcttctatgagttcagctttttgacacttaaataggtgagataatgcaggtggacctttctatgcctggcttatttcacttaatatgatgtcctctaggttcacccatgttatcacaaatgactggattttcctggtttttaaggcgaatagtatttaattgtgatatatgccacattttctttacccattcctctacagattaacatgtaggttgatttttttttgtttccccctggggtattgtgaataatactgcagcaacttgggagcattccttcctctacaactttttggaagagtttcagaagaatattttgtgaatatttggtagaatacagcaatgaagccatcatcaagtcctgggctgttctttgatcagaaattctgtattatttgttcaatctttttactcattactgatgtgttcagatttttctgtttattcatgattccatcttggtaggttgtgtgtttctaggaattaatcttctaggttatccaacttttttggcatctaattgttcattgtagtctctcacgattctttgtatttctgtggtatgagttgtaatgtctccattttcatttctgattttattgatttttgagtcttcccttttttgtctttgaaagtctcatggtttttcaatgttgtttatcttttcaaaaaatcaactcttagtttcattaatcttcccatattgtttatttagtctccatttatttttattccgacttttattattcctttcattactatgagtgtcatttgttctttttcgagttccttgagaagtaatgtttgtttaaggtctttctcctttcttaatgtaggtgtttattgctataaacttccctcttagaactgcttttcctgcgtttctcaagatttggtatgttgtttccttttgcatttatttcaaaatatttttaaattaaacttttaacttcttccttgacctactggtacttatcatgttgtttaatttccacatatttgtgaatttacctaaattcctcctgttattgatttctagcttaataccactgtggttgaaaagatgcttgataggatttcagttgccttaaatttcttaagacctgttatttggcctaatatgttatctgtcctggagaatctttcatgtgtgctggagaagaatatgtattctgctgctgttgggagggatgctctgtatacatctgataagtccatttggtctaaagtaaaattcaattccagtgtttccttattgattttctgctgaataagttgtcctttgtcgaaagtaggatttgaagtccccttcaattattgtattgcagtctgtttgtcccttcagatcttataatgtgtgctttatatatttacacgatccaatgttgggtacatacatatgtacaattgatacatcttcttcatgaattgatccctttataattctataatgactttctttctcttcttatagtttttgacttaaattctattttgtctgatatacgtacagttgacccttgaacaacatggagctggggcgacaactcaccatgcagtcaaaactccacatttaacttttgactccctaaaaatgtaatagcctactgttgaatggaagccttattgattacataaagtagattaacacaaatatagaatggtatatgtgttatatgcaatactcctacaataaagtaagctagagaaaagaaaatgttattaggaaaatatgccaggcatggtggctcatgcctgtaatagcagctgttatagcagccaaaacggactaagacaactgtattgctgagacacagtgaaaggtcattcaagatcagggggtgacatcttaagtcctagaagtcaaaagtctaaagtgggtctcactgggctaaaaccaacatgttgaagactgtgttgctttttggaggctctaggaggcattctctttcatggcctttcccagcttctagaggctgcccagattagctcatgaccccatcctactttttttttttgatacagagtctcactctgttgcctgggctggagtgcagtggcaccatctcagctcactgcaaactccacctcccagattcaagcgattcttctgcctcagcatcctgagtagctgggattacaggcatgcaccaccacactcggctaatttttgtatttttttagtagatggggtttcaccagttggccaggctggtctcgaactcttgacctcaagtgatccgcccacctcggcctcccaaatgctgggattacaggtgtgagccactgcgtccagccctatcctacacctttaaacccagaaaagacaagtcaagttcttcttgtatcacctcattccccacctgtttctgtcatcacatgtttctcttcttcagaactccctcacctacttttaaggaactttgtaattgcaccaggcccacctagataattcagggtaatctccgtatctgaagggtggctggttagcaatttaagtccatctgcaaccttctttatcttgccttgtaacataacatattcccaggttccagatgtaggatgtggatatattctgccagtaacaggcctgtccatcaaactttcctgaatagctagaatgtacccactcccctataacaatggtctgttttccttactaatctttttttaaatttggggctccctataattatatactttataatgggattaatgaaagcctgtaaccaaaaaaaaaaaaaaaaaaaaattattcccctaagaagcacacaaagaggaaactaaaaattacccttatttatttatttatctatttatttattaagacagagtcttgcttttgttgcccaggctggagtgcaatggtacaagctcggctcactgcaacctctgcctcccgggttcaagagatctgcctcagcctcctgagtagctgggattacaggtgtctgccacacattcagctaatttttgtatttttagtagagatggggtttcgccatgttggccaaggctggtctcgaactcctggcctccagtgatccacctgccttggcctctcaaagtgctggggttacaggtgtaagccactgtccggccgtaattacccatatttataccatctaaagataattactgttaacacttagtatgtatgtttactgtcttcccctccacctctaagcatgtgtgtgttttgtttctggaacattgaatcctattaatcatgtaaatgaggcaaaaactctccaaatcatagtttgtaaaagaaatccagcccaaccacgggtcacattatgtctgtgtgcatgtggagagaagagagataccagtcatgtttccttgctttgaaaaattaatcattgatgaatatgaaaatagtcactggataccttacaaatatggactttggaaatattcccaaggttatatgtgcaagtaacgaatattgactgtaacatttcaaaggtatatgaaatagaatgagatagcactagtttaaaatgttcactttttttttttttttcttttttgagatgaagtcttactctgtcacccaggctggagtgcagtggcgcaatcttggctcactacaacctctgcctcccaggttcaagcgaatctcctgactcagcctcctgagaaactgagattacaatctcaccaccatgcccggctaatttttgtattttcagtagagacagggtttcaccatgttgcccaggttggtcttgaacttctgacctcaagtgatccgctcaccttggcttcccaaagtgctgggattacaggtgtgagccactgcacctagctgataagaatctttaaactagattttttaaggaactatcatgtctctgtctccctagttaaaaggaaatagcagacttgttacttttatgaaaatggattgagatatgttactgattttttagtaataacagctaccttatcttaattgttatatatgactgtgtgtttcatgtggatgatcctgttcaaacagtcatacattgtactatctttcttgtggttttaccagtgaggaaactttaccacactgtgaagttaataactatcagagctcagattaacaccctcaaatcagaccacagagcctgtgttaatttcaccaaaacatgtctgctcaaattatatgtaccattttaacctacccttttcccttgttgattcttcagaagttttcttaattaatgagtcagtattattaggaaatgtactctatgtcattgtataacagaccatggtttaatctgattttcctttatcctccactgcaagattttcatttttaaaaattattctcgactgggtgtggtggctcacgcctgtaattcctgcactttgtgaggccgaggcaggcggatcacctgaggtcgggagttcgagtccagcctgaccaacatagagaaaccccgtctcttctaaaaatacaaaaaaaattagccgggcgtggtagcgcatgcctgtcatcccagctactggggaggctgacgcaggagaaccccttgaacccaggaggcggaggttgcagtgagccgagatcgcaccattgcacttgagcctgggcaacaagagcgaaactccgtctcaaaacaaacaaacaaacaaacaaaaaattattctctggaaattctgggtaacgtcagtggattacatcaatgttaatcttctggttgtggtattatatactacaatcaccagctgaggtaaccaggtgaaaggtacacaagatctctcaattttatttcttgtaactacatatgaatctaaagtctatctaattaaaagagaaaaagattttcagaaaaaaagcattttgtgaacatacttcaacattgtgtacaactatagctacttccttggcataaataccaaaaagtgggattttgagtcaaaatgagactgtggttaagtacctgcaacatcctgtagaccctgtgacgttagtacttggaatgagagcgggactcacggggcataactgctacctgtacattgtttacaatgcagcaagcaagggacaccgaatagcagctccggcagcctgtgctagcggcctgcagagaattccaggtgacgctccagaggggctaggagaggatacccttctgaggacagccatggctcgcccggcatcaccccactcaagaggccagacggggtcccagctggggtgacacagctcctttcccagtcgggaaggggcgtctgcagggaccaggaagggcttagcttggggctgcccgctccggcaccgacctgggacgcgccctgaggcccctgcctgggaccgtcccggactacatttcccagagaccatccaggagtacgccgtgctgcatgctggaacacggggcttggggctctggtttcccccgacggccccgcgtcctcttctagcctcaccctctcccgaggccccagcgttgggggactaccgggtgcgtctgcggctttgggagagtgggaggagggaaagggatgggaggggtgcacgcacacgtgtcagtgtgtccgcgtgtcagcatctgtgcaggcgcacgtgtgtgtcgggctctgttgtgtctgcacatgcgtgtcggcatctgtgcgtgcgcacacgcccgtcagggtctgtgtgcccgcacaggcacgtcaacagctgagcacgctatgtatcgggggtctgtgtacgctcacatacgtgtcggggtctgggtacgtgcacatacgtgtaggggtctgtgtgcacatgcgtgtcgggctctgctgctgtctgcgcgctgcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggtgagattggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggtgcgctctgggggttgtgcgggggcagcggtcgggacgggtctccgtggcccacggatgcacctctgcaccgtgtggggtggtggggcccgtagcatggccgtgctgggcgttagtgggtatgaggggcgcagatgtgtctcaggacagagtgagctgtggtgaggctgagctgtgcagacttgtgctgggatgggtgatcgggccttctgggtgacgcaggtgtgtgtgacaacacaacctgtagcttcagcgtctctgtgctgggatggatgatcgggccttctgagtgatgcaggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggtgacgctttcagagccagaagtgctgtgcatgcaggccacctgagtgacaggggacggtggcctcaggagtagaattcctcctgtagagggacaggtccctgatgtgggagacagggaggggggcagctccacgcgtcatcatctcaatcgccacagcgtgctcttcaggaatctcccagaaactccatctcggggcctcgtatttctcattggttttattaggtatggcaggtgttacccttccggttctgttttccccaggccagcatccttcagaaaaagcatccccgaggaggaagacgaatcgttaaacatctgaaagggtcaggtgagtatccttttttttttatattaaatgatatgtgtttataagacttaagaccaaacattaaaggtagatgaccaagatttgagtcctgtttctgcctcttagctttttgagccttctgaagataggcttgtgaggagggtgaaatgcattaacacgcataaaacccatagacgcgcacccctgagtgggagtgcacagtgagtgctgctgttttgtgctaagtctggatgtctgtacatcaggagcaacgtacatatgaaggtaactgggatgggtgtttgcaggttcacaaaatgaaccacagcctcaaatggcctagaactgttatccttaacctgagggcctgcctttaactccacttacaactttccaagggacattctgtgtatatttactgtatgtgattatcagtgttagtgtatctgtcccccaccaccaccaccctaaggagatactctgtaatttcatggcattaagaaggatggacatgccccaaagacatttagacccattggtctacaatcgaaggctgtgtaccttgaccacaattattgttcaggatggtggaaatggttaagtaattataccacgttcatttcatggaatactctgcagctacaaagaagtaagtttagttataaccgtaagaaagaaaaatgcacctgacataatattaaacactactaatagttattaacaatagtaaatgaaggaaatgcttcagttgcctacaaattccattgaataagatttttgtaaataccttatccaacatgacattttagtatattatttaggattattcatgaatccttcaaaagagaggagcctggccacatttattgagcgcatttttgtaccatactctattgtgttttgcacacactccttaatttattcttaccttagtctgtaacaaagtaccatagaccggtggctgaaaccacaaacatttattgctcacagttctggaggctggaagtctgagaagagggtaccagcatggtcaggttctgatgagggcccttttccaggttggagactgtcaccatcttgctgtgtcctctcacggaggacatgtgtgtgcttggaggctctttggcagagctctaggaggtgtgtgtgcttggaggctctaggagatagtctttttttttctgtaattgagatggaggcttgctctgttgcccatgctggagcgcagtggcacaatcttggctcactgcaacctccacctcccagattcaagtgattctcccgcctcagcctcccgagtagctgggattacaggcacatgtcaccatccgcagctaatttttgtatttttagtggaaacagggtttctccttgttgatcaggctggtctcgaactcctgacctcaggtgattaattagccggcctcagcctcccaaagtgcgggattacaggtgtgagccaccgagcctgccctgtgggaggtattttatgtccttgcttttgctggcttctagacactgccccacatgccttggtttgtgaccccttcttccatcatcaaagctgcaaagacaggccaagtcccttttccatcacgtcactctgaccctacttctttctgttcatctcaccctcttctcattttgaggaccctggtgattacattaggcccgctgaggtaactcaggataatcttccctattttagtgtcagcccattagcaattttagtccgcctgcaaccttaattcccctttgccatgtaaggtaatatcatcataggtgccagcattaccatattgacatgtttgagagaggcaacgagagaacaataatcatatttcttttcttttttttttttttgagacagagtttcgctcttgttgcccaggctggagtgcaatggcgtgatctcagctcgccgtaacctctgcctcctgggttcaagcaattcctgcctcagtctcctgagtagcttggattacaggcatgcgccaccacacccagctaattttgtatttttagtagagacggggtttctcttttgttggtcaggctggtctcgagctcccgacctcaggtgctctgcctgcctcggcctcccaaagtgctgggattacaggcgtgagccaccgtgcccggcctatatttcttcttttatgtgtttttgttttgttttgttttgttttttccttatagacaaggttgtgttctgttgcccatgctggagtgcagtgggttgataatagttcacagcagcctcaatctcctgggctaaagtggtcttcccacctcggcctctcaagtacctgggattacaggcaccagccactgtaccctgctcctatcttgttatatttcttataataggattaatgcaggcctgctgggggcaaagaaagaaacagtccctaaggagcccttaaagaagaatctccaaattacccataattgtaccatccagagataatcactgatgaacattttaaatggccagcactttgggaggccaaagcgggatgatcacttgaggccaggagtctgagaccagcctgggcaacagtgagactccatctctactaaaataaaaaattgaaaaagattagccaggcatggtgatgcatacctatagtttcagctactcagaaggctgctgtgggaggatcacttgggcttaggggttccaggctgcagtgagccattgcactctagcctgggcaacaaagggagacagtgtctcaaaaaaaaaaacaagaaaaaaacatctgaaatggtatttatgtttctaggcctcttctttgcctctaagcatgtgtgtgttttgtttttggagtattgaatcttgctaattcatcataaatgagtcagagactccaaatcttaatttataaaaggaatccaacccagccatgagtcgcattacacctgtgtgtgtgttgggaggggaagggctatgccagtgatctttgccttgttttgaaatatctcacatatttctaccttgtaggattagaaatccatcatctgaatctaacctatggtaacaaattttcaagaaagacagccttttagaattagattatagaatgttaatgttcctttcccaggacatcacaataatcacccatgaacactaatcactgggtgccttgcagatacggactttccatgtgacattagcaagattatttgtacaagtaacaaatatgggctgtataagtaacatttccaagatagaaaaagaattagatgacagtatctcatatgtatctcccttatcccgtggaacacaaaattcagcctcttgctaatgttctcaacttggcatcttctcagattagagtcattaaattagattttcttatgcagaacaatgtctctgtccccctagttgctgatggaaagggaacatttcctcgttatatttcttagaatctcttttgctaatgtattcattttgttaaacaaaatgaatttcattcttaacatcagactctgaatgttatttttggttaatattgattacgcagacagcgggttcaaggaaggcacttttgtttttcttgagacagagtttcgctctggttgcctaggctggagtgcaatggcgcaatcgcggctcaccgcaacctctgcctcccgggttcaagcgattctcctgcttcagcctcttaagtagctgagattacaggcaagtgccaccacgcccagctaattttgtatttttagtagagacagggtttttccatgttggtcaggctggtcttgaactcccgacctcaggtgatccacctgcctcagcctccgaaagtgctgggattacaggcatgagccaccgcgcccagtggcacattttaccattagaaaaaaaaggagggggccaggcatggtggctcacacctgtaatccaaagcactttggcaggctgtgaggcaggaggatcgcttgagcccacaagttcaagaccaacctgggcaacatggtgagaccctgtctctattatgaatttttttatttttttgagacggagtctcgccctgtctcccaggctggagtgtaatggtgcaatcttggttcactgaacctccaccttccagttcaagcaatcctcctgcctcaacctcctgagtagctgggattacaagcgcgcaccaccatgcccagctagttttttgtatctttagtagagacggggtttcaccacgttggccaggctggtctcaaactcctgacctcgtgatccgatccgcctgccttggcctcccaaagtgctgggattacaggcatgagccaccacgcccagccttattatgaattttttaaaaataaaaactataaaaagaaaaactttttttaaagaaaaaaagcaaggagattggccgacatgagttggtcttcaataataacaggtaacttctattacacaaatgtcacatattattgagtgttttacatagattatcatacttgccagttgtaacaatcataccatgtagtacttttattacattttatcagtgacgaaacagacactatgaggctaactgccagggttcagattcacatctctaaagtcagaccacacaacctgtattcttaatttcatcaaaacatctctgcccaaattatatacacctttttaatctaccttcttcacttggtaattcatcataaaaattttctcaagccagacgcggtggctcatggctgtaatcccagcactttgggaggtcgaggtgggcagatcacaaggtcaggagatcgagaccgtcctggccaccatggtgaaatcccatctctactaaaaatacaaaaattggctgggcgtggtggcatgcacctgtagtcccagctactcgggaggctgaggcaggagaatcgcttgaacccgggaggcggaggttgcagtgagttgagatcacgccactgcactccagcttggccagagcaagactccgtctcaaaaaaaaaaaaaaattctcaataagaatcgatattattaggccgggtgtggtggctcatgcctgtaatcccagcactttgggaggccaaggtgggcggatcacgaggtcaggagatggagaccatcctggctaacacggtgaaaccccatctctactaaaaatacaaaaaattagccgggcgaggtagtgggcacctgtagtcccagctactcgggaggctgaggcaggagaatggcgtgaacccaggagacagagcttgcagtgagccgagatcacgccactgcactccagcctgggcgacagagcaagactccgtctcaaaaaaaaaaaaaaagaatcaatattgttagtattccatgccatcatatagcagaccataatttaacccatcctctactgtgagatactgctatttttttcgttgttgaaactgtattctctggaaatcatagataagatcaaggagggaatctgtgtcactatcctggctgtgatactgtactgcagttttgtttttcttttttttgagacggagtctttctctgtcacccaggctggagtgcagtggcacaatctcagctcactgcaacctccaccttctgggttcaagcaattctcctgcctcagcctcctgagtagcggggattacaggctcccaccaccatagccagctaatttttgtatttttagtagagacggggtttcaccatgttggccaggctggtgtcgaatttgtgatctgcctgccttggcctccaaaagtgctgggattacaggcatgagccaccatgcccggcctgtactgtagttttataaggtatcactactggtgtaagtcaggttaagggtgcactggatctctctgtattattatttacaactacatgtgaatctacagttatctcagttttttagaaaaataacttacctagaaaaaaatttttcttgatcgctctttcacatacatttatgtacttctgttttcttgtctttctaactgtttcctcctcctggacccataaattccacatgtggaattttgagtcaaaattagatgtttgttaagggcccgcactatgccacaccctgtgacgttagtacttggaatgagagcgtgactaacggggcataactgctgcctgcacattgtttacaatccagcaagcaaggggcaccgaacagcagctcgggcagcctgtgctgtggcctgcagagaattccaggtgacgccccagagggcctaggagaggatacccttctgagaacagccgtggctcgcccggcatcaccccactcaagaggccagacggggtcccagctggggtgacacagcgccagtcacatccactcatggacactcagtaggccacactcccgatcacccagccacagtcctagatcagtcactgactcacagtctgccacttgtatttccattgtctctgggcttcctctgccttcaccttccaacagtgtggtacctgcctgagagcagcggcccccagtgggacatgagagccaggaccctgtcattaactgaaccaacacaaagggcacagccattgtcatagataagtgttcaagccggacgtgttctccgtaccggctcctgtgtcacagtaacgggaagcctcaggagtgggagtccttgtggagggagaggtgactaacttggtaggtgagtgtcgggagcatcacgtgttctagaatccagtaaatacacgttagtccccaagaactctgaaactcacaaatgccagtgtcctctccattcggattggtttcggctgtggcctggggacaggcgtgccctggagggtatttgctaatgcagcctgtgctccagaaagaccctaggttctcattcttcctttcccctaggctggcatccttcagaaaaagcatcctgagggggaaaaaaaaaaaaaaaaaaaaattattatttaggttggtgcaaaagtaattgcggtttttgccattatgtctaatgtcaattgcttttgcactgacctaatattatatatctgaaagtcggctctccacatgagttaccttttttgttcattaaatgatttgtgtttatatgacttaggactctttactctttatggccccaaatatcctccctaatagcaatttatcccagtaattcctccccaggggatgtggcaagggccaggcaggtatattcctctctgtaccccctggttgaccagccctctcctttgagtatccacaaacccatttgtcaaattgttgacatcctgctgtgtgctctggttttctaagatctgatggtatagaaaaatcccccctaaaaaaaaaaaaaacaactccctcctagaggttcatgttagcgcgctttattttacagtgtgcttgggtaaggaggggattcgtttttaggtggagtcaaacacagatatctttggtcttttccatgggactgatttttagagcacaagaaaagagaaagttagtttgtttagtctgtacctggcaaagttgtcagttttgtgaggcctttaagagcggagtttgagctaatttctgtgtcatcaaaggcagagatgtttttcaatatgcagtaaatcgaaatttgttctattcacttggacttctttgggcggacagcttctgtttttcttcagttccccgtttgtgtgaactgtgagaaaccatatggtttaatgttgagtatgagttctggatctagggcagaggttggcagctgtcttcaatggcaatttgtgtatgtttatggtctacagaggctttgatctgtgtttatactgcagattaaatcaagctgattaacatatccctccctcaactcactgataatcatatttgcaatgagaacatttaaatctagtctcttggcatattcaatattattcattatatttagtcaccatgctagacaataaatctccagaaattattcccactttatctcctttaatcttctcattccccatcaccctcccaggccctgacgaccacctctcttcttctgtgagttggattttttttacactccacatgtaatgacatcatgcaggatttgtctgtctagcttatttcacttagtacaatgtcctccagatttacccatgttgtcacaataacaggatttccttctttataaaggctggatggcattgcattgtgttatctctaccacactttctttattaattcctgatgagtatgtaggttgattccttatcttggctactgtgaataatgctactgcagtgaacacgggagcacaggtatcgccatgacatactaatttcattttctttggatatatacccagagtgggattgctgcgtcatctgatagttttagttttttcaggcatctccacggtgttttccatcatggctaatttacattctaaccaacagtgtataagggtcctcttttcctcacagccttgccaacatgttattttttttgtttgttttttaataaaagccattcttacatgtatgaggtgatatctcattgtggtttaactttttgttgccctgaataatagtagtgatcctgagcaatttttcacagacctatagcaatttgtatgtgttctatcaagaaatggctgttcaagttttctgcccatttattatcagggttgtttggttttttgctgttaagttgtttgagttctatgttttgtcatttttgtttgtttttttttgtttgttttctagacagggtcttgctctgtcatccaggctggagtgcagtggtgcaatgacagttcactgcatcctccacctcctggacccaagcaatcctcctacctcagcctcccaagtagctgggactacaggcacatgccatcatgcccggctaatttttcttttcttttcttttctttttttttgagatggagtctccctctgtcacccaggctggagtgcagtggcgtgatctcggctcactgcaacctccgcctcccgggttcaagcgattctcctgcctcagcctccgagtagctgggattacaggcgcgtgccaccacgcccggctaattttttttttgtatttttagtagagacagggtttcaccctgttagccaggatggtctcgatctcctgacctcatgatccacttgcctcagcctcccaaagtgctgggattacaggtgtgagccacggtgcccggccaatgcccgactaatttttcaattttttgtagatatggggtctcaccatgttgcccaggctgatcttaaactcctgggctcaagcagtcctcccatctcggccttccaaagttctgggattacaggtgtgagccaccatgccaagccctattttggatattaaccccttatcagatatatggtttgaaatagtctctcccaatccataggctaccttttcattttgtttcctttgctgtgtgggagatttttagtttgatgtagtcccatttgcttatttttgcttttgtaggatgatctggtgtgatagctaaaaactcattgccaagggcgatgtgaaggagaattttccctatgtattctcccagtagttttacagtttctggtcttactttttatgtctttaatccattttgacttcatttttctttttttctttttcttctttttttttttgagaccaagtctcactctgtcacccaggctggagtgcagtggcacgatctcggctcactgcaacctccacctcccaggttcaagtgatttctcctccctcagcctcctcagtagctgagattacaggctcctgccaccacacctggctaatttttgtatttttagtagagacggagtttccccatgttggccaggcaggtcttaaactcctgacctcaggtgagccaccgcacctggcctcatttttctctatgaagtaaaataagggtccagttgcattcttctgcatgcaaatatccagttttcccaacagcatttatttaagagatcgtcctttccccattgtgtgatgttggcacctttgtcaaagatcagttgaccatgagtttggatttgtttctgagctctgttcttccattgtgtgtgttttcatgccagtattataaccgtaataggtccgttgccccatgagcacagcatgtcaatacagcaggttgcagcaaagaaagacggtttactgtaaggctgcagaacaaggaggtaggatgaaaatgaaatccgtcctcccagggagtttggagctagggtttttaagggttttaaagtgtggaaatcactgcttaaagagtgcagtgtggagtcatgagacaggaagatgaagaaactattctcatgctgattctgttcctctgtggttgtcttcagactgcttggcatcagctatttcactggaatttgggacctgagaaacatcttgtgcaattcttaaaagcctcatgattctaacgttagaaatcctatgtatgggaacagtggggactctgtctcaaaaaaaaaaaaaaaatttttttttaaaaatcttttcatattgttttccagtctgtattttatttattttttgctctaatctttattatttccttccttcctatctttagactccatttgttcattttctggttccttgaaatgtttgtttgagatcttccttctttcgtgatataagtatttactgctataaacttccggcttagaactgcctctcttgccttctttaagatttgaggatgttgtgtttacatttacgtttgtctcaaaatatttttacagtttcttccctggcccattggttgtttagcatcatgtcgattaatatccacatattttttgatttacctaaatttctcccgttattgatttccagttttatgcccttgtggttggaaaaggtcattcatatgatgtcagtcattgtaaatttcttaagatttgtatcatgtcctaacatgatctatcctggagaatgtttcctgtgtacttgagaagaatgtacatgctgccgctattagagagatggtgcagaatacaactgttaggtccatttggtctaaagcgtaattcaggtccaatgtttacttgttgattttctgtccgaatgatctttcctttgttgaaagtaggatttgaagtcctcttctgtcattgtattaaaatctaaccctcccttgagatttcttaatgtttgctttatgtatttaagagctccaatgctggatgcatacatatctataattaatatatcatcttgactgatggactaattttattatataatgacattctttgcctctctttacagtttttgatttaaagtctattttgtctttttttttttttttttttttttttgagttagagtctcgctgtatcacccatgctggaatgcattggcccgatcttggctcactgcaacttccgcctcccaagttcaagcgattctcctgcctcagcctcccgagtacctgggattacaggctcctgccaccacgccaggctaatttttgtgtttttagtagagatggggttttgccatgttggccatactggtctcaaactcctgacctcaagtgacctgcccaccttggcctcccaaagtgctaagattacaggcgtgagccaccatgcctggccgttaatctttttttttttttttctttttttttgagacagagtcttgctctgtcacccagtctggagtgcaaggtgcaatctcggcccaacctccgcctcccgggttcaagctcttctcctacctcagcctcctgagtagtgtgcaccactatgcctagctaattattgtattttttagtagagatggggtttcaccatgttggtcaggctggtgtcgaactcctgacttcgtgatccacccaccttggcctcccaaagtgctgggattacaggcttgagccactgcgcctggccaatcattttttaaaattaggactcccttaactttcactccttataacgggattaatgcaggccaactgcaaaaaaattcagtcctctaaggagttcataaagaagaatctcaaaattaattacccataattccatctagagataattactgttaatcatatttggtatatatgtttatagtcctccacttcccctctaaacatgtatgtgcttttgtttctggaacattaaatccttctaattgataaagtaaatgaatcaaagactttccaaatggtagtttgtgaaaggcatccagcccagccacgggtcacgttatacctgtgagcatgtggggatgggaggggtgtgccagtgatctttgtcttgttttggaaaacctctcatatatttacaccttataggagtagagacacatcatctgaaactaatcccatggcaacaaattatcaaaaaatatagtgcacccttggaatgagttctgcatctgtggattcagccacagatcaaaaatatccttgggaaaaaaaataggaggtttgcatcctattttacagatgctaacatctgtattgaacatgtacagacttttcttctcattattctaaaccatacagtatgaaaattattagcatagcatataagataatttataaagaatctagaatctaaaatgtacaggaggatgtggataggttatatgcagatactataccactttgtataagagtctgaagcattcgaggattttgatattcaggggggttctggaacaaatctggatactgagggatggctctacagcctttcagaattaaattttctatgattttaatggttctttcaaagaccatgacagtaatcactgacgcctgttgccttacaaatctgcttgtacaagtaacatttccatgattatatgtacaagtaaaaaatacccactatacaaataacaaatccaagatcagtgaaattgagtacgatgacaattaaaatggtttgcataaatgtcctataacacatggaacacatgattcatcctcttgctaatgttcccagtttggcatcttctaagatcatattatttgagcacaatttttgatgcagaatcatctctctgttcccctactcgcttgtgagagggaacatttcctccttatgtgtcttagaatatttttacctaacatgcttaaacaaaacaaatttcattcttaacatcaggctctgaaagttccttttagttagcatttgctatattgacagctggtttgacaagtacatattttagcataagaaaaaaacagcaggccgggtgcagtggcccttgcttgtaatcccagcactttgggaggccaaggaggcagattgcttgagctcaggagatcaaggccagcctgggcagcatagcaagaccccgtctctaccaaaaaaaaaagaaaaaaaattacaaaaactagccagatgtggtggcgtgcacctgtagtcccagctcttgggaggctaaggtgggaggatgacttgagcctaggaggcagaggttgcagtgtggttgagattgcactactgctctccagcctgggtgacaaagcgagaccctgtttcaaaaaaattaaaaacagcagatgagtttcttttttaaaactggattcaggatcagtgtaatgttactgatcttcaatagtaaccacaaacttaaaaaatctttacatattgccgtatgtattagatattctgatatttaatagctgagacagtcataccttatagtattattatcccaattttactagtgaggaaacaagcagttaataactgttagagctcagattcacattctgaaagttatagaaattaagaacatagagcctatgttcttaatttcaccaaaatatctcctcccaaattatacataccctttcaaacctaccttcctctcttagtaattaatgataccgtctttcaatttacatgaatcagtatcactattagtaaatgtattttatgccattatataacagactaatttatttattctgtactctactgtgatattttcctctatcttctgcaagattttcatttttaaaaattactgtcttggctgggtgcagtggctcatgcctgtaatcctggcctaggcaacaagagtgaaactccatctcaaaaaaaaaaaaaaaaaattagtgtcttgaaatttgcataacatcaatggatgatgtcattgtgaatgtcctggcggtgatattatactgtatactataatcaccaattggtgtaaccaggtgaaagatacataggctttctcagtattatgtgtacaactacctaagaatctacggttgtatcaatttaaaagaaaaactttcccacacaagataatctccaaacatcttgggcatacatgtgtgtactactctagctatttccttgggataaattctaaaaagtgggattttgagtcaaaatgagactgtggttaagtagtacctgcaacatcctgtagaccctgtgacattagtacttggaatgagagcgggactaactgggcataactgctgcctgtacattgtttacaatccagcaagcaagggacaccgaatagcacctcgggcagcctgtgctggcggcctgcagagaattccaggtgatgctccagaggggctaggagaggatacccttctgatgacagccatggctcacccggcatcaccccactcagaggccagacgggctcccagctggggtgacacagcccctctcccagccgggaacgggcgtctgcagggagcaagatggactcagtgtggggctgcctgcctggaacgcgccctgaggcccctgcctgggaccggcccagactacgtttcccagaggccccccaggaacttaaggcgctgcatgctgggacacggggcttggggctctggtttccccagacatcgccctcctcaagcctctcaccccttcccgaagcccctgtgtgtttgggcctgagtagggcattcgcttcctaggaggaacccaggggtgcgcgccaagcatgggggtagggggaccgccgagtgcgcctgtggcttcgggagaggccaaagaaggaaggagtgggaagggcgcgcacgcgtgtcagtgtgtgcatgtgtcagcgtctgtgcacgcgcacatgtgtgtcggggtctggtcgcacatgcggatcaaggtctggccacacgcatgcgttgggggtctgtgtgcgcgtacacgtgcatgtcgcggtctgggtgtacatgcgtgtcaggatctgtgtgcacgcacatgcgtgtcgggctctgctgctgcctgcgcgctccggccgctgggtgcgggaggcccctcccgagtccggggtgcgcatgcgcgctggcctccatgggtggcgggaccgactgtgtgacgcacttgcgtgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggtgagattggcgcccatggctccaaggggagacgggcacggagcttctagcggtgacgcacttgctggagagggtgtggggtgacgcagccgggctctccccataactagggctggggtgctcccgaggctttggggcgacggaacccgcacctgtgaacctcggcagtgcgtccccgggactctgttctgtgaggtgcgctctgggggatatgtgggggcggcgatcaggacgggtctccgtggcccacggatgtgcctttgcactgtgtggagtggcggggccggcagcgtggccgtgctgggcgttagtgggtatgaggggcgcagatgtgtctcaggccagtgtgtgctgtggtgaggctgagccatcagtgcaggcttgtgctgggatggttggtcgggccttctgggtgacgcaggtgtgtgtgacagcacaacctgtagctccagcgtctctgtgctgagatgggtgatcgggccttctgggtgacgcaggtgtgtgtgacaacacaacctgtagctccagcttctgtgtgctgggatgggtgatcgggccttctgggtgacgcaggtgtgtgtgacagcacaacctgtagttccagcgtctctgtgctgagatgggtgatcgggccttctgggtgacgcaggtgtgtgtgacaacacaacctgtagctccagcttctctgtgctgggatggatgatcgggccttctgggtgacgcaggtgtgtgtgacagcacaacctgtagctccagcgtctctgctgcttcccctgccttcacctcctaaccaagcggtacctgcctgagaacaagggccgcggaaggacgggagtgcctgagccctgccaggaaattcaccaacaagaaggcagaaacagccatgaggtgacgctttcagagctagaagtgctctccactcagggcgcctgagtgacaggagacggtggcctcaggagtagaattcctcctgtagagggacacgtccctgatgtgggagacagggagaggggcagctccacgcttcatcatctcagttaccacagcgtgctcttcaggaatctcccagaaactccatctcggggcctcgtatttctcattggttttattaggtatggcaggtgttacccttctggttctgttttccccaggccagcatccttcagaaaaagcatccccgaggaggaagacgaatcgttaaacatcttaggtcaggtgagtatcttttttttttttttaattaaatcatatgtgtttatgagacttagtcggcgggcgcagtggctcacgcctgtaatcccagcactttgggaggccgaggtgggcaaatcacaaggtctggagatcgagaccatcctggctaacacggtgaaaccccgtctctactaaaaatacaaaaattagccgggagtggtggtgggcgcctgtagtcccagctactcgggaggctgaggcaggagaatggcgggaacccgggaggcggagcttgcagtgagccgagatcgcaccgcttcactccagcctgggcaacacagcgagactccatctcaaaaaaaaaaaaaaaaaaaaggaaatcctattgaattagacgttttgtaaatatcctatccaagatgacgactgattattcagtgaaggaagagaggagcctggtcacatttattaagcacatattctctgtactaaactgtctcttgtctattttgcacacacctcttaattcttgtcttagttgattcagtctgtgataacaaagtaccatagactgtgtgactaaaagggcaaactttttttttttaattttttttttttttagagacagggtctcactatgttacccaggctggtcttgatctcatgagctcaagctttcctcccaccttggcctcaaaaagtgcttggattacagatgtgagccaccatgttgggccttttttattgtttttgttttgttttgtttttgagacagggtcttactctgtcatcaaggctggagtgcggtggtgtgatcatagctcactgcaacctcagccccctgggctcaagcaatcttcccaccccagcctcccaagtagctggggctactggtgtgtgccaccacatgtggctgtatatttttatttttattttgagacggggtctcgctttgtcatccaggttggagtgcagtggcacaatcttggctcacttcaacctctgctttctgggctcaagcaatcctcccacctcagccttctgagtagctgggactacaggtgtgagccaccacacctggctcttttttttttttttttttttttttttttggtagatacaatgtttcaccatgttgcccaggctggtcgtgaactcctgagctcaagcaatctgctgcctgcctcggcctcccaaagtgctgggattacaggcgtgaggcgccacacccagccaattttttaatattttatagagacagggtcttgccatgttgcccaggctggtatcaaactcctgagctcaagcaatcctcccatttccacctcccaaagtgctggggttacaggcatcacccaccgtgtccggccacagcaagcatttatttcttacagttctgggggctggaagcctgagaccagggtgccagtgcaagcagcttccggtgaggccttcttcaaggttgcaggcgaccaccctcgtgccatggccacacatggtgaaagggagctgagagctctctgggatcgtttttataagacactaatcctattcctgagcactcctccctcatgtcctaatcaccttccaaaggcctcacgtcttaataccatcacattggggaacagaatttcaatataggaatctggggaggaataaaatacttagttttgtcaggtatcttcagaggctatttaggtacagtattgtgctcagggtcagtgtgtacaaaaccaactcatttttcttctctcacaccacaacgataatcaacacagaaaactttgtgacttggccgggtgcggtggcccacacttgtaatcccaggactttaggaggccgaggcggatagatcactttgaggccaggagtttgaaaccagcctggccagcatggcgtaaccctgtctctactaaaaatacaaaaattagctgggtgtggtggcgcatgcctgtaatcccagctactcaggaggctgaggcaggagaatcgcttgaacctgggaggctgtgaacctgtgatgagctgagatcacgccaccacactccagcctaggtgacagagcgagactctgtctcagaaaaaaataagctttgtgactaaatgtgtggggagaagcaagctgtagtggacatcagccggatgtcctgcagttcagttctgacaccatctacctggagatggcatcagattccacaggttgtgagcaagactgtcccactctgccccactagccacaagaccaggcctctgggacatcttgccaaccctctacaggttggggttcttatactctttggcttctattagtgtatttgattgactcagaattcagggaaacacatataccagtttattacaaaggatattttaaaggatactaatgaacagccagatgaagagatatgtaggactagggttggaagagtcccaagcacaggagcttctgttcccgtggaattggggtgcgccaccttttcagagttcttttgtaccttcctagcagccacctcctgttcagctgtccagaagctctcctcaccctgtcttcttaggccttttatggagacttcattggataggtgtgactgaagcatgcacgaatgtgttgaaacgtgattggacaaataagagttgatttaatgctaattgattgagtggggaaactcaaggcccgtctgttcagattcttcttggcctctcagtgcagcattccttcctacaggtacagggcaggaccctctctggagtgagagtcctgctttgggcaggtgaaaggagggcaagagaagatgagagagagattctgcttcccgaggcctgcttctgaggctgaaagtgccctaatattaagattttaccaagggttatggaattatgagccaggaaccatggacaagaacatacagacacactcataccccatatatacacacatataggcacctacatatatacacaccatacacacatatacacacacataccccatatatacacacatatacacacctatacacacctacatatatacacacacatacacaccatacacacatatacacataccatatacacaccatacacacatatacacacacataccccatatatacacacatatacatacctacatatagagacacatatatacacaccatacatatacaaacacaccccgtatacacacatatacacacctacatatagagacacatatatacacaccatacatacacacacaccccatgtacacacacatatacacacctacatatatacacaccatacatatacaaacacaccccatgtacacacctacatatagagacacatatatacacaccatacatacacacaccccatgtacacacacatatacacaactacatatatacataccatacgtatacaaacacaccccatgtacacacctacatatagagacacacacatatacacaccatacacacatatacacacacaccccatatatacacatacacacctacatatatacacacatacacatcgtacacacacaccatatatacatatatacacacatatatacacaccatacacacatgcacacaccatatatatgcatatatacacacctacatatatacacacatatacacacacgccatatatacacacatatacacacctacatatatacacacatatatacacattcatacatgtacatacacaccccatatatacacacatatacacacacatcccatatatacacagctacatatatacacacatataaaaaccatacacacatatacacaccccatatatacacagatatacacacctacatatatacacatatacaccatacgcacatgcacacacatacccatatatacatatatatatacacacacgtatatacatatatacacaccataacacacgtatatacatatatacatatacacatatacataccatacacacacgagcatatacacacacatgccatacacacacatatgtacacatacatacccacaccatacacacatacatacacaccacacacacacatatacaccccgtacacatatatacacacaccatatatacacacacatatacgcacacacaccccatacacatgcatacctcatatatacatatacacacctacatatacataccatacacacacatatatacacacatatacccacaccatacacacacatatatacacacaccatatatatacacacatatatacacatccacaccatatatacacacaccatacacacacatatatacacacaccatatatatacacacatatatacacatccacaccatatatacacacaccatgcacccacatatatacacacaccatatatatgcacatatatatatacacccacaccatatacacacacatacacatatataaacaccatatatatacagacacatatacacacccacagatagacacacatatacacaaacatacacacaattatatcacaaggtctgattgtattactgagacacagtgaaaggatgttccataacaggaaggttatgcctgattcagtgacactactttttcaatattaggccttatatcagtttatttttgctgttttaacaaattactgtagattattggcgtcatacaacacaaatgtattatcttactgtcatagaggtcagaagtctgaagtgggtctcaccgggctaaaaccaggttgttggaggctgtaggagatattctgtgtccttgcttttgctggcttctagacgccgcccacactccttagttcgtgaccccttcttccatcagcaaagcctgaaaagacaagtcctttttccgtcacaccactctgaccctcctcctctaagtttaaggactctggtcattacattgcgcttgcttctataactcaagagaatcttccgtatgttagaggcagccgattagccattttaagtccatctgcagccttaattttcctttgccatacaaggtaacatatttgaaagtactggaattaccatagagacacatttgagaggtgggcaaagtggcaagatcccacctctacaaaaatacaaaagttagccaggcgtggtaatgtgcaactgtggtcccagctactagggacgctgaggtgggaggatcacttgaacccaggagatcgaagctgcagtaagctgggttcacaccactgtactccagtggcgacagagtgagaccctgtcgcaaaatatatgtgcacacatacacacatttgagaggcaggcctatccattcagagtttccttaatgactacagtgtgcctgctcccccataactatgtttgtgtttggcattttcttttaatttgggactatctcagtaaatttcttatattataatgggattaatgcaggcctgctggccaaaaaaaaaaaaaaaaaacaaattagtccctgaggagctcttagagaaaactctctaaattacccgtaattgtgcgatccacaggtcattactgtttctggtcctcgtttttgtaattaatgtttctagtcctcctctttgcccttaagcaggtatgtgttttctttctggagctggaattttgctaattaatcatgtgactactccagagactctttaaatctagttttaaatctaatctgtagcagcaaattatcaagaaagcctttaaaattaaagattctaaggtggaatgattgcttgaggccaggagtttgagaccaacctgagcaacatagtgagacctcatctctccaaaaatttaaaaaattagccaggcatggtggtgtgtgcctatggtcctagctacttaggaagctgaagtgggaggatcccttcagcccaagaggttaaggctgcaatgagccgtgatcccaccactgccctccagcctgggtgaaagagtgagaccatctcaaaaaaaaactagaaggccgggtgcaatggcttgtgcctgtcatcccagctctttgggaggctgaggcaggtagatcacctgaggtcaggagttcgaaaccagcctggccaacatggtgaaacgccgtctctacaaaaaatacaaaaattaggcaggcgtggtggcgcgcgcctgtaatcccaggtacttgggaggctgaggcaggagaattgcttgaacctgggaggtggaggttgcagtgagccgagattgtgccacagcattccagcctggatggtagaacaagactctgtctcaaaaaataagataaaatagctagagattctagaattgtaatgtttctttcccagaacatgacagtaatcactgataaattctaagtaatcatcaggtgccttacaaatatggactttctgggtaacattagcaaggttatagatacaagtaacaaagactgtgtaagtaacatttgcaagataaaataatgaggtgataagatggcaatagttaaaaatgttcacatgtatcttccatttcacatagaacacaagattcacgccgggtgcagtggcttatgcctgtcaccccagcactttgggaggccaaagcgggtggatcacctgaggtcaggagttcgagaccagcctggctaacatggtgaaaccccatctctactaaaaatacaaaaactagccaagcatggtggcaagcgcctataatcccagcttcttgggaggctgaggtaggagaatcacttgaacctgggaggttgaggttgcagtgagccaagatcgctccactgtactccagcctgggcaacaagagcaaaatcccatctcaaaaagaaaaaaaaaaactccgggcactgtggctcatgcctgtaatcccaacactttggaaggccgaggtgggcagatcacgaagtcaggagttcgagaccatactggccaacatggtgaaaccccatctctactaaaaatacaaaaaatagccgggcatggtgacgcatgcctgtaatcccagctactcaggagactgaggcaggagaatcgcttgaactcgggaggcagaggttgcagtgagtcgagattgcgccactgcactccagcctcagcaacagagtgagactgtctcttaaaaaaacaaaaaacaaaaaaccagattcaccctcttgctaatgtttgcaagttggcatcttctcgaaataggttctgtaagctggctggattccacacccccccaccccccgtccccgagaaggagtcttgctatgtcatccaggctggagtgcaagggcgtgatctcagctcactgcaatctccgcctcccgggttcaagcgattctcctgcctcagcctcccaagaagctggtattacaggcttgtaccaccacactcagctaatttttgtatttttagtagagatggggtttcaccatgttgggcaggctggtcttgaactcctgacctcgtaatccacccacctcagcctcccaaagtactgggattacaggtgtgagccaccgcacccagccaagctggattttttaatgcagaatcatgtctcttttctctacttactggtggagaggcaacatttccctaaatgtgtcttagaatctttattgctagttttgctaatgaacagaatttcattcttcacacattaagctctgaaaattgtttttagtttgcattcattatattggcaactggcttgagaaatatattttaatgtaagtaaaaaaaaaagcagacttgattattttataaaatttgagatgtgtaatgttgatcttcaataataacagctaatttacattaaataattgttgtgtattactgcatgttgtagatagattatcttagttaatagttcatgcagtcataccttgtggtatttttattccagctttaccagtgaggaaaccgacactgtgaggttagtaatcatcagagctcaggtttgcatcctgaaagaccacagagctgccaggtgcggtggcaaaacccatctctactaaaaatacaaaaattagccgggcgtgggcgcgcacctgtagtcccagctactcaggaggctgaggcaggagaatggcttgaacccgggagggagaggttgcagtgacccgagatcacaccgttgcactccagcctggcgacagagcgagacttcatctcaaaaaaaaaaaaaaaaaaaaaaaagagcacagagcctgcattctttttttttttttttttttttgagacagagtctcactctgttgcccaggctgcaatacagtggctattcacaggtaccatcccactactgatcagcacaggagttttgactgcctctatttctgacctgggccagttcatccaagcctgtgtccttaatttcagcaaaacatctctgtccagattatacgtacctttttattttattttattttattttttttgagatggagtcttcccctgttgccaagactggagtacagtagtgcgatctcggctcactgcagcctctgcctcccgggtcccagcgattctcccgcctcagcctcccaagaagctgggattacaggcatgtgccaccatgcccggctaatttttgtgtttttagtagagacagggttttgctatgttggccaggctggttttggaactcctgacctcaagtgatccacccgccttggcctcccaaagcgctgggattacaggcatgagccactgtgcccggactatacataattttttaaatctaccttcttcccttggtaattcatcagaaattttttctcaattaatctgcatcaatatcattagtaaatgtattccatatcattatataacattatttatatatgtgttctctactatgagatatttcagttgttttcatttttaaacattatctgctggaaaatctggataagatccatgggttgttattgtcctggttgtgatattttactgttattttgcaaggtgtcacagttggcataaatcaggtcaagggtacaaaagaccactgtctagtatttcttataactacatgtgtatctacatttatctcagtttaaaagacaatctttcctagaaaaaactgattttttgaacattcttaggcatgcattcatatactactatagctatttccttgtcataaattccagaatgtggaatttttagtcaaaattagacatttgttcagtgcctgcaatatgccagatgctgtggctattcgtacttggaatgagagtctgattcagtggactcagctgctgcctgtacagtgtttataatccagcaagggaaactaaatagaagaagctcaaggcagcctgtggtcaaggccggtggagaattccaggtcacacactcagagaggtgccaggaaggggacatcattctgtggacagccactgataattcatgaccaggtgattctgaatatactgactctttgttgggataaatggaatttattttctaggctttataccttaggtaatttttttcctttttaaattttttgtagagatggggtcttgctatgttgcccaggctggtctcagactcctggcttcaagcagtcctcccactgtggccccacaaagcgcagtgttggcattacaagtgtgaaccactatgtctggccttttttgtcctttatccttttttatttttatttttttttctttttgagacagagtctcagtctgtcacccaggctggagtgcagtggcacgatctgggctcactggaaactccacctcctgggttcaagcaattcttgtgcctcagcttcccgagtagctgggattacaggcacgcaccaccacacctagctaatatttgtatttttctagtagggacggggtttcaccatgttggccaggctggtctcaaactcctgacctcaggtgatccgcccgcctcagcctcccaaagtgctgggattacaggagtgagccaccatggctaggagtagactttttaagaaaaaaaaagaaaccttctttgtctttggagagtctaattgcctctgactacatttcaaatcagtacacatttatatttgataagggaatgcatgccttttgttgcaacaaataggtgcactgaaatgaagacactcaagatcacggggtgtgtcaggagctgtcaggaccaccaccaggttccttgtttctctagatggactcaacaggactcaccatctagacctactcgtgaccgatttattccagtgaagggatacaaagcaaaaccagctgagggagaggttgcataggacaggttagcagggcaccaggctccctcttcctcagtcctctcccaggggcatcacaccggatgtgcctggctcatccagcatcacattgtgacaacacctgttccatgttatcgaccagggaagctcaccagagtctgctggtgcaaggtttggtttggtttggtttggttttgggtcagagttttgctctttcgtccaggctggagtgaagtggcatgatctcggctcgctgcaacctctgccccctgggtgcaagtgattctcctgcctcagcctcccaagtagctgggtttacaggcacccgccaccaggcccagctaatttttgtatggtagtgcaaggttttgatcagggttcatgcacacactgcctcgcacaatctgaatcttctggactcccggaggaaaccaagggttccgtgtaaaccacattgtttatactgattattccagcgaagggatacaaagcaaaatcagaagagggagaggttgcataggacaggttagcagggaaccaggctcagtttaggcacagcgagccactcttacacgtgaaagaagagtgagaacactcgggtgtggttttcagacgccatgggccagtgttgcgagcagcctaagcatggcagtttccagttcagtgtgttaactgttttgcataaggggtcgtagaacttcccggattttttctttctgtttctctgtttttatatctctattttatttatttttctactgatatcttagggttggtttgtcagcgtgtatggttctgcattccctccttccctctctcctcctctccctctctctccatatatatacatgtgtatgtgtatgtgtatatatagacagatgcgtgtgtgtgtgtatttttatatatggaattttacaaatgttattgtgtcattctgttttggtaacctaactttactgagagtatgtctgaaatatctctcatgtctttaaatatctttctaacttaacattcagtaatcatttactattttactttgatattctgtgtgtaattatgctgtcagcttttctggactcaaaagtgctctcagatgtcacctctggtatacaaaaaaaacagttctgtatattacctgagcagtttcttgtccacctgccatgttgtgagtaacatcacccaatctagaggccagaagaggcccaagtttggataatacagcccctgttcaccctggaagcttgtctggaggggccagggtaggctcagaatgagactgaatactctgagcacccactgtctgatcctagatcacaatccccccatccagagttagctaatctatgaggctcatgggtatggtctgcatagaagaccaccctcacttctgacaccactgcaagcttggtggggattcctcaaaccgccctcaggttcaacagttcactagagccaggcatggtgactcatgcctataatcccagcaccttgggaagctaaggtgggaagctcacttgaggccaggagttcaagaccagcctgggaaatatagtgagacgcaatctctacaaaaaaaaaaattagccaagtgcagtggtgcaacctgtaatcccacctactcgggaggctgaggtgggaggattgctcgagcccaggaagtcaaggctgcagtgagctgagattgtaccactgcactccagcctggatgagagtgagaccctgtcttaaaaaaaaaaaacaaaaaactattcactaaaaggacccacagaattcactgagagatgttatgctcatggttacagtttattacaaggaaaggatacagattgtcatcacccaaggaaagaagtacgtggccaggtgtggtggctcatgcctgtaatcccaacgctttgggaggacaaggagggcagatcacgaggtcgggagtttgagaccagcctggccaacatggtgaaaccccatctctactaaaaatacaaaaattagctggacatggtggcatgtgcctatagtcccagctactcaggaggctgaggagaatcgcttgaacccgggaggcagaggttgtggtaggccgagatcgtgccactgcactccagcctgggcaacagagtgagactccgttcaaaaaaaaaaaaaaaaagtacgtaagttgaagtccaggagggttccagacacagagcttctggtgtcttctccctgtggagtcaggactcattactctgctgtctttgatgtgtgacaacaggcaccaactatcgccaactagagaagctcaccagagctctgatgttggaagtttttattggggcctcagcatgtagacatgattgactggttggtggattaactgtctacatggttaatcttagtgtccaggtcagctgatactgcgtgaccaaaagctcctaccccgaatcccttgattagtatttctggcatagcaagcccccatcagaaacaaagacattcctcttagaggtaatatagattacctttcagcaccagagggcaaaggccagactactttttaggcaagtacacattctttactacatcccacccatccgtccccgacagggagctggccagaaatggagccctcctgttaaattgtctgggcctgtctttgaggcgcaaaaaaaaaaaaaagtaaagcctcctctgctgtgtgcagctaggtttcctgaggtttcattgagagcttggtttaggtttgatccatgatactcttttttttttttttttttttttttgagacagaatcttgctctgtcaccagaggctggagtgcagtgacgcaatctcagctcactgcaacctccgcctcccgggttcaagcgattcccctgcctcaacctcccaagtagctgggactacaggcacgtgccaccacatccggctaattttttgtatttttagtagaggcagggtttcaccgtgttagccaagatggtctcgatctcctaaccttgtgatccacccacctcggcctcccaaagtgctgggattacaggcgtgagccaccgcacctggcctgatccatgatactcttcacctttcccagatatgtcacggttatgtgtttgtgttgggaagccaagacagaggagccaaaaggtcatattacatcactatggggaccccagatgcacctcgttttaatctctttttttccacccctagctctagcctctcggaatttgtcttcttcagtggaaaccccgagaagactgatcagttcttcagttctaaaacaatggcccaggtaagtgtatatttctctttccttcttgagctatgatatttgcgttctgtgcatctgcttgtgaattatctgaagccttttatctagtcaagctctttataattacctgtttcccagctctttctattccagtgaatgataatgccacgtagctccgtgtctgcctttttgggaaatcactgagcaggtgattaagtatctcctgtttgctcccttttttggcaagggtaattttggagcagtgaagtagcaaagtcctttgagggaaatatttaagtcaagtctgtggtttgatgagttagatatgttggtcccatctgaccacatgagaaacagatcctccactgatcatgttttctgcgtagataagagggaatgctcatattcgccggtctgtcttagtatgtgctcagatcccaagctttatgggacttttggaaagggatggggctgtgattaggacctttgaacagaggtcatgttcctgccgggaaactggaggataaattttattattgaatggatctctcagaccacaagatgattctaagtcatctgacatccttatcctctaaatcagaaacagggggccgggtgtggtggctcacacctgtaatcccagcactttgggaggcccaggtgggtggatcacttgtggtcaggagttcaaaaccaacctgaccaacatggtaaaacctcatctgtactaaaaataccaaaattagcaggctatggtggcatgtgtccataatcccagctacttggtaggctgaggcaggagaattgcttgaacccaggagatggaggttgcagtgagccaagatcatgccactgcactccagcctgggcaacagagcaagactctgtctcaaaaaaaaaaaaaaaaaaaaatcaggaacgggggaaaggcagggttatggatggtaataaatatgaagatcttccagtatggaagtaggagatgatcacataccccagaatcggagaaagccttaggtgttttgggcaacctaagtgaataactgtaataaacagtctgacttacctgtgtgggaattttttaaatgcttaaaaggaagactgcttaaaatgtagtttggcatgatgaactggaggcttgaaaacattcaaacatgcaaaccgtattttctttttttttttcttgggacggagtttcactcttgttgcccaggctggagtgcagtggtgccatcttggctcacctcaacctctgcctcgcgggttcaagtaattctcctgcctcagcctcctgagtagctgggattacagggatgcgccgccacacccagctaattttgtattttaagtagagacgaggtttctgcatgttggtcaacctggtctcgaacccccaacctcaggtgatccgcctgcctcagcctcccaaagtgctgggattacaggcatgagccaccacacccagcaaaccctatcttcttttcttttcttttcttttctttttttttttgagacagagtctcgctctgtcgcccaggctggagtgcagtgccacaatctccgctcactgcaagctctgaccaccccgggttcatgccattctcctgcctcagcctcccgagtagctgggactacaggcgcccaccatcacgcccggctaatttttttgtatttttagtagagatggggtttcaccatgtttgccaggatggtctcgatctcctgacctcgtgatccgcctgccttgttctcgtgatccgcctgccttggcctcccaaagtgttgggattacaggcgtgagccccccgcccagccccagcaaaccctattttctaaaataaaagttcttaaacagaaatcttgatttttcttccccccttaaaagaaaaaatgctgtaggaatccacacttgttgagaacttataaggcaggcacgtagcagacactgcttgtaagcaagaagaaaacttggattgttttatccacttcctggcaggtttgactaactgaggattctgcacagtaaagtcattttctctgcagcggtagagctcttcagtgacatgcaggcattctgcttccgtcacagttacagtgatgtccttaccgccccttgccgatgtcacgggtgttcagtctgctcacggtgttcaccctacccagagggtggcctcctgtctccttcatctggaagctgtttcctttcatttcatcatgcacgtgtgggtttctgtttcagggtttggtgacgttcgccgacgtagccatagacttttctcaggaggagtgggcctgtctgaactctgctcagagggacctgtactgggacgtgatgctggagaactacagtaacttggtctcactgggtgagttgcacgcctcagataacttagactgcctcctggaatatccgctctcccctgtgaatttcaggaccgcctttcaagaaactagttgaatttcttcttcctgtccccaaggaatgtattgagccttattgatgtggccgtgagcaccacaaccttcccctcccatccatcggttaccttcccacctttgtcgactcccccgtaatcatctcacttccttaatgtccgtggaatgagtgggaattctgggatatttatttcatgaccatcttcaaaggagccagtttgtcctgtgagagtatgtttatacccaaattgctattggtggtcggtgttactctagggacccacgtctagggaaaacatgtggacacagtgccctgaattgttctagtaaaccagcctatgtgtttgaagtacagtagatcagacaaacagaatttgtgtaaaaccaaagtgggcgtatttcatttcttacataccatacctgaagtgaggttgaaagttacaatccccgaactgtgagttaaacattgaatgacaatatcttgcaaacatccctggaaacttatttttcttctagcaaaaataacaacaatgatattaatggctaagctgtctgtggtgaccctgcctgtaatcccagctactcgggagactgaggcaggaggatcacttgagcccaggagttgaaggctatagttagctatgatcataccactgtactccaggctgggtaacagatcaagaccccatcgctaaaacaataaacaaataggaatatatatattttatatatatacacacacatatatattatatatacacacacatatatattatatatacacatatatattatatatacacatatatattatatatacacatatatacatatacaatatatacatatatagtatatattatatatataaactgcttactgtgtgccatgcactgtgctaagcactgtgtgtgtaagtacattgcatttcgttctcacaggcagatgagacaggcacaatcattgtctattttggagatgaggatactgaaacacagtgatgcagtcagacggagggagcaggagctagaatcagatttaacagttttggtccccagattccttgctgccagccaccatgttccacttgcctccaggcataatgcctacagaaatttaaaatatgaccttttctcggccaggcgcagtggctcacgcctgtaatcccagcactttgggaggctgaggtgggcggatcactggaggtcaggagttagagaccagcctggccaacatggtgaaaccctgtctctactaaaaatataaaaattagccgggcatggtggcgcacgcctgtgatctcagctactccggaggctggtgcaggagaatcatttgaacctgggaagcagaggttgcagtgagccaagatcacgctactgtgctgcagcctgggcaacaaagcgagactctgtctcaaaaataataaaaaataaggccgggtgcggtggctcactcctgtgatcacaagactggcaggccaaggcagacggatcacgaagataggagttcgagaccagcttggccaacagagtgaaaccccatctctcctgaaaatacaaaaatttgccgggtgtggtggcgcatgcctgtaattccagctacttgggaggctgaggcaggagaatcacttgaacccgggaggtagaggtatagcatttctttttttttttaagttgagatttttttctttttttcactctgttactcaggctggagtgcagtggcgcgatcacagctcacagcagcctcaacctcctgggctcaagcaatcttcctgcctcatctccctgagtagcagggaccacaggtgcacaccacgacacccggctaattgttgtgttttttcttagagatgggatttcgccatgttgtccaagctgatcttgaactcctgggctaaaggaatccacccacctcagccttccaaagaggctggattacaggcgtgagccactgcacctggctcaatagcattttgacttctggttgttataaatttgattaatactcaatcaaaaaaaatttaaggccaggcatggtggttcacgcctataatcccagcactttgggagtccaaggcgggcagatcacctgaagtcaggacttcaagaccagcctggccaacatggtgaaaacccgtctctactaaaaacacaaaaattagccggtgtgctggtgtgcgcctgtaatcccagctacccaggagactgagtgaggcaggagaattgctgggacctgggaggcagaggctgcagtgagtcaagatcatgccactgcactccagcctgggcaacagagcaagactccctctcaaaaaataaaaataatttttaaagaatttttgaagttttgagcttgaaatttttcctcaagttctatgtcctctagcatttcgtttttttaaaggagggcatataatttctaagccagaggtactgtcttatagaattaagggaaagagccttgatggttgtgagggaagagacaagacaacaatacggaggaaagtgggagccagtcagccacccgtacaaagagcatccccacagggcagggaacaggcacaccctgaggtgttggagagctttctccaagagctcaggcccaaagcctctaggaaagaaagatcttaccacgaacttgatcttcaccccatttccctgtcaccttgtttttcctgtcatatttaaccccattttatgtgctgctggtgctgctggtctgtgggccacgcctttagtagcgggtagaggtgacagggtcctctgccctttatcattcctgaaagtgggttagcctcgctttaagtgcccgttttctttttctcatatctaggtgttggcagtactgcttcccgggtgttgttaatgtgtcaccaccatgaagcacctggtgtctggttgtagctcctctttgccattggcagtcattggcactgcttacattcatcacactgggggctcaaatggtgcgcgcctatcactgccccttcatttatcagctgttataatttaaagagaaactttgtttcatctgctaattgctcatgcagtggcactgttcatattggataagaaggataaaaactttgttctttttctttgtcagtttttatgttgtatttttttcttttcttttttttttttttttttgaggcagggtcttactctgattcccaggctggagtgcagtagtgcagtctgggctcactgcagccttgacttccgggctcaagccatcctcccacctcagcctcccaagtagctgggactataggtgtacaccaccacacctggctaatttttgtattttttttgtagagacagggttttgctatgtttcccaggctggttttgaactcctgagctcaagtaatccacccacctcggtctcccaaagtgctgggattacaggcgtgagccactgcacctagccaattgccagtttttataataaaggtctggtttcctagcgtgttccagagctggccatttaacattttgtagtatcattatgaacttatagatttaaacgtttgctgtttctcagtcctttgcagttagcctccttattgatgctcaagttctaaacttttccttattgttcttctaaactttttcacattttttattaaatttagtctcgtaaattatcttttttgttgcttttgaatgttgtattcttttacccagttgcttttttttttttttttttttttgagacggagtcttattcagtcggctcactgcaacctccacctcccgggttcaagcgattctcctgcctcagcctcccaagtagctgggattataggctcacaccaccatgcctggctaatttttgcgtttttagtacagacagggtttgtttgtttttgttttttgttttttgtttttttgatatggagtctagctctgtcacccaggctggagtgcagtggcacaatctcggctcaccgcaacttctgcctcccgggttcaagcgattctcctgcctcagcctccggagtagctgggattacaggcacccaccaccatgcccagctaatgtttgtatttttagtagagacaggatttcaccgtgttggccaggctggtctcgaactcctgacttcatgatctgcccacctcggcctcccaaagtgctgggattacaagcgtgagccaccgtgcccagtctgtttttttgtttttgttttgagacagagtttcatgcttgttgcccaggctacagtgcaatggcatgatctcggctcactgcaacctctgcttcccaggttcaagcaatttccctgcctcagcctcccgagtagctgggattacagtcatgcgccaccatgtccggctaattttgtatttttagtagagacaaggtttctccatgttggtcaagctggtctcggactcccgacctcaggtgatctgcctgccttggcctcccaaagtgctgggattacaggcgtgatgagccaccactcccggccctttaccagttacttttaataatactactgacatatacgtgtatcagtttcagaatgctttacacacagccatccaactgcatattgttttgttacagtacttctatatttggttttccaagtatatcatcacatcatctacaaatacttgttttcatcttcaaaataggaaataataggactaattgtcgggacctttttcatgtctgactttaaaatagatgtctccaatgaattctcagttagtattgtaccagaagtagaatctacattttaacaagagccctgggtgattcacatttattctactggataatttttatttctattagacgagtttttggtttgtggttaggttcgtttgtacttgtgtccctctaaaggaaagaaaatatgttcttttttcccagatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcaggtctctttgttggatattcaaacacgacctattcaagaaggaaccccgccagcagactggacctctgctaaaccctagcggtgcccacagcagggacagcgcgggagggaggtgagcggactggtcctggggacggggtcagggcccagagtagagttgttacaggaaaggggtgccaatccagaccccaggagagagttcttggatctcacacaagaaagaattcaggacaagtcctcagtgcaaagcaaaagcaactttattaagaaagtaaagtggtgggaccaggtgcggtggctcacgcctgtaatcccagcactttgggaggccgaggtgggtagatcacctgaggtcgggagttcaagaccagcctggccaacatggcaagaccccatctctactataaatacaaaattagccaggtgtgtgggcacacatctgcagtccagctactcgagaggctgagccaggagaatcacttgaacccgggaggcagaggttgcagtgagctgagatcacaccactgcactccagcctgggcgacagagggaggctccatctcaaaaacagaaaaagtggcgaaaggacagctactccacagacagtgttggacgctcctgacgttaggaggaacgcatccaccctaggtccaatgctcacatatatggggagacgtgctctgctacaagggtttgtgatgaaggattcattctcttcattattttgcaagaattgatattatctttaaagcaaaactaggaatgcctttgttctccagatatcaggatatctggacactcccaagtgtgggtctgtttagtaactgttaataatttgttcccttaaccgtaaacatctggaggctcggaattgcctacatttctcagaatgcagcccagcaagtctcagcctcattttcctagcccgcactcaaaatggagtcgctctggttcaaacacctctgacagagtcctgggggaggtgcggacacagactcaggggagagacctgaactatcttaagatggtcctaggctgagggtaggattaccttagggaaaggaccagagcccatagtaggaatcggagaatatggattggggaggactctagaccccatgggagtgagtttgacggggcagaggagtggctaatgggcatgggagggcctggctagagctcagggatgaattctgggagagaagggatagaggcctggagagaggccttggggctgggagaggactggagtgctcctgagagcagctgcggagatggagggcggacgctacatcctgcaggagagccttaggcacgggggatggtggtgtggttagagctcaggggtgtcctataaaggttggcaaaggatccagaatatagggttgaagtcctgcttgtttgatttacctcaagggtagggttacgtttcaatcaaagctgcttagttctcggattacaaatacctcagcattaggttaaggattcagattctccaggggtggtggggaagtgagggagcatgtttggggaaggggttccagacccaggtttcagagctgggtatctttctggtctaggcttcagtacccttaggaatcaacctcataggcggcaccgtcctgcttagtgcccctttcccctgtggaccctacgccagcctcagcagaaggggcccagggtcccttccttgccaccaagagcaacacgcatggtggggccactgctcttcccagcattcccgcataaacagaggaggagctgggtggggtaaggagaagggcaggggaaggagtgtgaagaggagaagcaggtggaagacagtgagaggaggctggaggaatgtgggagtaggggtagggagaatactgagaaacgaggaggctgtgcagaaaggcagcactggcctggccttacaggacacagccaaggcacaggaagacagcctgggtggacagggttagttcccagaaggaaatatgggaagaatgtgtgtcaggcaggactcttggctcaaggagcaaaatccaaagtttatataaaaagcccagaggtgggccaacgcggtggctcacgcctgtaatctcagcacttcgggaggctgaggcgagtggatcacttgaggtcgggagtttgagaccagcctggccaacacagtgaaaacctgtctctactaaaaatgcaaaaattagcccggcacaatggtgcacacctgcaatctcagctactcgggaggctgaggcaggagaatcacttgaaccgggcaggcggaggttgcggtgagctgagatccagccagtgcacttttttgagacagagcaagactccatctcaaaaaaaaaaaaaaaaaaaaatcccggaggtggccaggcgcagtggcccatgcctgtaatcccagcactttgggaggcctaggcaggcagatcaactgaggtcagcagttaaaaaccagcatggccaacttagtgaaaccctgtctctactaaaaatacaaaaattagccaggcgtggtgacccacgcctgtaatcccagctactcaggaggctgaggcaggagaatggcttgaacccaggaggctacggtgagctgagatcgcctcgctgcactccaacctgagctacagagtggctaatttttgtatttttagtggagacggtacagtggttcatgcctatactcctagtactttaggaagccgaggtgggcagatcacctgaggtcaggagttcaagaccagcatggccaacatggtgaaactccgtctccactaaaaatacaaaaattagccaggtgtgatagcgcatgcctgtaatctcagctactcaggaggctgagacaggagaatcgctggaacccaggaggcagaggttgcagtgagccaatatcgctccactgcactccagcctagccggcagagcaagactccgtctcataaaaaaaaaaaaataataataataataaagtttaccctagcttgggcaacatagtgggattctgtctctacaaaaaataaaaatattagccaggtgtggtggtgctcacttgtagtcccaactactcaagaggctgaggcaggaggattgcttgagcccaggaggtggaggctacagtgagtgatgattgcatcactggattccagcctggataatgacaaaaaaacaaacaaaacaaacaaaaaccctacaaagagcagtaacaacaacaacaaaaaaaaaacagggcgggtacagtggctcacacctgtaatcctagcacttggggaggctgaggtggacggatcacctcaggtcaggagtttgagaccagcctgaccaacatggtgaaaccccgtctctactaaaaatacaaaaattagccgggcaaggtggcgcatgcctgtgatcccagctactcaagaggctaaggcaggagaatcgcttgaactcaggaggcggaggttgctgtgagccgagggtgtaccacttcactccagcccgggcgacagagtgagactctctcaaaaaaaaaaaaaaaaaaaactacaaagagcagtaaaagccatggggtaaagggtaaccatgaagtcaaagagctttactaaagtaagtcattattgagccgggcttggtggcttacgcctgtaatcccagcactttgcggggctgaggcaggcagatcacctgaagtctggagttcaagaccaaccaggccaacatggggaaacctcatctctattaaaaatacaaaattagctgggtgtggtggcagatgcctgtaatcccagctacttgggaggctgaggcaggagaattgcttgaatccgggaggcggaggttgcagtgaaccgagaatacgccccattgcactccagcctggacaacaagagtgaaactctgtctcaaaaaaaaaaaaaaaaaaggaggtacatgagttgtacgcaaaagctacaaaacagttgaagttgtagaataatttttttaaaaaacctaaataaatggaagggtttttttttgtttttgagacggagtctcactctgtcgcccaggctggagtgcagtggtgcactctcagttcaccgcaacctccacctccccggttcaagagactcctgccttagcctcctgagtagctgggactacaggcacctgccaccatgcccagctaatttttgtatttttagtagagccagggtttcgccatgttgaccaggctggtcttgaactcctgacctcaggtgattcacccgccttggcctcccaaagtgctgggaatgaaaggatatttcatggtcctgaattggaagatttaatattgttaagatgatggctgggcacggtggctcatgcttgtaatcctagcacttggggaggctgagggaggaggtttgcttgagcccaggagttccagaccagccttggcaacatggcaagatcccatctctgtattatttttttaaataaaatttcaaagataacaatattacccaaagcaatatatacatattcaatgcaatatcaataaaatactcaatgacaattttttgcagaaatggagaaaccaactcttagagttgtatggaatttcaagacaccccaaatagccaaaataaagaacagtggaggactcacacttctggatttcaatttttttttttttttgagacggagtctcactctgtcacccaggttggagtgcagtggcatgatctcggctcaccacaacctccacttcccaggttcaagcaattctcctgctcagcctcccgagtagctgggattacaggtgcccaccaccatgcctggctaatttttgtatttttagtagagatggggttttgctatgttggccaggctggtctcaaactcctgacctcggatgatctacctgcctcggcctcccaaagtgctgggattacagatggagccactgcacccggcctggatttcaaaaaaattttaaaaagcaatagtaattaaaacagtgtggtatacgataatggcaaaaggatatacatacatggctggcgtggtgttgtgcacctgtaattccagctactcaggaggctgaggcaggagaatcgcttgaacccaggaggtgaaggttgcaatgagccgagattgtgccactacagtccagcctgtgcaacagagtgactttctgtctccaaaaaaaatttttttacttaaaaaaattacataaatattatatgtataatatctaaaaaacaaaatacaaaaatagccagatgtggtggcacccacctgtagtcccagctactcaggaggctgaggcgggaggatcacctgagcccatgagcccaggaggtcgaggctgcagtgagctgtaattgcgccactgcactccagcctgggcaacagagtgagaccctgtctctaaaataaataaataggccgggcgcggtggctcacgcctgtaatcccagcattttgggaggctgaggcagggggatcatgaggtcaggagatcgagaccatcctggctgacactgaaaccccgtctctactaaaaatacaaaaaaaaaaaaaaattaggtgggcatggtggcgggcacctgtagtcccagctactcgggaggctgagacaggagaatggtgtgaacccaggaggcagagcttgcagtgagccgagatcacgccagtgcactccagcctgggtgatagagtgagactccatctcaaaaaaaataaaaaataaataaataaatacaagctagaagggttttgaatgttcacaatacaaataataaatgtttgaggtgatggatatgctaattaccctgatttgatcattacacattgtgtacagaaatcaaattatcactccatatcccataaacacatgtaattattatgtgtaaaataagaaataaagaatttatgagaaattatttgctacagagcagacatcattgtctggagaggcagtaattacacaaagttatagaagccgaggagcaattgggaaggttctgatctcttttaggcacctgtggctgagtgaaactcatcaccaaaacaagccccatctgaacccatgcacgcagcaagatcaacagaataactctgcgcacatttcacaggctctttggacaaatgtatggggtgtcctcacctgagtttgcactaaacctggagtcatttatttcacaagttttcacaacaccaagggtcagcaaactctctgttaagggccggttagtaaatattttactagacacatattttgcagggcgcatatgttctctgtcatgtagtcctctttatttttacaagctttaaaaaatgtgaaaactggtagggtatggtgagtcacgcttgtaatcctagcattttgggaggccaaggcgggagaatctcttgagttcaagagactagcatgggcagcattgagagacctcatctctacaaaaaatggaaaacttagaagggggtgatggcgctcacctgtagtctcagctactcaagaggctcaggtgggaggatcccttgagcctgagaggtcaaggctgcagtgagctgtgatttcagaactgcactccagcctgggagtcagagtaagaccctgtctcaaaaaaaataaaaagaaaaagaaaagaaaaaaagaaaaatgtgaaaaccactcttacccctagaatgtacaaaaagatcctggaacagtggtgcacacctgtaatcccagcactttagaagccaaggcaggacgccccgtccgggagggaggtgggggggtcagccccccgccaggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagactttttattttgttctgtactaagaaaaattcttatcctgttgatctgtgaccttacccccaaccccgtgctctctgaaacatgtgctgtgtccactcagggttaaatggattaagggcggtgcaaggtgtgctttgttgaacagatgcttgaaggcagcatgctcgttaagagtcatcaccactccctaatctcaggtacccagggacacaaacactgcggaaggccgcagggtcctctgcctaggaaagccagagacctttgttcacttgtttatctgctgaccttccctccactattgtcctatgaccctgccaaatcctcctctgcgagaaacacccaagagtgatcaataaaaaaaaaaaaaaaattaaaaaaacaaaacaaaacaaaacaaaaaaaagaagccaaggcaggagaatcactagaggacaggagtttgagaccagcctgggcaacagagcaagactctggcctgggtgcagtggctcatgcctgtaatcccagcactttgggaggccgaggtgggcggatcacctgaggtcgggagtttgagaccagcctgaccaacatgacgaaaccccgtctctattaaaaatataaaaattagccagtcgtggtggcgggtgcctgtaatcccagccactcaggaggctggggcaggagaattgcttgaaccagagaggcagaggttgcagtgagctgagatcgcaccactgcacttcagcctgggagaaagagtgagactcccagttaccggggaggctgaggcaagagaattgcttgaacctgggaagcagaggttgcagtgaactgaactaggaaagaaaaaaaaaagatggggttttgctatgtttcccaggctgctcttggactcctgggctcaagtgattctcccacactggcctcctgacctcaggtgatccgcccaccttggcctcccagagtgctgggattacaggcttgagccactgtacccagccccctccaggatttttacagttggacatctcacatttaaatctttagtcttgagtcaatttttcaatatggtgaaaggtaggagtccagtttcattcttttttcttttttttttttttttttttttttagaaaatcctaggccaggtgcagtggctcacacctgtaatcccagcactttgggaggcccaggtgggtggatcacttgaggttaggagttcgagaccagactggccaacatggtgaaaccctgtctctactaaaaatacaaaaattagtcggttgtggtgatgggcacctgtaatcacagctactcaggaggctgaggcaggggaattgcttgaacccaggaggcagaggctgcagtgagctgagactgcgccactgcactccagcctcggtgacagagggagaccctgtctcaaaaagaaaagaaaatcccgttaattattctaccaaaaagacatgtgtactcatatgttgattgcagcgctatgagtgctgacagtctcactctgtcatccaggctggagtacagtggcgtgatcttggctcactgcagcctctgcccaccagactcaagcaatcctcccacctcagcctcccgagtatctgggactgcagacacgtaacaccactctcagttaatttttctttaatttttgcagagacagggtctggccatgttgcccaggtcagttttttttttttttttttttttttgaggcagagtttcactcttgttacccaggctggagtgcagtggcgcgatctcggctcaccgcaacctccgcctcctggtttcaagcaattctcttgcctcagcctcctgagtagctgggattacaggcatgtgccacgacgcctggctaatttttgtatttttagtagagacagagtttcaccatgttggtcaggctggtctcaaactcccgatctcaggtgatccgcccatctcggcctcccaaagtgctgggattacaggcatgagccaccgtgcccagcccgcccaggtcagttttgaactcttggactgaaagtatctcatcttgccctctgaaagtgctgggattacagacatgagccacactacaccctgcccagtgtcaaccttctgcatatggctagccggttatcccagtggcatttattgaataggaagtcctttccccattgcttgtttttgtcagttttgttggccatcagaaggttgtaggtgtgtggcttcatttctgggttctccatgctgttccattactctatgtgcctctttatttttattttattttattttatttttttgagagacagtctcaccctgtcacccaggctggagtgcaatggcgcaatatcagctcactgtaacctctgcctcccgggttcaagcaattctcctgcctcagcctgccaaatagctgggattacaggcatgcaccatcacgcccaggtaatttttgtgcttttagtagagatggggtttcaccatgttggccaggctggtctgaaactcctgacctccaatgatctgcccactttggcctcccaaagtgctgggatcacaggcgtgagccactgtgcctggcctatgtgtctttttgtaccagtaacatggtgttttggttactgtatacttcttttgttttacatttactggcttattataaaggacattacaaaggacacagacgaagagatgcataggacgaggtatgggagaaggggtgaggagtttccgcgccctccctcggcacactaccctccaggaggcatccaagtcttcagctatcaggaagctcctagttactgtttccttgtacagtttgaagctggaatgtcatgcctccagttttgttcttttggcttaagattgctttggccattgggctcattttaggctccatatgacttttacaatagtttttttttttttttttttgggacagtctcactctgtcacccaggccggagtgcagtggcgtaatgtcagtttactgcaacctctgcctcccaggttcaggcaattcccctgccttaggctctcga

SEQ ID NO: 214 - DNA, 25869 bp, Homo sapiens
actttgggaggctgaagagggtggatcacctgaggtcgggagttcaagcccagcctgattaacatggcgaaaccctgtctctactaaaaatacaaaaattagtggagcatggtggtgcgtgcctgtaatcccagctactcaggagacagacaggagaattgcttgaaccccggagacagaggttgcagtgagtcaagatcgtgccactgcaatccagccagggtggcagatttttaaaaaaaatctgcagtgagtcaagatcatgccactgcaatccagccagggtggcagatttaaaaaaaaaaaaaaaactaaacaattctctcaggctgcagagtttagtagagaccagagggattaagacaggatgtgggagacaatttgggctgccatttctgttgtccaggtgagagttgattagagaccggatcagggaggtggaggtgaagatagaggtggacaggtccaagggcaggtaaaatcaataggaatcagggatcctcaaggcagtggcaaaaaatctcattatcttttcctttcttcctctagacaatcttctttcagaccatgctaaagaaaaaggtaatgatataaaagagtaaggggtagggaacaaaaaacacattctttatttttctatgtaaatgttgacagtcattattataagtctatttttataatactgtacacacatgcacacatatatcctccattgatattactggaatttagtgtgcaatgttaaggggctgtggagcttgtggcagtgggtaaggaggtgcccaggtcaaaattcacaggcctagattaccataaactcccttcattagcctttccgccaaccattttaaaaagaagtctacatattattgaaaagtatattaatgtggtcatatgggatatatgggaatttcaagaatccacacaacctttgcatagagagaggtggtatgatacaaaggaagggtcgcaggctctggggtcagtgacacctcagatcattggtctgccacttaggttttggtttcctcatcagcaaaatgcagataacttccccttacctgattgttttcagtgttaaaacaggcaaccttaaaaaaaaatctgtcacagtgcctggaactccttttccttattgccattttgtcttcattaatttgacatttactgtgggccactgagttggacaccttgttgaagtctatctgggaagacaagtcactggctcagatgactccagattcaatgatgtcagcgtctcctctcttccctccttacatttcctccaagctggtgcaagcgtggcgtgtatctggcagacactggctgttctgctcaagtgaagagggaacagtgtggggtaagggagagggcctctaactcaggagtcagacagacttagattgaatcctgcctccttggtcacttactagctggaagaccttgggcaaattttgtgtccctttgagcctcagaccacccccctataaaatggcaataataattctaggcatctcacattattgagaggattcagtgcctacttcagtataagcacagcagacagtaaatggaagctgttagtagtggagatggtaacaataaaccataagctccttaggagccgtgtcgtattcggctgcattgctccaatgcctaatgcctaacacatgcccggcccttagcacagggactggtggtggactcaggatgtgtaacttcaattgtctagcagggccaatgctgggtagggggaaatgtgggccacatggccctccagagaagctgcaagtactccccagaaacacatgtctcatacacatgtccccaaatcttctgggacctccaatttgtgaaatttataacctcaggggagttactgtagagaataatacagccatattaacaagttcatgctaggcctttagctagttttacaccttagataccataaacggtgggctataaaaggacagcagtgcatacactcatgtaccgcagttacaaacatatagaaacactcatgccgacagcagaaatgaaaccagacagatgaaaaggaggggaaggggaaggaggaaccaaagtcccgggcaggctgggtcactgggacagtgtcaccagcaccatcagatttctgggtctgaactctgggacacggagctggactagggacatagaagcgtcaccatcattttaatcttgtgggttggagtgatgaggctgccacagctctgaggaaaaagaggcaggatctgatcactcactcttctctctctttctggtttttaggaaaactccataaagctgtcagtaagttttgctcctcatccatggcacaagctccttctgctgacacttttgctttgggatgagcatctcagtttcacttcctggggcagaagggagggggtactggtaattcaagccatggggactggggctttcttggctctcaaaggcctcttttctcaagtattctctgctcctctttcctgcacaactattatttagtctttaaatgaaaaacgtttcaccaggaagagatagatgcatctcccataggtgaagccatctggaagtcccttttatcacccaggcatgacatttccttagatggggtccaggaggacaggatccttattaaactgaatatgctggagcagtacttctccatcatttcatgtgtgaggacctctttttaacattaaaaaaaaatctggccaggtgcagtggctcatgcctataatcccagcactttgggaggccaaggcaggtggatcacttgaggacaggagtttgtgaccagcctgacaacatggtgaaaccccgtctctattaaaaatacaaaattagctgggtgtggtggtgcacgcctgtaatcccagttacttgggaggctggggcaggagaatcgcttgaacctgggaggcggaggttgcagtgagccgagattgcactattgtactccagcctgggcaaaaagagcgaaactccatctcaaaataaaaataaaaataaatctgtagacatgtgacatatctatgcattaattattacattgagaaaatatacatgatcacaaagtccaatactcagtgatagttttaaatgaagtaatatttcctacaacatctacataatttatgttgtcattacctgtaggtgtgagatgtgttatttatttagcctgcagataaggtttggctcacataggaatttgctgatcctctgcagtatctctggggatactcccatggtccacagctgggatctactgctcttgcaaactcttctggggaagttccagggtatagctattgagtatctgtctgctcatggttgggatgggactgtagcattatgggagggcctctacatagaggccctccttctgatttgccaaattgttttcattctttagagaaactccggagtgaactgagtaagtttcccatgttcttgtaacttccgtaccaacttatctcctgttgccctaatatttgcagtgatagctcattccccttgtttcttctttcatagagttgaaaagagctgcagcaaactcaggtgagatgcactttctccacatttgaccaccaccctacaggagttcttgatgtctctggtactttaatgatccccttttctcatttttcaggctggagaagagcccggttgcattttggtaagttataccaatcaaataggtccatatctcagagcacttcctccttatggctttgtaaccttagattttgttccattcctctggaatgcaggtaatttaaaaatttttaaatcaaatctgtatatctgactatcaaattaaaaaaatctttgtgatcgatcttgaggtcatatttagatttagaaagtatcccctcttttagagcactgataatattaggtttggtcttcttaagggttttctgtggtttttgagatttttcctatgtttatcagttatttgtatttcttctttgtgtgacttgtctgttcctgttctatttgggcttttttttgatttgtgaagactctttctagataaagtatattagctctttgtcatatttgtcaccattacttttcatttgtacttccttatagtatttttctgatgcataagtgttttatttttacgtagtcaaattcattcatctttttctgtgtagtctcttccatgctttcaggtttgggaagtccttcctatcccacaaccagataaatagccactgcttccgcctctttctacacatttgctttttcttctttctctgcagaccaatttgcttaggggtggtgattgagattctcagagaagaagggaatgggttgagcagatgccccaacaatatacattatgaaaagatttgcacctctctttcaatgtattcctaaatagtttgcattttttgctgctgttcaaatgggacctgtttttttcactgctttgggatccttatcaattttctaggcttttatcctcctcctgttcacaccatcttccttcaggcagagtacaacaaattatgagttggccactcgagagaactccaggtcaccttggctggcattctgggaacttacaaacccttctgtctcacatttacagtctggcttattgccaccatctcaactgtgtatggtttatagacttaactctctaagaagaagctgtttcctgtatttggggaaggaaggagactcactgtgacactcataatccacaattttagggaagaatccttctctctatattaacatttaaaaataataatttcgtcctacgtacttgggaggctgcagtgggaggttcacctgaggccaggaattcaaggctgtagtgtgttatgactgcatgcccatgaatacctactgcattccatcctgggaaacatagtgagacccttcctcaaataaaataaaataaagcagataattataagtaataattttaggtgacagaatgaatatcatgcactcactgtaggaatgaggcactatatcattagttcatcaagtctgcacaatagctctacaacacaggttctgttactatttccattttacagatgaggaaactaaggttcagagatgagtaacaagcccaaggtcacataactagcatgtggcagagctgggattcaaacatgctatgtggctacaggatctaacaacaaaccctgtatttatcatcacacatttgattattttggaacatcaaagacaaatgtggtgtcttactctgttttctgttgctataacagaatacccgagactgggtaatttatcaaggaaaaaggtttatttagctcatggttcttggggctggatggtccaagattgggcgactgtatctggtgaagggcttgtgctacttcatagtatggtgatagttgcttctggaagaacagaagggcaagtgagtgcctccaaaagcagagaggagacaaagtgccctgacctgctttatcataacctgctctccagagaaataaacccagtgttgtgaaaactgcattcatctctttgtgaaggacccaaacacttcccactaagccctacctctgaacactgcagcaatgagggattaaggttccaacacgtgaacttttgagggacacacttaaatcataacaggtagttatttcctgaggattaaagcagtttcacagacagatgaagaagaactttttcttctattacttagtaatcgaccaggagacctattctttgaaagagaatattctttggttccagtacacatggtgggggcgggaatccatgaactaaaatgggctaatgacagtgatggcagacctaagattctttttccctccaaagccatccccaaatcccttaagacctatacttccaagcctcacctgtctgtgtctctttgcagtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgttttggtatgctgttattttcattgtgaatgaggagttgtggggaaggtaagagattggtttccaaagagctttgagtcccccaaggcaaggtttagccaccgttcatactaaagccatagttttattcctgagtctgctctctagtattttattttatcaatttataaacaaatagtgttcataaggcacacatatttcactcaaccatattcagttccaaacatgcattcctgaatatcccaatcttaaaactaactcacattgtcagcttgtggaggcagaatacatgcatacatatacacatacatacatgaatatacatataatatacacacacatatgcatacatacacatatacacatgtatacatgtatgtgtatatacatatctgtactacataggtgtatatatatgtatatgtatttagcatgtatgcacgtgtatatgtatacacatatatacatatgtatgtataatacatattcacacatgtatgcatgtatatacacatgtatacattagtatatgtatatacacatgtatgtgtattatacatgtatatatgtacatacatatcagtctactgatttgaatattaatgtcatcaagaaataacctcaatatatgtatgtattataaccttacaactatataaaacatacatacatatatatgtatatatgtatacacatacacatgcatgagaatatatgtatgtatatataatatcctcacagtaattctgccagggattttatgggggagggagttggtactccaaatggctaggtggtagagccagagttttatacttggtttatctagctctgaaggcaatgctccttgttctttgcactgaaacattgtgcagatacgagaagcctgtagtttacgtatttcattagccttttattattttaaaaaataaaacctgaaaaaaaagacctagtcctggatactttggtgatcttgttgtgtctggattgacgaacacgtgtcaggcttaattagggatgcacgcggaacccgggaaaatccctgctcaggggggctggaagacctggaggttgatccttgaacagggtacttttagcttctccgataaggagattgggttattttatctttaaactcccttccagctctaccctcctttgattttaagttataaaccttgagtgaggtgccagactctaggcttcgttggacgtctacaggacggtcaaggattaccaactcaaagtaaagaaggaaatttgagtacttgcccccttggaggttgtgtaggttggctatacagattctacaacttcccagacgagtggccctgagacttggggctgaacgcgcgagcacggaaagaaatcccaccgtaggacggaacccagtctcttcagctccatcctaaacttcgcaagttttctctgagtctacgcgcttccttaggactacaactcccagcatgccacgccagcggtcaaagcttattggtggtcctgccaggtcgcttgcgttgtggcagtcatggtagccaatggaaataaagaattatcccaagaaaccaatcctggagtagtagggcggatccttcctgggttccggctccggctccagctccttccctcgcctacagaggcggcgctgtccctgatcgagcggcgggagcgaggtgggtccgggttgggcccgaggtcgcggggggaggcggacacgacttcgcgggaaactctgtacacggccacttccctctcaccgaggatctggatgctgctgctttgctccctggaccgagtgggaagccaaggggccttgtggtccctccgccgcgaccctcgccctggcccccggcccacgcagccaggtggctgtccccaacccattccccggcccttctgttgggtttgagtatacagccttcctgccgctgaccatacgtttaggatcagcccctcctcctctcccacctctctggccccaagcccgccggcaatctctgaaaccagctcttgtacccttggacctccgccattggcttctccccgccccgcaacacacaactcagctcttgggccctggcctgtgacacttctggcagcctttgcttcctcttccctgaccgtctcctgcgaccctctgacttccttggtcctcctgtatctctgacccgttatctagcttccctgtacaattaccctgttagcaccttgctcttggtctttcatagctcctctctcctcttcctccctgcagcccttgacttggccccaaagacctgtaacttcggacctccataccgcactatggcttggccccttgcctttaacctaggcgcttcaccttcatcatctgtgatcactagccccatcttcttggctcttaacttcttagacctggcccctcctccacttctcagccccttccaccgttgcttctctctgtgcagctgagccaccaggaagacaaagcccaatagaccccttttccccccagatctctgcagtgtgatatgaaagtgcctctgtacttcagctgcactgtcttctcagtaggtagttgcctctttatctctgcaagtcccagtcttacccatcctgcaaaccttaggtcaaatacctactcctccttgaaacttctcagccctgatttcatcagggagatacatctgtatcatgtgaacttcagtggtactgtttttatttccttccttcccgtcttctctccttttttccttcagtaatagtataatggttaaaagcactgactttgaagtgatgggcataggccccagttctgccacttacttgctgtgtgcccttgggcaagatacttaatttctctgagcctcagctttctcatctctaaaataaggatgatgtgaagtgaaattagatgattcatatatggtccttagtccacagcttagcacttgattcgagctttaaaaaaatgttaataatgtgccaggtgctgtgttagacactgaggagtgggtacaaaggtgactaaggcacagttcctgcccctgtcccctgaacttaaccttctgcattgtatgacaatttctggagttcacggtctgtttcagtacactgtatcacaaactgagtggtaatcataatcctaaatccttttgctcttacattgacctagcatccagccccgggtagagctggaacttggtaaattataggttctcagaatagcagtttcggaagtgagtggaggctgaatagctcattgcgtagagatactgtagctgtaggtcagatgggagcagggcagggggtgggggatgggatggtggcgtgaattaagatcacatcctgtcacttatacattcaaaagacatttgagcacccagctttatgctgcagaaggagattactaatatgacccagtccctttcctcaagttgcttataaactactaatagaaacagacatgttctactagtagttgcaaaccactataagccaagcacaagattctgtgactgcataaaggagaaagtaggcaggaatcaggagattgctgaggaaaagtgggtgagacagttcatggttacttgtgtcccatgaagacagagctggtgttttattcaactcattcaacaaatacttatgaaggatctactgtatatggctgccactactctaggagttttggttacattggtaaattaaaaaaaaaacaaaaaaacaacaaagacaccagctctcatggaacttatgttttagggaagcagacaataaataatagacataaagagaatgtcagaaggtaagatgtgctatggggcaggaggactgggagtgtgggagtgattttaattttttaaaggatggtcaggaaacagtgtctaagtatcaaggaatagtttctcatgtttacttgcatttttggaagtaaagcaaaccaattatttttcatattcttatctaaattcttcaaggaacactaacagggattggcaaaccacagctcacctcctgttgctttaaataaagttttattagagcacagccacacattcctttatgtcttgtctatggctgctttcatgattcatgatacagtggcagaattgaatagttacagcagatatcccatggccataaatatttactaaatattatctggccctttacagaaaaagcttgtcaacctctggttcttaaagagttgaggttctgtctgtatttcacattttagaaggttatatacagttttatgctatttttaagttaaaagttttttcttaatgagatcatttaaaagatctttttcttgtattcttcacagggcctggacgtagtgtcttcaacagttgtaacagcagctgccatttgctgaatgacagcatgtgtcacacactctgctgagtattacaggcatttttttctaatacaaagtcttgtagtgtgggtaggtatcacaattttagtgaagagggagtttaggctcagagtggttgaataatttgcagagagcgataaagatagtatgtgtcacagttgtaatccaaccctaaatgtagtcagtacccctttctttattctgtgtttcttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagaggtacttttccccccaactctttccctgtccttggctgtaggaacccaaaggagtctgtgcagcttagcacacattagtgatgtttgcacaaatcaggacctgtactgggcactcttatgtgtttagttttggggtggggtgtggggagtgtggtttgtgtgtctgtgtctgtgtttatctttgtgtgtacttggtatgtgagtgtgtgtctgtgtgtggtgtatgggtatatgtgtatagacatgtatgtagctatatatgtgtgtggctgtggtatgtggctatatgtggtatgagtgtgtatgtagtatgtatgtgtgtggtgtgataatgtatggctgtgtgtggtgtgtaggtgtatagctgttgtgtgtggtatgagaatgtgaccgagtatgtcaggtatgtgagtatgaccgtgttacgtgagaatatggctttgtgtatggtgtgactgtgtctgtgtgattctgcttgcttgtgtgcatgcatgcgtgtgtgggcggggggtgtgggtggggctttgtatggtgtttgagaatgtagtggagggcactgactgatcagaagaaacacagcccaggccccacagtaggtcctggaggtcccaggtattaacccagatgtttacttgctagattctggtgtgggctggagaggggtagagtggcagaaatctcaagaaaagccaaagctgggccttgtcacctaggaaagcctcaagatttagaggttttgttttgttcattttgaaagcaggcatataggtagatacttgtaaggaaggtttttcaaaaaggattaaacataaaaagagttacagttaacttacagttaggcagaaaaattgaacttatcccaaaatgaaagctcttttacttgcccatgaattatagtctggattgtcattgcttagtggtttcaagaagagtgacattattcaaatggcacaaatatcatctggtggtggtggacaaagccggtgccttctttttgctctggtgggtagctttaaatatctctgaaagtttgtcacttaaaaggtagcaagtaaaggtattctatccaagtattccagttgattgaggttatttctaatggatggtcccatggggaaggtgtatacccttcaaactgaacaaaagattccctgtgatctggcccaacccaaagaataaaggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaggacccgtgtacttatttggggaagtggggagctggggagattgtcccactgaacccactctggaagggatttgaattctaagaaagacagatgggtagatgctctgaaaagcaaaggaaagcagactgagtttctggggcctttgaggagaagggggaaaggaaaggaactaacattaattgagcatccactacatgcgattaattctgtcagtcacatttacattcattatctcatgtagttctcacagcaactctcaaaggaataagaagaggacatgaaagtgagggaagataaagtcacttgctgtgaagtcatacagcaagtacgttgtggagcagagttcaaacttgggcctccctgactgccagctgttgctcttttcactacatttaccttttggcttctgaaggaggagccacttaggagacttgcctggagttaggagccagtgtggcctcttcatatggccttgggccatttgctctatggcaagtcagtgccaagcatgagaacgttttcaactttattttattttgaggtcaactttattttattttgagacaggatcttgctctgtcgcccaggctggagtgcagtggtgtgatcacagctcactgcagccttgatctcctgggctcaagtaatcctcccacctcagtgtatggagtagctgggactgcaggtgcacaccaccacacctggcctcaatgttattgattgagcacttactctgtgccaaggaaaaacggcagtgacggggagtacagggtgaagggtgggataaggtgagagaaatcttaaaacccataatgagagtctttgcttttagtagcaatagtttagtcctcaaggctggaacagcttagcagggattatgtctggtttcctgtcctcctggtttaggcctggctccacatggcagatttcagtgttttctacatggaagtttagtgttcacccagttttcctctaacaaatacaaaagaacccttcctctaacaaatacaaaagacccctatctacctctcttgtgaatctggggccctactcttccagagtgaggggccctcttcatttgtagccagttggcagagtgtgattctggcaccgggcttggaactgacatcacccataaccttacctaacatggggaccctgccgttcaccagtaagagatgtgccaggaactttacactcattattgaattctcacagcaactaagagtgacttgcatttgccgtatgtagaaataggctgataaagaaagggacttgcccaaggttacagagcaagtaaatgcggggtgtaggacctgaactactgcccaaattcaagtcctgtattttatccaactataaaagacttcccaaatgattcatttatatttatagggtactttactgtttaccaagcacttttatttcatacacattttctgattccttgaaaatctccacacaatatattttaaacatagtcacccaaacttgtgtgtgtgagttggcacacaccctaataataaaaatcaccatcttttaaatacctactaagtgccaattattgtacaactcttatctctagtcttcatactatcctgtaaggtagtaatgtccccatgttcaaggcaagaaaattctgtgagattaaataaccagacctattggcagagtggagacttaattcaggtatgtctgatcccaaggtcaagctcttcattatacccactatcaagctaggtctacagatcccctctcagtctgggaagcttagtctgactccttcctgacttggagactttgtgacaaccactgtgatttttttttttttttttttttttttttgagacagagtttcattcttgttgcccaggatagaatgcaacggcgggatctcggctcactgcaacctccacctcccaggttcaaacgattctcctgcctcagcctcccgagtagctgggattacaggcatgtgccaccatgctcggctaattttgtatttttagtagagacggggtttctctatgttggacaggctggtctcaaactcccgacctcaggtgatccacccgtctcggccttccaaagtgctgggattacaggcgtgagccactgtgctgagccccactgtgacttttataattatgagtgtctgctgccagttgggcctacgaccaatgtaccaggctcctgctttgatcttggaacaaagctccccagccaatctcacttgtctctctctcttttttttttttttttttttgtgagatggagtctctgttgcccaggctggagtgcagtggcgcgatcttggctcacggcaacctctgcctcccgggttcaagcagttctcctacctcagcctcccgagtagctgggattacaggcatgtgccacaacgcccggctaatttttgtatttttactagagatggggttttgccatgttggccaggctggtcctgacctcaggtgatccgcttgcctcagcctcccaaagtgctgggattacagatgtgagccactgtgcccggctcacttgcccttttttgaccctaacttatatgctaacattttttgttttagtcagtgcttttgagtcctgactagtccttttattcactgtctaacttccttttaaactttattttatccttcattccccttattttttccctttctccctcattccatctactctttcttctcttcctctccctcttttcctccttccctcttagtaacttgtaatactgacattgaagacaatgtggcccctgatttctagtgtaggagattgccacacaaatccagagttgcaatgcaggatggtaggtatcattacagttgtacccaggatgctgtagaagccgggggagtgccttaacctggcctgtactggacagtggggcccagaagtgagtaagacatagtccttcctggctgggtgcggtggctcactcctgtaatcccagaactttgggaggctgaggtgagcagatcacgaggtcaggagattgagaccatcctggctgatacggtgaaaccccgtctctactaaaaatataaaaaattagccgggcgtggtggtgggcgcctgtagtcctagctactcgggaggctgaggcaggagaatggcatgaacccaggaggcagagcttgcagtgagccgagatcgcgccactgcactccagcctgggcgacagagcaagactccatcacaaaaaaaaaaaaaaaaaaaaaaagacatagtccttcctgcaaggaacgcagaggaagtgaaagtactctgaacaaggtgctgggggaacacaggtgggaatggttaacttcacaggagaggggaatctgaaaggatgattgaatttggtctgaatgaataggtgtttatagcagagaaaagagaggaaagggaaagtttatttcagacagaagggaaggcttagtgttttaggaaataatgaaatgtttgatagtgtgccctgtgtgaggaggagaggaagcccttgtgttggatgccagggtaagaaattttggattgtggacaataaggaattttaaagctggggaatgacatgataatattcactctttatttaggaaaagcacttgggctagtgtggaggatgaactaaagggggatgagtgatttggaaacatgctgtctgtgtaaaccaggtgccaattaggaccctcctgatccacagagagttctgtatgattgcctcagagcattgccaattccacaagatgggaaagttcaaactttccacacaatttctgcagattccttgggtttatgacctcataatctcttgcctgagattcctgtgatctgtacaaaccttttctattttgtccccattagtcctgtcacagaactcagctcttttgataagtttagaatccttcctagagattgagaatcttagtgaggagttacattaaggcatgtgagtagcttccaattctgtcatctctgcttgcctccccaccctctctctggattgccacaataagactagggtgcatcattgttttttgtttgtttttctgagataaggtctccctcttgcccaggctggagtgcagtagtgtgatcacagctcactgcagcctccacctcctgagctcaagcaatcctcctacctcagccaccccagtagctgggaccacagatgtgtgccaccgcacctggctaattatttatttttgttagagatggtctcactgtcaggcctctgagcccaggctaagccatcataacccctgtgacctgcacgtatacatccagatggcctggagcaactgaagaaccacaaaagaagtgaaacagccagttcctgccttaactgatgacattccaccattgtgatttgttcctgccccaccctaactaatgaatcaaccttgtgacagtcctcccctggacaaagagtctcaggagctccccaccgagcaccatgtgacccccacccctgcccgcaagagataaccacctttaactaattttccactacctacccaaatcctataaaactgccccacccctatctccctttgctgactctgtttttggactcagcccacttgcacccaagtgaaaataaacagccttgttgctcacacaaagcctggttaggtggtctcttcacatggatgtgcgtaacgtttgatgccaaagaacccgggacagggggactcctttgagagattggccccctgtcctcaccctcacttcatgaagagatccacctatgacctcgggtcctcagaccagcccaaggaacatctcaccaatttcaactcaggtaagcggtctctttgctctcttctccagcctctcttgctacccttcaatctccctatctttccaatttcagttctctttcctttctagtagagacaaaggaacacattttatccgtgaactcaaaaactctgacatcggtcatggatttgggaagacagtcttcccttggtgtctgatcatagcagggacgcctgccttgatcattcacccacattccattggtgtctgatctccatggggacgcctgccttgatcattcacccacattccactggtgtctgatctccacggggatgcctgccttgatcattcacccacactcccttggtggcaggtcaattgcagggatgcctgctttgcctgttcactcacattacagcccaggactcagtcaaggatgcctactggaagcctggtaggtgcccacctccatttctccatgtctctaccttcctctttaaacttaccttctccattatgggcaactttccaccatccattcctccctcttcccccttagcctgtgttcctaaaaacctaaaaccccttcaactaacacctgatctaaaacctaaacatcttattttcttctgtaatactgcttgaccccagtacaaacttgacaatagttccaagtggccagagaatggcacttttgatttgtctatcctacaagacctagataatttttgtcaaaaattgggcaaatggtctgaggtgccttacgtccaggccttttttacacttcgctctctccctagtctctgctcccaatgcagcttgtcccagattttccttctttctctcccgtttgctccttcagtctccatcccaagttcagagtcctccaaatcctccttttccactgacccctctgacctctctcctcttcccctggctgctccttgccaggctgaattgggtcccaatttttccgcagtctctgctccccaaccctataacccttctattacacccctcctcacacctggtctggcttacagtttcgttccgtgactagctctcctccacctgcccaacaatttcctcttagagaggtggctggagctgaaggcatagtcagggtacatgtgcttttttccctattggacctctcccagatcagtcagcatttaggctctttctcatcagaccccactaaatatatacaggaattccaatatttaactcagtcctacaatttaacctggagtgacttaaatgtcatcctgacttctaccctctccccagatgagcgagagtttataccctagcccaatctcatgctgatgactgccagcgtcctgagccaggcctccaagaagacaccagggcagttccccaggaggatccccaatggggataccaaacaggctcccaagatacagctaggcaagattacatggtctcttgcctagttgaggggcttaaaaaggcagcatacaaagttgttaattatgacaaacctaaagaagccacccaaggtaaggacgaaaacccagctcagttcatggcccgcttggtggctaccctcagacgctttacagccctggacccagaagggccagaaggctgtcttattcttaatatgcattttattatccagtctgctcccgacattaggaaaaaattccaaaaactagattccagccctcaaaccccacaacaagacttaattaacctcgccttcaaggtgtttaacaatagagaagagacagccaagtgacaacgtatttcagagctgcaactgcttgcctttgctgtaagacaaaccccagccatgcctacagcacacaaaaacctcaaaacaacaaaactgcagcctccaggcactccttcaaaacctccttatggaccttgcttcaaacgccaaaagcccggccactgggcctcggaaggcctgcagcccaggattcctcctaaggcttgtcctgtttgtgcaggaccccactggaagtctgactgtccaactcagattaaagctgctcctagacctgctggagcaaaaacccagggctctctggctgactccttctcagatctcctgggcttaacagctgaagactgacactgcctgatcatctcggaagccccttggaccatcacggacaccaagctttgggtaactcttaaacagtggaggaagacaggaatgtcaggcctctgagcccaagctaagccatcataacccctgtgacctgcacgtatacatccagatggcctggagcaactgaaaaatcacaaaagaagtgaaacaaccagttcctgccttaactgataacattccactattgtgatttgttcctgccccaccctaactaatgaatcaaccttgtgacagtcctcccctggacgatgagtctcaggagctccccaccaagcaccttgtgacccccgctcctgcctgcaagagataaccacctttaactgtaattttccactacctacccaaatcctataaaactgccccaccccatctccctttgctgactctcttttcggacacagtccacttgcatccaagtgaataaacagcctcgttgctcacacaaagcctgtttggtggtctcttcacatggatgcatgtaacactcactatggtgcccaggctggtgttgaactcctgggctcaagagatcctcctgcctcagccttccaaagtgctgggattacaggcacaagccactgtgcccagcctgcatcttactatatacatggtgtcttactatcaccattgatctttttttttccacattgcaataattactccaatattgcagtgtgtcttacaattaatgttttggattaaatgaaatatcacataagaaagagatgacatggtgatgtcagcaagatggtacaataggaggtaggtgtcagcctccatttccctcacagagacactgacttaacaatatacagaccaaaatacctttattttggtagaattctaaaaaccaattaggttttactaccccaggcaagcacaaagccaaaaagaaccacactgaaacaggtaaggagctgtttcactttatctgtgattgtctcttcctcaaaccagcacagctcagcttgggtcacaggttcttccttgggggaaagagaagagcagaacatacatttaatgttctggccttttagaaggctgcccacggactggtttattctcttgcctaacttgatgtactaatggaactggaatactctggatgcccgggggccactgaaagcaagggagaacggggttgggaagtacatcttgctgcaacactggagggcctgtagtgccagagacagaggtcagcacactcagcacaattgagagaaggctcccaatttgtggcttctctcttgggaaggaaggagaagagcagaacatgtgttagtattctgccttttgggagaactgcctaagggactggtatttgtcacctaatttggggtgctaatggggagccaacataatttgaatgcctgggggccactgagcacaaaggagagcagggagacttgctgcagtactaccagagaacctgcagtacctcagacagacactagaaagaacagaaaattatgcacttctgaaagtaacaacaaactggcaaaggtctgtaattgggaaattagaagcatgagcccagagaagtaacatcccctctgaaaggattcggaggttcccagaatctatcttggctgcttattgaagccaagaccttactgaaggtctttctctgtatgaagccagtctgtgaaaaatcagaaaaacaatgtgtgaatgaaatgagaatgtcagtagagacagaaacaaataaccaaacaaattctgaaactgaagaatacaataactgaattgaaaaattcactacaggggttcaacagcagacttaagcagaatgaagaatcaggtaactttgaagacagattgaacttagtgagtcagaggaacaaaaagaaaaaaaagaatgaagaaaagttaaaaaatcccaagggatttatgccacaccatctagtggatcaatatacacattatgggagttccagaagaagagggagagaaagggattgagaatgtaattgaagaaataatggcccaaacttccaaaatctgagaaatgaaatggatatccaatcccaagaagctcaaagaactccaattaagatgaaccaaagaggcccacaataaggagcactcattacaatcaaactgtcagcagtcaaagacaaaatcttgaagctagcaagataaaagcaagtcatcacatacaaggaaactttataaaattatcagggagtttctcagcagaaaccttataggcaagagggagtgtgatgatataattaaagtgctgaaagaaaacacacacacacacacacaccctgccaaacaagaacactacatccagcaaaactgtccttcaacaatgaaagagaggctgggtatggttactgatgcctataatcctagcactttgggaggctaaggcaggaggattgcttgaggtcaggagtttgagaacagcctggacaacatagtgagaccctgtctctacacacacacatgcgcgcacacacacacacacacacaaagctggtgtgatggcatgagcctgtactcctagctattcaagaggttgaggtgggaagatcactcaagcccaggaatttgaggttagagtgagctatgatcatgctagccttccaacctgggtgatggcaagacgatgctaaaaaaaaaagaaagaaaaacttactaagataagcaaaagcttagggaattcatccccacaacacctgccttacacgaaatgttagggtgagtcctcaggtttaacctaaaggatgctagacagcaacacaaacacatacaaaaatatatgactcactagtaaaggtatatctatagataaatacaaaagactataacactgtaatgttggtatgtaaatcccttaataactggtatataatttaagagagaaaaacataaaaactcaaactgcattgatgcatacaaaatataaaaagatgaaatttgtgacattgataaagtggaggagacgtaaaggagtagagtttttgtatgtaattgaaattgttattagcttaaaatagattgttataattataagatgtgtatgtaaatctcatggtagccatgaagaaaatatccatagaagatgc

SEQ ID NO: 215 - DNA, 22948 bp, Homo sapiens
actcactcttcctgggaatgatcctttagcctggtgtcactaaaagctggacatcagtttgctaagttgtgacatcttaagggtgctgcccagggtctaattgtcacagatgagaaatgacctggccctgggacgaggtctccaagaagactcagcaagtctatgcctagtctcccaaaggcctacaggtcactctttggggcttgtactgatggattcagcttcatacaacagaaaccactctagctaatttaagcagaacaggatttattagcaaacattaagtggctacagaattatctgaggggctggaagagctggctctagggtgagcatccaggaactcctagccttcagagatatacagcctcatccataatcagaaaagttacatttctgctgcaggagatcactgagttagaaactgctgactacagaacatgctgcttctgcctcagttcatgtcagatatgagctctatgtttccttcctcttaattcagttttgaattcaagtctcttttgagcatactggagagtcttttggaatcctagctgcaagggagtctgggaaacatagtcttggatttcctggcctcttcagcacaggaaaacatgagaatgaggttataataaattcaaagcaagccaatcatagtatctgcaacaggaccatatcctttctagattctaaccagatttgaagcccaaaaaacatacttaactgccactcttttagttaatatgctgagaggcttggggaaggaatattggatcctgctggcccctgagggttggtgacttgggggaatttggttactttttcaaaggttgtggaagctggagaaggacagccatggtgtgcacgaggatgtgatgggaagggtcaggcagagagtatgaggagtacagtgggagatgtgagaagcgtaatgggcgtacagagttcagacaagcagctgagtttcagtgtccagagaaagcaattgacgtttcaagagcaggaactcaggaatggccacctggttgttccaattaattctgctagaagtcatgatgttggcctgttgctgcattaatcatgaggacacatgcgcatcacccactgtcttcctggcttcctggtcacttgttgattttaactgagacacagatcactccatttgattacttcactgagcagctttccttctgaataggcctggcttttgtcttccctgatgggattgggtcatgagacccacctgcaggcccaggttggacctatatcctaagccaatcatggcagaggccaaaagtgaaagaattccagcctcatcattcaggaggatataatattaaaactaggtgtccacagacctgatatgtggaccaccagaaattcattcctttattcattcacttaactacatctactgagcccctgtcatgcagcaggcacatgggtgttctgcataggtaaggtcatggtaagcatcctggaagataggaaagactcccttgggtggagaagcgatggcagagctggtcaggcagagacaacaggaagtacacaagccctggggctgaagtagaagtaacaaggggcagaggccatgtggctggaggcttggggcagggcctggacaggaaaggccttgttggccctgctaaggactttcacttttctcctgaatgtaagagaaagcaattgaaaaaggtgttaggcaggaggatggccataatgagggcagtgtttaaaaactgctctggtgatttttaaaacatcctatgcttgcttgctttcttgaagtattgataggatggggtggcaggtgcggggggcagtggaggtgggtgaaagtgggtggaggcagatcggttaggaagcctttgcagtagtagtgaaggtaagaagtgatattatatcagataggggtgatggtggtaaagaagagagacaggactgagatacagagaggaggaagaagacaattgaaggaggaagagcagtgttgttctttttactctagtcacttcaaactctactttcacttttagacttggttttcttttttcatatttatcttttcaagttatatcccagtgtaagaaaatcaaaaggaatgagatttatttaagaaaattcacatcacaatatgaatatgcttacatacaacccatgccaaagacttggaagtgctataaaatctgtattttatatagcgccacagttaagagcatggattttgcagagaatcagctttgtgaccttggacaaactgtttcacctttctatgccacagattcaccacctagaaaatggggatgaaaatagtaactaccttgggtttcactgagaatgaagtgagataatacatataaaacaggcatagagcctggcataatgaaaatggtcaatgaatgctaattagtcttgttattcatagcttgtagctgaccatcctctgtacagttgattgatgctcctgaaggtcttcagagccaccagtgagcaccatacaagcagttatagcatgacagacttgtgcacagattgcaaggaccctgaaaagatggttctgcatattgaatttaattctgcctgttttctcccaaaaccaggttctgcctctgggactgtgcagaacttgttggagaagcattgcatggcaggggaaattgggaggcggggagaagagggttgaagagggtgaagactgtgaagtggaacacagggttcccactcctgttgggtaattttgattgcagttttattgtgactaattttgttgtagggatctgatttatttcttattcctcattcatctatggaacatttacatgtgccaagcactgtaataggtactgaggattcagctatgagcaaagttccagcttccatggagtttaaattttggtgaggttatgtctcttgccagcaaaatttattctcctacagttcttagctggccaaaacttcttcctccatggtaggaaagaaaggaaccaattgggcacactgcctgttctagagtcatatcgaaaagaaagccctactgtatatggtttggagcttattccttttgggggaaatttagtttgtattctatcagggaggggaataatagagaagttattaatcccaacgaactttcctattagtcctcaaaatatccatatgggtaatgtattgctatcccagatgaagaaactgagggtaagaggttgaatgattttcccaaatagaggtgagattcaagatttcaactttagctcccatgctttatttctttctcttgtaaattggaagttatttgttcaactgcaaacaagtaaatttaatggcattagctcgtctggccattggcgtgatggtggtggttagcacctctagttaatagatcctatagtgagtatactatcagatagactgaccttcatggcatgtgacatagctcagtggttcccaaatgccagttcctggaccaatgatagtctgtgacaaagttgtcaccaatttttgcaatgtgtggaataaagtaaatttaaattaaaggccacttctgttatgtctcctcaacattccattatggaatgatggtaaaagtaggagggtttttggtttttttttttttgcttttttttgggttattgttattttatgaaataaaaagttggcaaacctgtctgtcaatccttccctgttaaagtttcccatttggtttaattcaaaaggctagggaaacttgatatagctaactaaatgaaaaatagaagttctgtttctggcaatatgaatactagatattaaaaaaatccttctggtgcaaagcacctaaaaaagaaagtaaagttggaaaaaattatatattttaaaaaatgcatagttttattggcaagaaaggaaaatttttagaggccaaaaatgacaagaaagcacaaatacagagaaagccatatttgggagagaggagacaaatctcaggttctaagcaaggtgggaaataggattaaagactgaaagctggctctcctaaaaggtgacatcttctgtgaaaaaaggaaataggaactaaagtgcccctcaagagcagtccagtaaatacaattacccttgggatggtgggaaggataaatttctcctgaaagattcataacagtgagttactcccactggatttaagtctagaattcccattgcttatataagctgagaaatcctaagctgataattcaaaatattctgggttacactgtgtctccaggtgcctggtaagggcaaacacaaactctcctgaaggcatgcaccttgattccaagcctcaaaaaattcctaagatataatttcaattaatataggctcaaaaataaaaatcacaaaataaaggaggaaacaagatgtcacggggaggtggggggtaatcaaaagaaacatcaagaatcaggcctgtagaaacttcaggtattagtgatgttgagtataaaatataaaagaggtattgaaagtataagaaactatcaagccgatttttaaaaaagaaccaattagaacctgcagaaataaaaaatacaaccactggaatttaaaaatttcagttacacaggtgaaaagagagttaatgaactagaaggtagatatgaagtaattactctgaatgcatagaggaacaaagagattgaaaatatggaaggtaagagaaagggaagataaagtgagaggttgtaatatatatctacagagagtaataatggagataatgggagagactcatattcaaagttatcgtgtatgaaaaattttcagaattggagaaataaagaaatcttgagattcagaaatccttatgagcaccaagcaggataaattagaaaatcacacttagacacaccatattgaaattatagaatatgaaagataaatagattgcaaaagaagatacagaaaagaaaaattacctataaagaaatgacaataaactgatagcttacttctcaacatcattaatgaaaattaaaggagagatatacattcaaaatccttcattggaaaatatttaacaagccaaatgtcatagctaaagaattacatgccccaaatgactatgttttattagctttaggaaaatgccttttcacctgtaactggaatgaattgccccacaaacttggaatttaaatatggacattttccctatttttgcagttaaccacataagtggtctcctatgcctccttatcctgaagttcagcatcttcttatgagggttcccatgccctttaattgaattgtccaagaacacttactccaaagcaggttgatctccttccaatgtgagatgtagagggagatgaaatttagtcagtttataccacccggtgcagttacttttttcactgccatgtgtattgcagttgaattttgccttgaaaaattccatggatatttgtttactacaaggtctctctaacaaatccagatcattgcataatcacagtgagaccccatttggggtctcttaatttataaccttcttgagtgacaattataacctcccaggaagcagtgggtcacatcaactacctccactacccccagatgcagaattactgtcccaatgtcttagagtggccacctgctttcaaagagtagaggcaggtttttttttttttttgtagttttgtctttttttgtttttgtttttcaagtttccaaacaagaatttattctttctttaaaaaaaattttttttctaaaaaaagtaccaggtacaattttttcctgtttctgttttttcaagtttcagcaaatgcttgttcccctcagcccagccccaggagtcaggactgaggctgggtcagagtctggagtgggggatgggatagttgggagccacatgactgagtctgagagttgccccttagcccagatgaggtaggtgggtcagagtctggccaggtgaaaggaggcaccccagtccttggacctgactctgcttcctggacaccttcctcagtcacaccccaaagtaaggagacacaggtaggaggaaagggacaactggagtctggaactgtaggtgaggggtggttaacctctgtgtgtgtgcatacatgcacactctctttctcacacataccacacaaagacaagcttgtacacacatgcatacatataatttggctttcagagctaggtcagagggtaggggaagtgaagggactaggggaaggacaaggcaagctgaagctttggctactgactcagtccctctggaataacccctcttccctcagctgagggagagcagttctccttctgctcccctgcataagcctcttcaactcctgaggttggagcaatatctgagagtgggaaaggaaaaggggtgacgccaatgatcaggtgtgggaggttactaagtcaatccaatttgaataagttataaattaaaaataaataaaataataaatggttctttttcaggacagggaggcaacgctggcatgacttccctgggaacttgggataacctcagggtggctctggttcctccctactacctaagctggactgggagaaccaagggaggggacaggcacatggaggacctgaagtagggcaggttgtagtaaggatcagaagctctaaatacccaaatgatcaatctaggcatgagcatggtgagggctttaactcgagcctgaagggtctcttgccatctctccatctatgggatggacaagatgggcaggtcattgatccacattggttcagagtaatggcaatcagggcaaaagtgaataacgtgggttaagaggggccccagtcacagcctgaagttcgcaggggagccctgcgtccagctccaggctctagcaggaaaaaagctggcagagatctccattcaggcttaagaggcctgagcgggagctccagaacccaaggtgcagcgagtagcagaggaggcagtaggtggggttagcatttttctcctcacccacaggcaccaaaaagaggcaatggcacaataagggcatgtggcagcagccatgtccaagaagtcaaaggtcaccaggaacatcttcaccacagtctggttggggttaaatgttacttgtgtggtgcccactttgggcacgctgtaactcttcctccccaggaggttcagatccacaaagcccaggaagtgggtgggggcattttgctcagaaacctcaaagaaggtgacagtgacaggcagtgtgacatggtgggggcagtaggacccactagctccagtctctgctgtgaagccctcaatgtggccagatggtgcaaagcgtccttgcagcaatgattcctcaaagttgcccagcagggtacagctgatagcaggggtaggaacaggggaggcactacgggggctcagcaggcctggccccttccagaggcttcaaagtgggctcagcttcaggtgatgggcacctgtcagcctccgccccatgggactgcagtctgttgggtccaaaacaggctccttgggcccaggcagcaggtggctccagatgggtgtggtttgagcatcagaactgttggtagcagtagggtggcccagggttccctggcacgtccaaagggctggaccctcttccttagaactgacatttggggcttctccagcagaagcagcctttgcttggtggggcaggggcctggaggtccagggctgggggtgtgtgcttgggactgtgcccactgtcaatgccaggggactccctaggccagaggctccccctcttgcccaccctagccactgggctcttaccccttatttgtgcaaaactgcaaatcagtgtccagcgtgtgtagctggcccagagggctggccctggggactcccctagggacccctgtccccctgggtctgggaaagcctagtctctggtgtgtaaagtatttcaggaagcatatgatcggggccaggagggactccaggcccctgaagtccaagaagaggtggcactacttccctgttccacaacacagaggccacggtgggagaaatggtggctggacacacctactcccagccccagtccccctgggcccaatagccctacagaagatggttcttcagggggtagtccctctctggcccccagcccagggcccctctccagctcctgaggacccttagtgggtggggctggtcgcttctgggccctgtgaagctcagaggcaccagctggaggggaaaagataaatacctggtagagcctgggggatgtcactgccccctgccccccccccacttgctgggctgtagtccatgagcaggccaccccggagggccccctgcctgactggaggctgtgaagggccagcctctggctctgaggatggagacagctctgcctgcatgtggcacatgaagtcccccttgggtcaggggggtcacccccacacggcctttatgctgggcctgtgctggggagtctggggacatctggatgaagagggctcaagcctagccgtgcatcccctcttcctgactgatgccttgttcctctagcttgcagtctgattcatgcccactgcactagcaaagtgactgccaccattccatgcagctcctgggctcaacaggaccctgtagttctgttagtctcattgcacttgaggaggtggtagtagaggcagagttttaaaaccacagcaaacaacaaaggtcttgcattcatctctcccaggacagtgaagcctgctcagtctagacttacatgagagactactcaatgactctcacagaaaagagatcttcccaaggtgacatcttctcctcctaagccaataaggtcatcttactcacagtccacttccaggaactgaccccaaatggacagaatctacttatatcatggcacagctgtcaacttctcttgctaaagaagagaataacgctcacaaaattgccccagatggcggtgcaacatttttgggccaagtactacaactgaaaagcatgaacagagttttaccagcgggttacaggtttgtttatatgaaaattgcactccctgtttatttctaatagggaaaatatttctgatggtatatgattcctaaatgaaatgatgctaacaaatgttcacatattttgtgagggagaacacagcaaattgtaagatatgatctgcagatatcaaactcattttctttactggaaaacaggtctgactgcatggcacgattatgttgggaaaaatgcagctatagttctcttcatttggaacacgaacgtatatcacaaagctaaccagatcacattcattcagtagcaaacacaaatcaactgtggctagcaaatgtgtgtacaaaatacattgacatcaataccagtttggtgctttcttgtgatcaaatccagggaaatagaaatcagccatctaaaacttaaccacttgcaaaagagcatttatgttaccagcagtttaaaggaaatgaatgttcattgaagagcagcctatgctgaactctcatttttacatgtattcaactatatatatgctggctcatcattttaaaactattatcagccaggtgcagtggctcacgcctgtaagcattttgagaggctgaggtgggtggatcatgaggtcaggagatcgagaccatcctggctaacacggtgaaaccccatctctactaaaaatacaaaaaattagctaggcatggtggcgggtgcctgtagtcccagctacttgggaggttgaggcaagagaatcacttgaacccaggaggcagaggttgcagtgagccgacatgcgccactgcactccagcctgggtgacagagtgagactccatctcaaaaacaaacaaacaaacaagcaaacaaaaaaattatattatcatttattaaatgtgattaggtagctctggatccttggtctgttattttttttaaggcataataagaccaggacttaaaaaaaaacaccctgtaaaatgtacgctttttaagaaataatagaagtcacttttattctaacatgctatctttattgaaatattttaaacatttattgcaaaaacaataaatgctttttatttttcaaacataaacaatacttaagtataaaagtaaaaactgaacattgcatataaccctggtccatcccatttcctgcagaaaaccactattaacagttttatgcttatacttctagatgtagttttatttcctgaaactttctcttttactaaatactgtatcttagagatgttttgatatcagtacatacagagataccttattgtttcacagtatttcatagaacagatgtaccataacttacttccaactgataaacatttagattgttctcaacgtttcacacataaaaacaaaactgcagcgattattctttgcacgcacatctctgcataatataaaaacatttctgaggatttctagaattgaattaacatgtcaaaggatctacatgttttatattttaatacattgtattcatcaaaacatttttttctgagtttctcattagattagataagctgtgttttgttttgtttgtcttagctcttgtttaacttctagaaaactagtgacatgctcttggagaagcccctcttacagaaggccaaagaagctgagaaagcacagaggaaataatcaaggctcacctgggaaagcaacacagcttcaccatcattctctcgtccctgagaaaataaatcaaaacaaacaagtatattgagcactgggtgttcaaaaccacatgaagaattgttttttgttaaattaaagccttaagtagtcttaaatgatgtagcaaaatatgcccattcaatgtggttacttacctcctcagatatgaaaggattttatatggcagtatttttatattctacgttcttacaagtttcacatattccattacttaagcgttcatatttctcacaaagacttacattcctcaggagtacaatgttttagaacaaagaatgcattcaataaatctttacagagttaatctttacagaggacaattctcctgtagacaggagtgaatacatataaaggacaaataacgaggcaaggcctttgtacctttcagccatctgcaaaatgaagaactgaattcaaattttgataggcatggctttcagagaagtctgacagaagctatgcatgaatttctttttttctcttttacagttcccttcttacttaaaaaaaaaaaatcctgaagtggcttagtgatataaactatggagagaggtgtgggtggttcttttaagtgcacaataaccaacaggtctccctcctggaaaaattctcagatgctgaggaagatatttcctgtggccaaaagattttcttcactagtttttgtcaaaatgtcttttcgcagtttaagttctctgacgttgactgatgtgggcccacttgcaaaaggccttcccacatatctcatagagtttatctctggaaggaattcttcaatgccaagtgaggatgagctgcaggtcacagctttcctactgccactgaattcagagtgcttctcctcagtgtggctctctatgtatcaaagaaaaaaaaaaaaagaaaacccacaaattcccacatcatttgcactcaaaggttttttcctccagagtggatcttactctgttgggcaaaagcagagtggtagccaaagtcctttctatgttcaaggcactcataaggtttctctccagtgtgactccttgtatgtcgagtgagggaatagctgtagtaaaaacctttcccacattctttgcactcgtagggctttcctgcagtgtgggtcatactatgtcggaagaaaacagagcggtaggtgaaggtcttcccgcactcactgcacttgcagggcttctctccagtgtgaatcttcatgtgccgggttaaggaagagttgtagtaaaaggtttttccacattctttgcacccaaagagtttttctccagtgtgggtcacacgatgctggatgaagacagagtgatagctgaaggtctttccacactcgctgcactcatagggcttctctccagtgtgaatctggcggtagcacaggaggtgcgacctgcggttgaagaccttcccgcactccacgcacttacagggcttctcccctgtgtgaatcctcatgggtcgaacgaagtcgaccttttcaggaaaggcttttccacactcctggcattcataaggcttcaccccagtgtgaatctgctgatgtcgaacaaggaggctgtttttgttaaacacgctcccacattccttgcatttgtaggtcttcccctcacgaaccaaagtgtctttacttggtccctgggagtcacattcatggagattgtctcctgtggagacctgctcctgtaaaacctgtgagtgcagaccatcacctgtccccaacccatcgcgtttagggctcatcttcctccagaaggtctccgtgtgggagactgcagccaaactcaagtgcccttctgcatttccaactgtgtccggaattggtgggttcttggtctcactgacttcaagaatgaagccgcggacccttgtggtgagtgttacagctcttaaggtggcgcgtctagagtttgttccttctgatgttcggatgtgttcggagtttcttccttctggcgggttcgtggtctcgctggctcaggagtgaagctgcagaccttcgtggtgagtgttacagctcttaaggcttaaggcggcgcgtctggagttgttcgttcctcccggtgggctcgtggtctcgctggcttcaggagtgaagctgcagacgtttgcggtgagtgttacagctggtaaaagcagtgtggacccaaagagtgagaagtagcaagatttattgcaaagagcgaaagaacaaagcttccacagtgtggaaagggaccccagcgggttgccactgctggctccggcagcctgctttcattctcttatctggccccacccacatcctgctgattggtagaggcctggtctgttttgacagggcgctgattggtgtgtttacaattcctgagctagacacaaaggttctccacgtccccactagattagctagacacagagtgtggacataaaggttctctaagtccccaccagagtagctagatacagagtgtccattggtgcattcacaaaccctgagctagacacagggtgctgattggtgtgtttacaaaccttgagctagatacagagtgccgattggtgtatttacaatccctgagctagacataaaggttctccaaggccccaccagagtagctagatacagagtgtagattggtgcattcacaaaccctgagctagacacagggtgctgattggtgtgtttacaaaccttgagctagatacagagtgctgatcagtgtatttacaatccctgagctagacataaaggttctccaaggccccaccagagtagctaggtacagagtgtccattggtgcattcacaaaccctgagctagacacagggtgctgattggtgtatttacaatccctgagctacacataaaggttctccatgtccccaccagactcagaagcccagctggcttcacccagtggatcccgcaccggggctgcaggtggagctgcctgccagtcctgcgccatgcacccgcactcctcagcccttgggtggtcgatgggactgggtgccgtggagcagggggcggcgctcatcggggaggatcgggccgtacaggagcccacggagggggtgggaggctcaggcatggcgggctgcaggtcccgagccctgccccacgggaaggcagctaaggcccagcaagaaatcgagtgcagcgccggtgggctggcactgctgggggacccagtacaccctccgcagccgctggcccgggtgctaagcccctcattgcctggggccggcagggccggccggctgctccgagtgtggggcccgccaagcccatgcccactctgaactccaactggcccgcaagtgccgcgtgcagcccgggttcccgctctttcctctccctccacacctccctgcaagctgagggagccggctccggccttggccagcccagaaaggggctcccacagtgcagcagtgggctgaagggctcctcaagtgccgccaaagtgggagcccaggcagaggaggcgccgagagcgagcgagggctgtgaggactgccagcacgctgtcacctctcacaaccactctttccctcactcacctcaacctggaggaacttctggctccctgagttagtctttccaggagcaaggctccctaggacaaggctggctggctttggcttttactttgtcacctggacagcagctttagcaaaggtattttctgctcttttatcactgcttcagctagtaggtcaactgtggtttgcatgcccccgtgacgagtggtctgcaggtctctggtgtcacctcccagtacggggtcctctggggctggtccagctgctcccacttcttccaggttaagatcatggacatgtcctgcaccactgcctcggatgtcgctgcaatggagcaagacaaaagccacgcggcacctgcatccgcatatgcagagagtacttccgactacagataccagagagccgcgtgcagcctccgccagccgaactacaagtctcagaggcctcagtttcattttttaattcctgggaatttaaccctcaattattctaaatggaagttgatgccggttgggtcggggcgacctgcaagcttgcgcacaaacgtgcacataagaacatacatgtaaggaacctgttcatgcagggcgtggagagagtgtgtcccacttatcacttaattttacccgctgaccccacgataaactgtaccaaggggctggccattaaagtcaatccagtcaaaatactcagtgtggagaagacatggaaattcaggatctcttttatgttgtggatggttctgtaattagtaaaatcactttggaaaagtttggtcctatgtcctaaaggtctttccaaaacaaagctttcccacatgtaccaggaaatgtgttccagaatgctcacattagcaaacacctggagagagttcaggaaagaggatggccgctacacagaatacaacattgttcagccgcctgggactgctgccgtccagtacttctcccaggggagccagggaagcatcacagtttatgttgcagaatcctcaaaaatgaagggtgtaacagcaccaaatcgctctggagctggtgaggagtggaagccatcatatggagattggtggcagtggcttgagctttgagcaagaccctgatccactgccctccccttcccaaaatgcagctggtttttaaagtgaagagaggatcttggaaccagggaatgagaagcaaattggacagttctggcgaatactgaagaagagaactgatggtcactgacatatggacccctcactccacccctctttgctcgtcatagcagctgtttggaatgttcctctctcagaatctaatcagctcaagaggagagacccaaagacgctgatattgcagttctcccagtgaggtggcctggcacgttgacttttagcaaatacttatactttgttttatttttctttcttctgtgctggccagaacctctatctactatattgaaaagaagaggtgctatcaaatgccattttcattttgctgattaaaaaaaattcttctaatgtttcataattaagaatgtgtgtagtgtgaaattttactggtatcaccagcttgattagttttataagatataaatattggggtcagagaaataaaagagcaggcagacatgctaactgaaaaatccaacagagttttctcacccaaagtatttggaacaaatcagtacagtcacaatacaaggcagaaggctcagctgtgttatccagacagcaagagtctccccaagatgggaggcaatagtggatggcaatgacttaggctgctatgcatgagctcttctgaatcggttctgaactgtcttgccagggacagtgccttcatcattcttaggacgctgcacatttgatggtgaagttctctccagcagtggttctcaaagtgtcattcctggtctctgttgtgcttatttttaagagttaaagagctgggcgcggtggctcaggcctgtaattctagcactttgggaggccaaggcaggcggttcacaaggtcaggagtttgagaccagcctggccaacatggcgaaacccaatctctcctaaaaatacaaaaattagctgggcgtggtggtacgtgcctgtaatcccagctattcaagagggtgaggcaggagaattacttgaatctgggagtcggaggttgcagtgagctaagatggtgccactgcactccagcctgggcaacagagcaagactctgtcttgagaaaaaaaaaagagttaaagaaagctgatcactaaatacatgcaatctaaccatgatcatgtgggcggttacaaaatgcattagttttatttcttggaaatgtctatttttttctttaatgaatttgtctttcagcatatggttttaatgatataaaacagctcctaaaaatgataaaaaaaatttctctcatttgagctgtcagtagcaaagcttgtaagtaatgtgactatctcagcaaaaagttggtacgaattagatcatatcagtaacaatgcccagagtctgctctctggaaattctcagggggtttctcacaaggaatcctgtggatgacttaaccaatgtgactatagactctcacctgcaatttttggtccttggacacacccatggacttccccttatcactgtaatccaggcatgaacataaactctctagtgttagaccaaactgtggctttaacaagacttttcttagggctggggatcacagagggacgttcatataaagaataacaactggctactagatagggctgttcttggagtcctcagttcccagtccattcagctggcctccatacagctcccttctgctcagagcccattctcttcaccaccattttaggaagaggccagtttttctctaccacccagaaacatctcacacatgcctcaattccacagtgtctaggccgaagtcaaagtccagacagaggaactaaccccaatccaggcctgtattccccattttctgtttccatattttacaaagatgcctaatcagtatattatcttcttccttcagtagagaatccaccttcattcacacaattgtggccttaccctatgactccaatagtatagccccttagaacatagtgtcacatttccagaagatatacatacttaccactttgggttgaattgatccctccaaaaggatgaagtcctaacctccagtacatgagcatgtgaccttatttggaaacagaatctttgcagacgatcaagttaaaatgaggtcattaggataggcccaactaaaatgtctttgcctctaaaaacatggattctccttgattctttttttttttttttttttttttttttttttttttttttttgagatgaagtctctctctgtcacccgggctggagtacagtggtatgatctcggttcactgcaacctctgcctccttgcctcctgggttcaagtgattctcctctctcagcctcctgagtagctgggactacaggtgcatggaccatgcccgactagtttttgtatttttagtagagacggggtttcaccatgttggtcaggctggtcttgaactcctgacctcaggtgatccacccaccttggcctcccaaagtgctgggattacaggcataagccaccgtgcctggccatgattcttcatgttagaaatacattctcccttgtatctccctagtcctttatcctttatctcatgccatcactttcttcctggtgatacagctaactatttgtgcagcctgactctctcatcaaactataagttctcaagagcagaattcccattgaactcatctttatatctttcagagtgagaaatactgtgccttgcatgtggccagtgagcaaatccatatcttgcctaatttgattccttttataaccctcagaaataggtgttgtataccctccaaccaatgaagaggagtgtggccaaagatgagaatgacctgtccgcatagaattctttcaccattgcttattgcttcaaacggtattaagcccaagaaacaacaatcaaaacacaaaacccagcacagctcatttattaattatctcttttgtgaaccaactctttctttgtgtgagacagctctgtttctgcctggtaagggagcagtccacttcaaatgcaaaagcaaattgttcctgcagccacagttttaggacctgcttctcccccttttctgcttgtatgagatgccctagggtcctagagacactgtagataaactcagcaactgcctcttggatgcccaggtggattctgaagttctctccacatggtggttgctgtggggaagaatgagtttctgttttgctcagaaaatactctttatgactggaggtttcccatgtgcttcttgtctgttctacttgtctaccaagttgctgagttctcaattatatatgtatatatacatatatattcattagcatgttttccattaccagactaatagcaaatccttcaaatgttgttatgaaatgtcaccatctcatgctgtaatatcccactaaaaaggttcagaaataggaaacagaaatatttattctttcttgatatagaagggttggtaaattcaaagtggagaagcttaggcttaagatgggacttacttgttgaataaccttgggaaaattacttcatcattgagtttcttcacctggaaaatgagggataagaccagattctccacatctagggattttctccttgccacatttaggtctcaattagtctgcagtaagactatagcagagaggctgtgtaggcccaggtatgataaattaataaatctcagggtagacgagaagtagtaaagagaacatgttgtcagaagcagaatttgtgaattcacagagcagttacatttataatttcaatttgagatttaaagggcaaatttcagatgaaccaccatgttccattttaattcaatatgtcttaggattttccacctcaaaactcttaggtcctttgctaaaaagtcaggtccagtcttatcagtctttgattatctagaaatggatgatcatgctgtctctaagagctcattaactaactcctctcattttcatccttcctaataagccactccagccatagagcatggattaagatgtggaataaggaacaataaatacagtccacatgaaagtctaagcagggtatctcccaagccatgccttcccattctgggtgtcctagccctttccatagcttcttgttttcttatccaattaacatctcctccatgatgctgttcaaagtggtcaatttgaagattattctattaatgtctagacaggtgtggctgttactatttgagaacttcagctgtctttctgaagactttttggcctttcttccacaaggggagtaaacagagctcatctgggggatattctagtatcttttcatcttgggtagagttaagactgattactgtggtgctgctttctggaatttgccttatataagacagcttaatttgtcccagctgatatggtttggatttgtgtccccactcaaatcccatgttcattagtaatccccagtgttggagatggggcctagtaggagatgatttgatcatgggggtagatccttcatgaatggcttagcactaccctttttggtgctgttctcctgatagagttctcatgagatctacttgtttagaagtgtgtggcacctcccctctcgctctttctttcccctgctctggccacgtgaagatgtatgcttcagctttgccttccaccatgagtaaaagctccttgatacctcccccagaagcagatgctgccatgcttcctgtacagcctgtggaaccatgagccaatttaacctcttttgtgtataaattacccagtctcaggtatttctgtatagcaggataagaatggactgatatagaaaattggtattgagaagtggggcattgctataaagatacctgaaaatttggaagcgactttggatctgggtaatgggcagaggttggaggagtgtggagggctcagaagacaggaagataagaaaaaatttggaactttctagagacctgttaagttgttgtgaccaaaatgctgatagtgatatggacagtgatatctaggctgagaaagtctcagatggctgagaaagtctcaaatgaggaacttattgggaacttgaacaaaagtcacatttgttatgcattagcaaggaacctggcagcattgtgcccctgttctagggatctgtggaactttaaacttgagagtgatgatttagggtatttagcagaagaaatttctatggagcaaagtgtgcaataaataacctggctgcttctaacagcttaaactcacatgggtgagcaaagaattgacttgaaattggaacttatatttaaaagggatgcagagcataaaagtttggaaaatttgcagcctggcaatgtggtacaaaagaaaaacccattttctgggggaggaattcaagctggctgcagaaatttgcataagtaaagaagagccaaatgttaatagccaagacaatgggaaagaggcctccaaggcattacagagacctttgcggcagcctctcccatcataggcccagagacataggagggaaaaatggtttcatgagccaggcccagggccgtgcttccctgcgcagccttgagacactgcttctcacatcccagctactctagctccagctgtgactcagaggtgcccaggtacagcttgggctgctgcttcagagggaacaagccacaagccacaatccttggtggcttccatgtagtgttaagcttgcaggtgcacagagtgcaagagttgaggcttgggatcttctgtctagatttcagaggatgtatggaaaagctgtccaggcagaaacctgttgcaagagtggagccctaatggaggacctctactagggcaatgtggagaggaaatgtggggttggagcctccacacagaatccacactggggactgcctaatgtaggtatgagaagagcaccactgtcctccagaccctggaatggtagatacaatgacagcttgcactgtgtgcctagaaaactgcaggcacccaacaccagcctgtgaaagcagccagggtgctgtaccctgcaaagcctaaggggcagagctgcccaggtccttgggaatccacctttgcatcagtgtgccctggaagtgagacatggagtcaatgaagattattttggagctttaagacttaatgattgtcctgctgggtttcagacttgcatggagcttatatgtcattgcttttgaccaatttctccctttttgtaatgagaatacttacccaatgcttgtatcttggaagtaactaacttgtttttaattctacaggctcacaggcagaagggactagccttgtctcagataagactttggactttggacttttgcattaatgctgaaatgagttaagactttggagactgttgagaaacgatgattgtattttacaatgtaaggacataagattgggaggagccagggggcagaatgatatggtttggatttgtgcacccatatctcatgttcaaatgtaatccccaatgttggaggaggggtctgggggaggtgattggatcatgggggtagatccttcatgaatggtttagcaccatccctttggtgctattctcatgatagagttttcacaagatctggttatttaaaagtgtgtggcatctccgttctcactctctgtttctcctgttttggtcacgtgaagatgcctgttccagctttgccttctgccatgagtaaaagctccctgatacctccccagaagcagatgctgccatgcttcctgtacagcttgtggaaacataagccaatcaaacctctttttaaaaataaattacccatggccaggtttagtgacttatgtctgtaatctcagcacttttggaagccgaggcagatcacttgaggtcaggagtttgagaccagccaggccaccatcgtgaaaccctgtctctactaaaaataccaaaaagcttagctgggtatggtggtgcgtatttgtaattctagctacttgggaggctgaggtgggaggattgcttgaacccaggaggtggaggtttcagtgagccaagatcacaccattacactccagcctggatgacagagggagactcatctcgaaagaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaagaaaataaattacccagtctcaggaatttctttacagaggtgcgagaatggactgagatgggaggattgcttgaacccaggagatggaggtttcagtgagccaagatcacaccattacactccagcctggatgacagagtgagactcatctcgaaagaaagaaagaaagaaaggaagagagaaagaaagaaagaaagaaagaaagaaagaaagaaagaaagaaagaaagaaaataaattacccagtctcaggaatttctttacagaggtgcgagaatggactgagatgtgaggattgcttgaacccaggagatggaggtttcagtgagccaagatcacaccattacactccagcctggatgacagagtgagactcatctcaaaagaaa

SEQ ID NO: 216 - DNA, 20383 bp, Homo sapiens
aattactgcttaaataaactccgaaatttcagtgcatcaaagcttattttttttaacaatggagattgtcttaaaatagtggaaattcaggtgatgaattttctttatagaaaatcagaaccaggtctctcaggttgtccctgtgtcctctggacagtggcacctgcagttgtccaacatgggagggcaatactccctggacaggaagcacagtcttctattagggccacttgaatgacactgaacttgacactgagaacttgtctctgagaaatgacgcattttattttcccacagctggggccatgccagaggcattcatgctgcgctttctaaatacctcaaagacaggctggggctgcagccaagtcaggcaatgagctggctgggtgccagtctccctggggtgatcctgaggcctctggctgagtgctcagagccgggtgtctcctgtggcccagaataagggaggcacaatggccttcccacctgtgcaccatcagaaccaggggttatgcagaggctgagtaaaagagggtaatgacatggcagccgagatccagtcccctttaaacttagaagaaaatccaagcatctttccacaggcccctgaggtccagcctccacccagaggcctccagtgacacaatatggacattacttaaattatgtggtcaatcaaacatttatgtatcaaaccaggctcaacggagtgcaaacatcccacagacaatctatagattctattgggaggctatagtcaacttatcaagaaaattggctgcaggcacacacatggaactgtcctggaagggaaatcagggtttgagatgcacagtcaggggactggaggtttcttccccaaagcatgaccaccaggaaatcagaatcagccagtccctcagaatcaggaacaagatcattgcatgagaggagaaataagacagtacccataagagaaagtccagttccgaatctgaaccctgagttcgtttggttgtaaatcccttcagggatgtgcgtgtgtgtgtgtgtgtgtgtgtgtgtgtgcatgtttgtttgtgcatgcatgtgtgtactatatggaaatataatttttgtgactcatgttttcactcaatagtaaattttgatcaacttccctcatccatacaaacttagctcatcctgcctcagctgccagaagaattagggtttcactgcagggccgagtaattggggttggtgtttcctgggtgtattgtgcagctctgcgccagctgagacaccctgtgcttctgcccactggtattcagagcctacaggcacatcttccttttccctggcttgcaggctgagccaagtgaagcttgggcagcgtcttagtgtggtcctccaaatcattccctccaacttgcttcctacctggcctcagcgctcccagccctactattccaagctggggtggttcacactctctggggaagcccatccatttctatcccatctcagtgctgaatcctggaaaccactggttccaatgccattgacttcctttcatcaaaaatttcctttatgcctcagactatttatgccaccattttccacttttcaacccttttgcagattttcaattgattcctttcaaaggtaaacacacatggactcagcatcaggaaactggaaaatgggtgctcttaaggcaagatgggcagacagaacagcttgttcttgttcagactcaaacccaggaagggccacgatgtgacccaagaaccttgagaactttggtagcagagggagcagaggtgagaggtgaaaatgctcattccataagcattcgcagagtgctcatttgacaccaggcctctatcaagtggcaggagacaagatgaagggacctcaagtgccagaagatgcaggacttggcccacatggcgattcctctgggggagttagggtgttctggaactgcattgagtggccctagccacatgacaatcatgcccctgtttggggttgcagcacctctggcagtaggtgccaccctggccagtttcacagggtaagagaggcagctacagagatgaagagcttggccaaaagaaagagctcagacaaggatgaaattcccgcaaaactcagtttttaaatagagttatcagatcagaaatccaaccagtgagcaattaggagggaggaggtgtgtaaagtaagaaagtgctgtgctcagcactttttggatgggtgagagttatggctgttgttcttttagtgcctggaaagtgttattaatagctatgggaaagggattttcccatctgttctttcaaacacacacatgcatactttaacgttatcttgtattttcagatgcttctaaaatctacagtcaatgagttacttgtatggagaggttaaacatgccaaggtttcaccagccatgagcttcaccagcagtggggagaggggagtctggaaagccgggagattattccttgtttctcagccaggctcatcttcgggctctgcaggggcagccttactttacagtcagtcttgggaggagtgttctccaagggagggtaaggatagccaggtttaaagagcaaggaaagggagacaaaaggcaagcccagaggcaggtgccagtggctgttgtagcaagtccctttgcctcttcttcaggccattttcactgccacttgtgtcagctctggaagaccacaggagcttccaggtggtcctagccccagactctaattttgcttgaaatccactaattcagattctccaatggctgtgcccttcctggcatggcccacctcctctgcactttccccctggagtaaatgtacaggaatgggagagctagccagagaggtgaccagaaggtcagagattcacttttgtttccatccaaatcatagatgtgtaaaatcagaactttctcatttagggccccacatccacaggtgcttccttggtgaaaaaaaatcaatctgggagatattttagaattccagagtcatgatcttttccacccacacaagatgaattcttgtcctgcaaatgatcaaaggaaatctggttataaacaatgctgctgcatgaacatgactgggaggaaaaaatggagaagagatgctttcacacccaggagctgccttgcatgtcgggggcatttgcagcaggatttacaacagaattacaccattattgatccattaatctatttccttttcattcagtagctatttcctgaccacactggacacagaaggctaaggaaagaatctaattaattcatttaacaaaagtgtattgggcacctactatgtcccaggctccatgctagggctggggagcaatggtgagaaagacttctctcctcccctcactgagccagcattctgcctgggaagacagacaatgggccagtcaacacatgaccaggcaacgtagtaacagggcaatgaggtagacatgacctgggagaggctacttcagaaagtagcatctgaaggttaagaaggaagccatcacataaggacccaggacaaggctttcacgcctagggcacctaggggacaatgcagagctcccaggtcggaggggcctgtgctcaccagagggggactggctggggatccagcaggggaaaggtgctcagcctgagactgggaagcaggagtgacaggtgtgtggggaatggcaggcgtgggaagctactgtaggtgccatgagtggtgttctagggccttgaacagggagatggatggaattacttcttggaggatcatgctgctgttatgcagtgaataaagtgagaaagggaaagcaagcagagagagcactgcagaggccatggaggaggggaggtggggaggaagtatcgctgtgacacagccatggcagtaagagcagccatgcatggtggagtatgaggtgtgtttggatctgactgtgaactctttgtggacagggagtgatagagatttgagccaattgcttaggttattggattgagcaagtaaaggatggtggtgaccctttctgagatgaggatatcagaagaatcaggctgtaaggcagggaaggagggatgtcagtccctgccctgccagagcgcaggttctgtggacgacacagttgtggaatgtgagtcaggtgccagatggccttggtgctgagtgtgaactgataggagcctatgaagggaccacagtttatttccttcctcccgctctggttcatttggaccccactgaagactggggaggtttctgcagccaacatcaataaagtggtgacagagagcaccaattgcaatccaaaatcctactgctgaggattcatcacgagcttattcatatggccaaagagaaactgcaagagcaaaggctgtgtgcctggagaattcacacatttcccattactttccagcagggagtggaggacacatatacagacctcccctaagttagtcaagtaagagacccagcagcagtataacagttcatgacaagaagggggattggaaagaaaggtaactgttttccaggagaaggtggggctgtccatgccactcctggaagatgtggctacagactcagagataatgatgcttctagttcccacagtcagtatatgaacccagctgaggatcagaaggactctgtgtggtgaatgcaccaccatgttttgcagaaagcatagtgtttccaaggaaatctcaggaaaattacaaaatctgtaactttagcaacagttggagcttcatttgctggggcaaaggaaaaaaattataaatattatcagtgtcactaacatgagtttactacacctcttccacctccaaaggcacttttttctgaattcttaccaaaaacccatgtcctggtaatacagcagccttacacttccctacacatggcactcctgggagactcaacctgcaactccatcgtgtgagagtgggatgtgcttgaagtctttcatcaaggaaaaaatgtaaattggtatccatctggtcagatgatgaaactgttttgtgtccaaaatgttaacaataaagttcacttctttgtaaacgatgattttataaaattgcaagtaaattgtctttgcagaaaattaattgtgggttatcacttggactccagtcacacaagggggctgtctatgtttcagggagtgagggtgtactttcatttgttgtattatactcataccccaacttttttggacctcatgcagctttagccaacagcagtttctctaagccgatgaggttacaacgctgtggaatgaaaaagccactgctggcttgtaatagcgagaacagatgttgacaagagaagaacttcctgctatggggaacaaaggctgcattgcactgcaacaaatggagaaagtgctgtcatttgttcaattactaaaacatagccccatttatgatataatttggaattctggttctactgagttttatgctatttatggttttatgcctgccaaagctatgattttcaacttgaaatgtgatcttgtgtttgaccttggaactggtgctctaaggcagcctattcggtccttgtggccatatattaatactaactggatttggaaatctgaggaacaaacgtgagtgtgggatattaaaagctacaaacttatttccaaacaagtatcctctgatcatacatattttgctaggtacctagatgggagcaccttttactatcacacatgctcccaggttgtgtgttaataatggatacaagctttgacattataccagccctatcctgcatgagtaagatgtgtcaccaaatgtagaaatatggcaggcttcttggcagacatttctggatgaactatttccagcaaaagcagtaacttatcaagcagttccaagtgaagtacccaactaggaacctaaatttgcaatgactgatagactcccagctttaagaaataaaacaatcaccaattctaagctgtatgaagagaaatcaccccagaataagaaatcccaaccaggaaatgataaaccattaacaaaagcagccctgaaaaatcaaaggaaatataaagctaagaaagctacaaagcaggaagtaagaagtgacaagagtccagatttgacacctacccctgtcccccagagcacaccctgaaatacagtgtctcagttaacatctggaaaccctgagatagatgaaaaattcaagaacctaaaaagccaaaagcaactgactctcagttaacatctggaaatcctgagatagacgaaaaattcaagaacctaaaaagccaaaagcagctgaaccttgaaagaacacagcaactgaaacacagctagaaaaacagtgagttagaaaaataaaagatagttcccttctccaagagctggaagatttgaaaatggttacttaaagattcacagagagcagatttattagtataaatccatagaaacacatctgggttaaatccaggagagcaccctgaatatccatgtacccacacttaatgctcaaacattatattaaccatttacctaagcttttgcacatttgggaaattatgtattaatgaccactaagttaacatctttcaatgcaagttatagaaaagacacatacaaatttcttaggtaagtttgatagactaaaagaggaatatcaatgacattcagtagagaccagtatttaccatataaatgaatatgggtattttaaactaaaacaaataaatgtaactcactagactgtaatccaaaagaagtcgatgaaaacaaggcgaacaaaagtttgtttctgtaactttagaatgaatatatgtttctttctcttcaatctatattcactcactgatatgctttggatgttcatcgcttccaaatctcatgtcgaaatgtgatccccagtgttggaggtggggcctaatggaaggtgtttggatcatgggggtagatccctcattaatggcttggtgctgttctcatgatagtgagtgagttctcacaagaccgggttgtttccaccgtgagtggaagcttctgaggcctcaacagaagcagatgtcagcactgcacttcttgtactatcttcagaatcataagccaattaaaagtgtgtggcatgtccccctgccctcttgctcccactgtcaccatgtgacatgcatgctcccccattcaccttccaccatgattgtaagcttcctgaggccctcaccaaaagcagatgccagcaccacacttcctgtactctctgtagaactatgagccaattaaacttcttcttttctttataaattgcccagcctcaggtatttctttacagcaatgcaaaaatggcctaatacagaaaattggtactggggagtagggcactgctataaagatacctgaaaatgtggaagcaactttagaactagataactgacagaggtgggaagagtttggagggctcagaggaagacaagaagataagggaaagtttggaacttcttggagactaattaaatggttgtgaccaaaatagtgatagaaatatggatagtgaaggctaggctgataaggtatcagatggaaatgaggaatttattgggaactggagcaaaggtcacccatgttacactctcccaaataatttggtggtattgtattcatgtcctaaggatctagggaagcccgatcttaagagtgatgacttggggtatttggcagaagaaatttctaagcaacaaagtgttcaagaagtgacctggctgcttccaacaacctataatcagataagggagcaaaggaatgacttaaagttggaatttatatttaagagggaagcagagcataaaagtttagaaaatttgcagcctggccatgtagcagagaatttaaccaggctgcagagaaaccacttgctagagagattagcatgactacaacagagccaagtgctaatatccaagacaatggggaaaagacctcaaaggcatttcagagatcttgaaagcagtactccccattataggcccagaagcctaggaggaaaacaatggtttcaggagccagacctgggacaccactgccctccacaggcttgggatgctgctccctgcatcctgcctgctccagctccagctgcagctcaaaagtccccaggtatagctcaggccaccactccagaggctgcaatccatatgccttggtggcttatgtggtgttaaacctgaaggtgcacataatgcaagaatgaaggaggcttgacaacttctacctagatattaaaggctatatgagaaagcctgggtgcccagttagaggcctgctgcaggggcagagcccccacagagaacctctactagggcaatgctgaagggaaatgtggggttggagtccacatgccaagtccccactggggcactgcctagtgatgagcttcagatgagacttagtacttttagcttgatgctggaatgagttaagacagaagagttggcagcggggggatcgtattttgcaatgtgagaagaacatgagatttaagtggccaggggaggagttatagagtttggatgtttgtccccttcaaatctcaagttgaaatgtaatacccaatgttggaggtaggacctagtgggaggtttctgggtcatgggacagatccctcatgaagtccttggtgctgtcctcttgataataagtgaattctcacaaactctggttgtttaagtgtgtgacacctcttccctctctctcttgctcccactctcaccatgtgagatgcctgctcccccttcaccttccacaatgagtggaagcttccgaggcctcaccagaagcagatgccagcaccacacttcttttcctatcttcagaaccataagccaattaaacctcttttatttgtcaattacccagtctcacatagttccttacagctgttcaaaatggcttaatacactcaccgaattgctcggcataaactgaagcagtaaatttggggaaaactgaatttctttctagtctactaccttaggaaggccttaaaattccattagtgaatttttaagccaggattcaggccttgctctattcaatgagtgtgtatatttgaggagcctcagaagagtctgaatacgcagtcaagtgttgtcattctcctcaaaagaggaattcgggcaatctctttgatggaacagtcaatgatggagctggacacacaattctggtgtgctgagccactcatttatttatgcatacttattttgtgtttcctgcaagctaatctttgtgtaaatatagccaagatatcatgaaaattcccatgtggagtctgtttggaaggacattagtaatacatttgaaagtttccagcagataaagtaccagaatgagaaaaaaaagaatactaagtgacaagaaaggcatccagagggtagaggctccattcagctgctgacctgtggttccactgtggagagcacgtgagaagtcccatttcctgcagctctctctaaggccgcagtggctgacacagagctgctctgcagcagcaggtctctctctgggcagcgtccagcagaggcagttgatggctgcagattgtggagagggcactatctgcctggagagtggtaggtctgctgtggattttctctgcttttagttttattttgaatacagatttgaattgtggacagtgttgcaggacatggaatctctctcttaagctttttacctagccaattctaggtctgatcacaatccacacctggttctggagaatgacaccactttcctcctgtggagaggcaggatgctgtaatcaaactgcagtatgtgggaggcagactgtgacttggggagcatgttcctgcctcctggttcttaactctacattgatggtggccaggcaaaagacaaacaggtatgagtgacgagaaactgaccttaggtggagtcctggagaaagtcttggaatgccaccttctactgctgttgctctatgaccccatccttttcttaatcccttggctggagaaactgtaggaaaaacctttccttccctcagctcctggaaacccatttgaagtctggttcctatcatccttgcagcctaaccttttctctgggagaaactgattgaagaatgtgaccaagagatttattctcagggctgccaccagagataaaagaagggtctgggagtgcaatgaagaattagaagcctcaaaatcaagccatatttcacaggttccatttgcacttggggaggggaggggagaagagaaaagaaggatgtttccacgcttgctcctgctgcgctccagctgagaaaccacacagcgtccatcctgctggactcctcgctttgcccatgacactcgctgtgggaatagggacccaggtagcatatttgtcattcacactttcttgaaatcagcatcatacaatcaccagcttccttggcatctgctctctatccattccataataaatacctctcatttcgttcacatcgatatacagtttactgagtcctttcacattagttcactcaaatcaatttcctgaggaaagcaccaagtgaggtttttgggggtgtaacagtgaacaagacttggaaggcccttgtcctcagggagcttacagcccactagggagacaggcatggccaatataagaaatcaatgacagtatagtaattgcacattgttgtaagtgttgtaaagcaaacaaataggacctgagataatgcatatactattaagaattatattaaatgcaaatcaatacaattctcaagttaaaaggcaggagaggaagtgggagtgactgcttgatgaatacagggtctcctttggaagtaatgaaaatgttttggaactagatagcaatgatggttgcacaacactgtgaatgcactaaatgccactgaattgttcaatttaaaatgcttctatttcatgttatgtgaatttcacctcaataaaaaataaagaaacaataatctgtacttatctgctcatatatctgatatcactcatcataatcatatccaactttatttgctggaaaactacaagtttatgttttataccacaatacccattcatatttgatatagacttaaaatcttctactatcttatatataagtatatatgttacatagtacatgttacatatatagcatgatatgtgttatatataaatcatatattttatatatataaaacatatacttttttatgtatataacttttctatatgtacagtgttaaatttgacccaaggctatctccatactttgagttcctacataacaaactgcaacttagcgtataaacaaaccgaaacctaatttaggagtataatttttaagtttgttgtaacaaacagccagatatcagccaacataagcagtcaagcagtcaagcttcagccaatcacaggcagccaactgataaggccacgccctaataaggcaatggctaactaatcgaactatttctgtgctttacttccaggttctgtctataaatgctcacttctcatatagagtggagctctctgaacctcttctggttctgaacgctgcctaattcatgaatcattctttgctcaaatacaatctgttaaatttattttgtccaaagtttttcttttaagaataaataattgaattgctttttgctattaacatagatccatttcccttcatagaagggtagcagccatcttgtgtgaaattcctgtatctcattgtctgtagtaaacttttccttagtcttttcctccaggctgaactatcccaggactctacattttcttcctgatcaagtttcccatcccttcaagtcttaccgtgattatctttgaagcccatcctatggtcttcatattctttcctcagtgacgttaccttatggggctcttcgcaagtgtcctctcctacaagggtacacctggatcatgccagatatgcacctgcactgaacacagaggctgcacatgctggaatatgttgtcctggctccatctttcataactcttaccctttctgcactcagccagctctcctgagctttggtttcacctttccattctgcctttctgggccagctccacactggtctgcacactagtctcttataaatatatttctgatctcttctctaattgaataaagtgaccgaattgttcaaatatcatggagatgaatgccttactcaaagatagcagactgtattcatatgctccagcctttacataagaaagatcatgcatgcattgcactgcatagacatgtgcccctggcaagagcccctggcttgaacatttatcctgaacagccatcctgcattcctcctatacttgatatccctcttctctccctggttcctcatcttcctagttattcttcacctggtttcatgcctttagtcttcttttttgctcttcctctttgttttaataacttgttgggaactcttttcctgggttgaaaaattatgttttctactctgtttggctcttaactttatatggcttgaacacaccctctggctgctttggtacatgagaattacatgcacaggagttttgtccccactgaacaatttcttcagctgaagagaggaagtatgtggcatacacagtatgtgccatattccaaacacgtatctgttttccaaagtaaaatgagttacttaaggacaagaaactcacaatatgcaaacaaaaatcacaaaggaaatgctcagaaaatggtttccaaggtggattttctctaactgaacaagggcccaggcatcattcccttccacctcttgaaactgatgacttctccaggttcccacaaaacagattctgtactacactgacacttgatatgggtccagttaattctaaaactctgtgaagtaaatgggacagcatggttatcctttcctagcaaaggaataaaagaaaagacctgtaaggtgaaaggatttaccctctgttatacaggaatttattgtggtttgaatctttgcttgtctgaaaatatctgtattttcccaagcttgtagaagcattgctttccactgccctccaacttccaacattgctatcaagtcagcacctctcatcctaatcctgtgcatgttagctgtgtttattttctctctttctctctcacctttctcagttttagtatcatgttttgtttctgaaatttcacaatggtatcactggtagatttttttttgttcatttatgtgaatttatgatactgcatacacaaaggtttttcaatctgaaatctcaagcctactggttctgggcgtttgtccagtattatttttccaataatttccttctgattgttttctctgttctctggaatacttcttagttagatactgttcttctgaattgaatctctaattattttttttcttttttattttttcttttttttttttagatggagtctctctgtgtcgcccaggctggagtgcagtggtgagatcttggctcattgcaacctctgcctcccaggttcaagcgattctcctgcctcaacctcctgagtagctgggattacaggagcatgccaccacacccagctattttatgtattttttagtagagacggggtttcaccatgttggtcagactggtcttaaactcctgacctcatgatctgcccgcctcagcctcccaaagtgctgggattacaggtgtgagccaccatgcccagcctctaattttgcatctagctattttccattaatcactactatgcctttttgtctgccttctgtgttttttacctctttacctaccacttctttatagatttagtctcgatctgttgcccaggctggagtgcagtggcatgacctcagctcactgcaacctccacctccctggttcaagagattctcctgcctcagcctcccaagtagctgggattacaggtgcacaccaccaagcctggctagtttttgtacttttagtagagatggggtttgaccatattggccaagctggtttcaagctcctgacctcaagtgatccacctgcctcagcctcccaaagtgcagggattactgacgtgagtcgccgcgcctggcctaatgtttttaaatcaaaatcttttttttttttaatttctaagagatctttcttgttttcttattgaatttgtttttagcatctcagttgagataaaaggcaagatcgtgactgaagggaagaagcctgctctgagtttcaaatacaaaattggtctttttgtcagaacaaacagcttgagaaaaaggagtcactaaaactaattgtttttcgttatcaaaaacattcagtgctcatggagaacaatatttgagactccattctattatgaaataattggggattatgtattccaggttttatcacaattatcttaaaaatcaatacttttttagaatcagtaattaactgtttatttagctaaccactacttccaacatcccaagtcttcctcagtttaactattgatatttttgttttagtttgcttgaatagatttgccagaaatttctgataatagggcttatgattagtaaacttcgggtccttaaaaaaaaagggctcaaagttgcttaaaacaactatttttaaccttgtaattttgggggcttggattagaattctagctcaaaataacacattacaaaattttaaagatactgatctattgctttcagaaatttcttgcttttaagaaccctgattccaatctggtatgcatttctttatagacaacctgtagtattttttgtttgcctcgttagctcttagaacttctttttcattcttggttttctgaaatgtcaccacacggtgtgcttatggtttgtctgttacagttatcctatttaacacccagtgagctatttctatttgaggattcatgtcttcatttatgaaaaaagaaaaaagtcttctgttatttattttctcccttcaattctcatttctttttctttttcaagtcctattagatggaatttggaactctctgataaatccactttgtctcacaatgtttctttaatattttctatttctttgtcctttggggatacattttacgacaattctttgttgtcatttcccagtttacaaattcagttttcagctatgtttattctgttccttaatccactatttttacttcatttatcttttttccctccagatctcaaagtttttgctttaatttatatataaaatactccaatccatttctgtgatgttatacatgttaatattaactacgcttattcttaatttcttgattttctaaacttcctttactattgcgatatcttcttcatgtaatttgaaattttaatgtattcaacatgtccttttaatgatgttgatttcttgccagtgtttggagattcttgattgtatggccatctttgcttttgtttctttgactgagaggggaattgaacatacatttctgctgagtaaggtttgctctgtgtgtgtgtgtgtgtgtgtgtgtgtgtgtgtatacatacatgcttctactaatatttatatgtattaaattaatgaaaaacaagtctctgtcttcacaggttagtcataacctatggcatcagtctgcccagaaaggcagtctatcctggaatttaagtaatttttggtggtagacaaaccagtaatgccaattactaactctacgactttggataaattattattctctgagcctcaactttcttagcaaagtgaatatagctcaagagtaatgggaggattaagtgtgctcttgcaaatctgtacactagtgcctggcactagcaaacaataacacaagtgttaactgttattttggttgtctccaatcagaacctattaatggagaaattgacacggaaaggaaggaatcatttagtagaattggtaatgtgatgttgggtgaaatactttgatccaagaaatgtccctgtccttgtttcctcactcactgtcccctcatagaaatcctcggtccccctatgtctcatgtcctgaaacgtcgggtgggagaggccctgagacacatccacacagccctgcagcacagaggtgagcacactaggccaagcctgggcatgaggagaagagaacactgtacccgccagaggtttgcagctttctctgaggatgggaacccacgtcccccctcagggtttcatcctgcgggcccatctgttctgtgtttttgcttttgatttccactggtagctcttgtagacagctgagcatcttttctcccaagaagtgagcaagaaaaccttagccaaaatcagcagctgttggtgtgcttaatagagaaaatatctcccagagctgccaaggccacatgatacaatgggatccgcgaagcccaaggttcttttcccaaggcacaaagcaaattttagcacaaagaatcttcacttggctcacttccgcccttgggtcataagtgcgggaccccagactcattcttcagaggtgctgcccagccatttggaatggactgtggtggtccatggatgtctgggaagtggtttgcttcttgtctgtgttccttctctgtggctgcaagcttgctggggctggattcccaggctctccgacagcaggagtgcacacaccctgacccagcctggattatgtccctctatagactggccatcattcccacctctcaggtctcaaatcaggctatgagtgcagatttcgtaccaatctgtggactgtgggtttgctcagctgggacctctggggcctccagaagagtggagaagagacagagtgctgataggttgggcagatgaccttcaagatcaattaacactccctgattgcagccaactcctcagttctaatcctagcagatgagcaacagggcctatcacttgccccaggtctcacattccaagtcctgcactctctcctctgctcttaccgccccatcctggaggagtcaggaaagccacactgcccttggctgcctggacttcccccaccagctgagctgctgagaggctggtggactgaggggcggagcagacttctgactctctgaggaagaatccagctgagagcccctcttcttaagtgcttccaacccagccagtccgagtaaagcaggtctgcaaacagggtgagcaggggtcagaagggaagagacagcctctataaacatcaacaccatgccctagaactaggccccagctggagcctcgccagcagcctcccagtcaatcaagaaaaagatccggaattggggaaaaggaagatgcatcagggccaagcctcgcgccagatctggcctgacgcttcttggtgccattgactgtcctggctgcattctgttcgcccaaggtcagtcctgccaccaggccagggctggcgtaactgccctccctgccaggccttaatcccattccctggaattaggcctcatcttcctatttcttcttgcggggcttgtagggaagggcttttcctgatgatggacagggctttttctggtgccagtgacaactccagggttgcaacctccatccagacattctctcacctcatccatggatttcaacagttgctcagactagacttgagttttcatttgatatcaggggcatagaacaggggaagaaacaggcgctttagttttagatctctgtcaaagtcctggctctgcacttactacctgtgtggctttgagcaagtcgcttaccctctcagagcccccacttcccccatagagaaatgggagaatggaagctatcagagtggcttccatttagaaggagctcctcccagcccttctctaacaggtcagaggaatggatgtgcttccaccactccctggcatttggaatcccagccaagtgccggttctggcttggccatctgctccatcgctgtcagcacactgctctgcatggtgggacagttccccatctatggtgctctcctgagccatcactgaccaggcttgggtctccttgggcaacctttattatgtggtctgcccatagtgggtggccctggctgctcccagggcagggaccatggcactcagcctgcatctcaggagtacctgtctgcattttactagtttctccatgaagacttgctgggttgaaaagagttgagaacatggcataagctgtgggatggggaccaagagaacctcagcttcatgctctaactttactcaaattacccaaacacttcagtgcaaacgcatcctcaaaactattcctcccatgtgtcttctgccttagagaatgacaccagcttccactcagtgccaaagcctgggcttcacttctcactgtgcccctcacccaccctccccactccaccacccttctctatcaccctctccaccaccctctccattgccctctccaccaccctctccatcatcctctccaacaccctctccatcaccctctccaccatccctccgcaaccatctctatcatcctctctactaccctctccatcatcaccctctccatcgccctatgcttcaccctctccctcctaccaatctccaaaacctgtggcttctgcttcctctgtcttatatctcatgtttagtctctagaatgcacgttagtttagtgaccagagaagaggtcccatgccactgggctttcactaatgtcattgccaccacctgcatgatttcacgccagcaaaatctttctcccagcctgaataactcttactcatcccaaagacctcaactccaatattgcctcttctaagtatccattcctgcctctttccaaattggattaggtgtttgccctcccagcctatatggattagatgtccccctgctcaacctatatgctcccttctcacccccatagagtaattgtcattctttgtgaatactgctagtttgcttgtctgtgttcaacactagatggagtgccctccaatggcagggatggtgtcagtacttttcaatgtgatgttcattcctagcaggctacagacagggtttagtaaacactcggcatttcttgaatggataagttctccttctgtagaaatgaacttgccaaaggtgtaggtaagactctcccagattaaaggctaaggagcatgaccactaaattcatcttgtaaacctgggttggatcctggatcaggaaagggccattcatgggacaattggtaaaatctgcataaagtctatggattagatgaatgttctatcaatgttaatttcctgatgttgttccctgtactcagatggcctgagaaattgacatctaggaaatctgaaccgaaaagtatatgggaattctttatgctttttttcacctttttcgtaaagtataaaattatataaaatcgaaagttaaaaatgcagacaaaataaaggtgtatattaattgaaaagaatgaaaactaacttcaggattccctcggaacttgattttttcattagtaaatttatcaccagttttcttttccttctgcttccccttttcctataaaaagcagtacctgtatgacagggcgtgggagggactcactgctgaaagcttacatgacaggcacgtgtgtgatgagtaggcccctgaaccctgctgggtgccaccaaccagcctagcaggtgattgcagagcccccagtggtcaaggtggacccggccagcccaacacaccggcccaatgcaccggcccaagcgcttcctgctggactggctgggcaaatgactcatctggactctaaacactagagctgcttcctaccatgctgaggacagcacccgttcatgggaatgggcttcacaaacagaaaagacccccaggaaggagagcgcctagcccaatccctagctccaccctgtctttcatcctcaagccaagacggctcgtcctccgcctcgtcctcagggtgtggacagactgtctgagtctcagggttggggccttcccttcagatgtcaggagtgcaggagaggttgcaggtgaaaccccaggcctacttcatcagcttgagccccaaagctggacaaacatcccctgtggcagctggcaggcctgtgccctccaggagtacagctggtccaggccgcccttcccatccaagacttgcagacgtgggagccatgccactgcctcctcctacagctgcagagcccctgcactcagaggcaggacaccccacatttatccacccaagctccagaagaagggcagtcagccttggcttgggcatctggggcaacatggtaagcactttcccacagggctgcccccagggctgttcaaaagctactctttggaatgaaataaaatctgcccccagcaacatccacctacag

SEQ ID NO: 217 - DNA, 430754 bp, Homo sapiens
aaggacatattttgggggatgctactgtattctttaagaaaaaggaaaaatggctcaaattatctttcagtagtgtcatggccctctgctaggaaactggtttatgatttgaaggtgtctgagacgttcactctgattacagtgcaaagggtcatttgcactctatgatgcaatgatggcggaattctgtctcaactttgctgtcggccactctgactagtgttttttgtttgtttgtttgtttgtttgtttgttttttgagagggagtctcgctgtcaccaagctgcagtgcgatggcaccatctcgctcagtgcaacctctgactccctggttcaagcgattctcctgcctcagcctgccgagtagctgggattacaggcaagtgccaccacgctcagctaatttttttttttttttttttgagatggagtctcgctctgtcgcccaggctggagtgcagtggtgcgatctcggctcactgcaagctccgcctcccaggttcacgccattctcctgcctcagcctcccgagtagctgggactacaggctcccgccaccatgcctggctgattttttttgtgtgtgtgtttttagtagagacggggtttcagtgtgttagccaggatggtctcgatctcctgacgtcgtgatccacctgtctcggcctcccaaagtgctgggattaccggcgtaagccgccgcacccggccatttttttgtatttttagtagagatggggtttcaacatgttggccaggatagtcttgatcttctgacttcatgatccacccgcctctgccttccaaagtgctgggattacaggcatgcaccaccacacccagcttactctgactaatcttttatttcagtcccttccccttccctttctccctcattccccacttcctttcctcccacttttcctttcttccttcctcaactacttgtttaaaacctgtttctcttctaggctataaagatcccgtttccttcccatagctgaagaccatttagggaaggtggaagtacatgcctataatcccaactacttaggagacagaggcagaaggatcacttgagcccgggaattttagtccagcctgggcaccatagcaagcctccatctcaaaaaaagaaagcgttttcatatatgagtaaagctgaggcttgcttatgtccagagggggaaaggttacacattttcaaatatacctgttgcattttcttacacagaaagtgggatagcaaataaatagaacatcttgtctgtaggatgaatgtaaccttaagaagtattgcagtgtgttattattgcttaaaatgtatttatttaagacctctttgttgagaaaatttctcagtttgggtgaaaagatagagaatggaaccagtatgcagtagttatattgttgagggagtcttgaagtggcaaagaaaatgaagtatttctttcaaatagtattttgcaaccgaactgaaattccactctgcacaaatgtgcctgcgaaaagttacagtaatttaggattgaaaaacctgtatgttgctaaattcatagttaacctaattttagtttttgcagaaaagacgatttatagtatgaagaaatgataatacttttttaggagttttctttttttcttttctttcttttttttttttttttaaagagacagggtcagccaggtgcggtggctcatgcctgtaatcccagcactttggaaggctgaggtgggcagatccccatctctacaaaaaatataaaaattagccatgtgtggtcgcacatgcctgtaatcccagctacttgggaggctgaggcatgagaatcccttaaacctgggaggcggtggttgcaatgatctgagatcatgacactgcactccagcccaggcaatagagtaagactgtctcaaaaaaaaaaaaaaaaaaaaaaaaaaaaaagatggggtctcaccatgttgcctaggctggtcttgaactccaggcctttagcaatcctcccaccttggcctctcaaagtgctggaattataggcatgagccactgtacctggactaaaaaagatttttcatgcgaaaattatgtgatttttggttacctttgttgtaaaaacattttttcctttttatttgcttcctagagctctattcagtgagaaggttttattctgtgtattaatcagcacacacttcccatgcacatcttctcctaaagtgaaggcctccaacctgaatttcatccctgtctccaatctaatctttatcagggtgattttgacttcgtcctaccctctggatggcagtggggccacaggtggtaactgtcactctttgaagcttcctcatgtccataggcctcggtcccgggtccatttgttctcagcagcgggttgtgccctttgcatctgagcttgttcagtgtccatagtccatggtgtccctcctcaggtctggctttgctttgtggttcacatggctcacaatccggcttgcccaggatactgccactgtacccctgctgctccaccatagttattcagaacaccactttccttctctagtttcgttcctgagttatttcaggtattagtgcagagaggggccaggttcagcttgggtgttactttattttttaatttttaattttttaaaaatttatcattattttttagacagagtctcgctctgtcaccaggctggagtgcgatgacgcgatcttggctcactgcaacctccacctcccgggttcaagcaattctcctgcctcagcctcctgagtagctgaaattacaggcgcctgccaccacacccgggtaatttttagtagagacgaggtttcaccatgttggccaggctggtctcaaactcctgacctcatgatccacccgcctcgacctcccaaagtgctgggattacaggagtgagcccgcgcctggctgcccagctaattttttttgtatttttagtagagacggggttttgccatgttggccaggctggtctcgaactcctgacctcaggtgatacacccacctcagcctcccaaagtgctaggattacaggcgtgagccaccgtgcctggccttgagtgttactttaaatctaatattgttgtattggggtagaggtagagaaaccattgcctgtagtaacttagtaacaatgggtctatattagtagggttctgatctgggaagaggatatcaattatttacttaatagataatcatttaccacctattttgtgtcagatacagttccaggtcctgggaattatagaagtcaagaaaacagagtcagggccctaaagaagcatgcattttggcaagagacagtggcaataataataataaaaaaagatataatttaatgtcgggtaacaataaatgctgtaaagaaagcatagcatggagatagagaagttgctgcaagagctgttttagagggggcggccagggacaacttctgaagaagggacacttgaaccatcgtcacagtcatctagatagatcacagtcatctagatagatcttgtgcaacgggaaggcctcttcgtattccctctaagctcatagaggatcgtgaaaagtctgtggaatcttactggggataggacagtaatttacacagtgctatggcgatttgttttgtatgtattatcttcagctgctgggaacttgctttccatagtccatctctagccatctccagtcccaacaatcctacagcctacatttgctgtttggtatattacccagatcacgttttcagtcactttatttttttatgtatttatttattttttgagatggggtttttctcttgttgcccaggttggagtgcaatggcgcggtcttggttcactgcaacctctgcctttgaggttcaagcgactctcctgcctcagcctcccaagtagctgggattacaggtgcccgccaccatgcccggttaatttttgtatttttagtagagatggggtttcaccatattgggcaggctggtctcgaactcatgacctcaggtgatctccctgcccctgcctctcaaaatgctgggattacaggtgtgagccaccatgcccagccgtttcagtcactttaaaagttctaagaggtatggagagagaggggcattttagaacatggagccgcacagctatagaatgtgtcctggcgctgttccctgtccgtcatgtggctctgtaggaagaagacattctgggaaattctatgctccaggtcctagcttggagcctccctccctctgtgaggtttgcaacatttcctgaaccttagagagtaaagggaaatgtgctcctatatccagaacttccaaatgtaagtgtttgccaagtgctttgcaatctgcctttccataatttctctcattatctctgtgatgggatttatcatgctgtactgcactttactgagtaaatgtagggacagatggaggtggcagactggaggagaagagcaagagatgacattgagctgggagctcttcacaggaatggtccgtctgtgggcttcctggggggtgaggaggggggacaaatatgtgattggcacatggtattgccattcagtaacacctgtggcatgaataagctacctagggtgaaggtgagctgctgtttcgaagttttgaatacaattatattttaaattaatgaagagatcctggcactgaggaggttgaaatccttttgcatggtggattttctggatctgaattttataaggaatttttttttaaatagcattgaaagatttttagtagatgaagacaacatgcgtagtaaggtggccattatatggtgagtcagttcactatgccctaggatttgaattgctgttaagttttggatgttgtaactgactgctggttggtctgttcctatttttgctgctgttgttcatccatccaaccatgcatctgtgcatccatctgtccattcattcatccattcatccatttatccatccatccacccacccacccatccatccatccacccacccacccacccacccatccatccatccatccatccatccatccatccatccatccacctctccacccatcaatctgtccactcatttctattacttactagtagtgtgattattttcttcatctcacttggactcagttttcttcatctacagaatggtgagttttgtctaggttattgaaagggtcctgttaattctagaatcctaagattcttaccatttgattacagtttgtgcaagacaattggaaagaatacaaacatgaattaaacatgggttctgccctccaaaagcacattgtctggtaggcgtgctgacatagaaacatggcacaaatgtgagtagagaatgaccaagtaccaaacacagctgcggttaatgtgtgcgatgggaatttcaagaaattcaagaaatttggctgcagatgttaaggaaggcttcagaaggaaggtggcatttatgtttgagtagagcaaactgacatgtattaacatcatcagttgattagcatcctcatttcatttaatgttcacagtagtgtatggtcttcactttactatccccatttagcagatgaagaaactgaggcagaaaaggagattaagtaactggcccaaagccacccagctgtattgtggcagagttgtgattaagaggatgtctgtcaaccccctttcatccttttgtcttaaaaaatcgagtcagtaggccgggtgcggtggctcacgcctgtaatcccagcactttgggaggccgaggcaggcgaatcacctgaggtccggagttcgagaccagcctgaccaacatggtgaaaccccgtctctactaaaaatacaaaattagccgggtgtgctggcgcatgcctgtaatcccagctactccagaggctgaggcaggagaatggcttgaacctgggaggcggacgtgctgtgagccgagatcgtgccattgcactccagcctgggcaacaagagtgaaactccgtctcaaaaaaaaaaaaaaaaaaaatcgagtcagtagagagatgaggattgcaggattcctccctttccctcccctccactcccctccgctctttttttgagacagggtcttgctctgtcccccaggctggagtgcagtgcctcgatctcaggtcactgtaacctccgcctcctggactcaagctatcctctcacctcagcctcgtgagtacctgggatcacaggcatgcaccaccatgcccagctaatttttgtatttttttgtagagatggagttttgccatgttgtccaggctggtctcaaactcctgatctcaagtgatcctcctgcctcagcctcccaaactgttgggattacaggcgtaagccactgcacttggcccaggatatttcaggtgaagaagaccatcagtgccctggcacaacgaggtggaagtgccctgtgtacctgagaaacagcacagacttcggtggcgctggagcacagtgtcccttaatggcagcagtggaaaccgagcctgggatgacagcttgggattcgaggaggctttttattgtctgactacagggtctggtctttatttggcccagatggagactttgtgcagggtggagacatgatcagaggagtacatttcaggatgtttatgactctaagaccttcttatgattccaacatcctttcatgctcctaagctcttccatgtgatgctgaggaaactcccctcccctccccagatgtctcctgcagcctcagcccttgagcattttcatctctgggtttctgtgctaaggaactcagggccctggcttcccatcctaccattctgaacatcagcacctttaaaaaaaacccctctcaattcttgggattctgagaagaaaactccttcatcttcccctttctgctctttcctagattttaacctaacttcagctatttcagaacgttttctgttcaataaatgaataattagatcttcttgggctttgccagtgaaaaatataccataatatttagattaaaacagtgtaatgactacactagcaaaatacaccccggttacatgatgaattcctccttttcatttttatttgtggtatcctggggtggcctactggagaaaaaaatactatttgatcctccctgggtggtcagacaggacttgtaaagactcctgtttgttttgtgttgaggtttcaaaggcacgcaggcttttctacataaagatgttctaagaaaatacggatttttttttgaagttgctgtgtataaagggaaattcaaagcaaccgtcttcccttacaactaccagctaatgtgattagagcgtctcttttcaccaggcatctttgttgttaccatctctggtcattaccaccagtcttgaggggagatgtatgcttacaaaaaccacctccacctggctttatttttggcgcgatcacacaaacatgtgttttaattttaaagattatatttattgtcacatttagattttttttaaaaaaacactaagaaatctgagtgttgtgtgtgtgtgtgtgtggttcaggatgcactggaggtgtgtgctgccacaacaaatttcaggccacgtgttctgcagattccaattagcaaggccctcctgctgtggtgtgggagaaaagtttggagtggggttagggctggctgagtgtaggaggctttttaatgcaatctttgcagaactccctcattagcacctcgaggtcagtgggaactggtatacagagcacagttggcattttctgctatgcatggtgtgtgtcagccattttatttatccatgcttattttctccgtttcataaaattaattgtacttaatgggggaggggttgataatgctgaattattttaagcctggagggagctcagcagctgtgtcctagatcagaccaccgatctatctaataggttgtcttgctaccggatccactggacgaatgtgtttcgccaattagacgaatccctatatggagagaaaaatgaccttgagccccagaaagccagacagttgcttcgtgccatgtcttcacctactgaagctgcttcaccgccttggcctgataggagtgtagtatatatctaacctctagacaattaaatttctcctttaaaaaaatagccactcttatgtgaaatagtcaaatctttcatgacttgccaagatacttgcttttggaatcaggtgctttcgggtgtagcctctaaaaattttaaaggagagcaaatcttccaagcttccttcttgtatcaaggcataacctgctgaggtccaggctgcagtgatccatgatcatgccactgccctccagcctgggtgacaggctgagaccctgtcgcaaaaaaaaaaaaaaaaaaaaaaaaaagacataaccccctgctataaaatatatatatgtgtgtatgtgtgtgtgtttaagaggaatatcagagaaagataaatttttaagtaaaaggaaatattataagctaattttgttgggtattcttctgggcaattattttatcatcgaatacatttccacaaaatgccagaattcttttttttgagatggagtctcaccctgtcgcccaggctggagtgcaatggcgcgatctcagctcactgcaaactccgcctcccaggttcaagtgattctcctgcatcagcctcccaagtagctgggattacaggtgcgtgcctccacgcccagctaatttttgtatttttagtagagacggggtttcaccgtgttggccaggctggctcttaaactcttgacctcgtgatccatccgccttggcctcccaaagtgctgggattacaggcgtgagccacggcgcccggcccaaatgccagatttctttaaaagataagcctgggcacagaaaacaaacttgatgtatgatagaatcttgcactttttaagtcctggagttaaaatttactgtggctttggtgtgactctaccagcaacaggatggcactcagtagagggcacatggtatagtgggaaaacctcttgggggtcaaccaggtccagattttgatctgtgcctctgctgctactagctctgtgaccttaggcaagttactgcacacacttggccccagtctctttgtagccttctgctgctattgctgctagcttcacaaaatcgtttcaaaggttaaatgaagtaaactatataaaataaatatctagggctgggcacggtggctcatgcctgtaatcccaacactttgggaggcagaggtgggtggatcacctgaggtcgggagttcaagaccagcctgaccaacatggagaaaccccgtctctactaaaaatacaaaattagccgggcgtggtggcacatgcctgtaatcccagctactcaggagggtgaggcatgagagtcgcctgaacccgggaggtggaggttgcagtgagctgagatagcgccattgcactccagcctgggcaacaagagtgaaactcccatctcaaaaataaaataatatataatataataaaataaataacatctagcttatatattaatgttagttcattttcttttcttctcattacatccaaggactagtaattttccaagggtagtaatgttccattaattttgggagtcactctggagaatcctgtaaattttccagatactgaaatctaagcctacaaaggcttaatgactctcttgcaatgccttaggagtagcagagttggtgcccaaatcgtgcctcactgaatgcttccagctttactacaggtgtgaggacgacgtagaattctgcactgagtccctggcgtggctctaaaacagtcaagtgcagtgacggtcttaagtgtagaaaacactcgactttccagatcttctaggaaccttcaaaatacacagaaatgtgtagtgaaaccttaccctactgtgtcgccgtcagtttacttttacaacttttgactcagtttccctttctgtcccctagtaccctcaggtgactacagatgtgttaacacccagcatgttccggtaggagactttctggatggggaagatttccaggtaaaggaccaccctgattcccttcgtggctatagcctgctgcctgcccttccatgggctgccgcagacttcctgatggccactgctgccttcctccttctccttttttgcattgattgattggttccttatctatgctatttttctatgattttttggtattatttttaagtattcatacgtgtacactgttaatgatataaaacatgcatggagtggtaagccctaacttcaggataaggcttaccctctgaggagggaggctggggcacttggccaatgtcaattctgtctccaatgttttaaacttttttccccaatatgtatctcttaaaaagaagaatttctttccttttcatttctttctttctttctttttttttaagacagagtctcgctctgttgcccaggttggagtgcagtccagctcactgcactgcgatctcagctcactgcaacctccacctcccaggtttaagtgattctcctgcctcaatctcccaagtagctgggattacaggtgcgcaccaccatgccctgctaatttttgtattttttagtagagtcaggatttcgccatgttggccaggctggtcttgaactcctgacgtcagttgacccgccagccttagcctcccaaaatgcttgggattacaggtgtgagccaccacaccgggccagaactccttatttttatttaaaacataactgtagtgtcacttttgctcttaaaacagtagttaaggctagatgtggtagctcactgaaatcccagcactttgggaggccaaggtggaaagatcgcttgagcccaggagtttgagaaccagcctgggcaacacagcgagaaccccatctctaccaaaaaaaaaaaaaaaaaaaatatatatatatatatatatatatatataaaatttacatttttttttttagccaggcatggtggcacatgcctgtagttccagccacttggtgggctgaggcaggatcacttgagctcaggaatttgaggccatagtgagttgtgattatgccactgcactctggcctagacgacagagcaagaccctgtctcaaaaaacaaaacaaagaacaacaacaaaaacaacaacaaaattaccaagagctccccgccagccaaaacaaaaaaacatcctcaaacagtagttaagtccttcatatcaaatatccaactagtgttcagtattccaattataattggaatatatttatatagagagatagtaacaaaaccaaatttgtttggcatttcaaatgtttgaagatgccagaagtttaatctagagtagtggttctcaaaatttggtcctaagaccagcagcatcagcatcacttgcgaacttgccagagacggaaatcattagaccctacagctgactgaatcagtgattctgggagtgtagtgttttaacaagccttccaggtgattccaatgcgtggtagagttaagagaactactggtctaaaggaaagcaaaattttatgctctttacacaccctattttgcatttgtctttgtgtttaacatcacagcatgtgctgagatgatgtgcttacacacttgggtcaccaagatggagtccagccttctattgccttctagggcctgtgccaagccaccttccatttctagctgtggagggcagcacacacagactgctgctgcattaggaagtgtgtaggagagcagggaatggaagtggtgatcatgattttctggagcaggacagagagagtgaaaatagagatctgggtgtatttgatggggaaatcaccttcttttttaaaaagcatacttacaaagttgtggtcctcaactgctggcagcacagtcgaatcactccagagggctttgaaagacactggtgccctggcctgaccccaggaaattctggtttcaattgggttgtgggtggggttaggggtggtcccagcaacagcaagatttaaaggtgcttcaggtgattctaattgcagtcatggtccaaaaccactgggaaagacttgtgtttggtttgggattcagttgggaaactaagatgaaaatatcctgcaagaatgcactcgggggtcttacccttcaaacgagtaagtactttgcaaactctggttcttaagccattagcgacctggtttgggggagtttttttctgccatctctagctttttttgttgttttgagctactgctgactctttctgcagtatttccggctagtttttgtctaggtaaggagatttgaatatggtttgtctactcacttgtaggtgtcttgggcagaatatgcattttttaaagtatacaaatgacaccctctttcacctccttcattctctttcctgtaaatggctatagctccaggaaatgaactcgagagactgatactacattttgcaatgtgaggctttttaatttttctaagactatcaacgagaccagagccttccttgcagtctccgaaattatggaaaggaaaggttgggctgtatttgttggttgagtgttgaaatagtccatggaaaaaggaaagggaaacaagttctactactgattttcttggcagagtttatcacctgtcccccccaagtttctggcaagtgtgattagaaattgacttgcaggatttgctcacactggcttcccaagacagtttttgcttgcatgctgctgactagcagtagttaatttgctatctttcacatgtgttatccaaaaatcacagaactcattagaaataaacagcatgggctgggcgcggtggctcatgcctgtgatcccagcactttgggaggccgaggcgggtggatcccgaggtcaggagttcgagaccagcctggccaagatggtaaatccctgtctctactaaaaatacaaaaattagctgggcgtggtggtgggcacctgtaatcccagctacttgggaggctgaggcagagaattgcttgaacccaagaggtagaggtcgcagtgagccgagatcacgccactgcacttcagcctctgcaacagggcgagactctgtctcaaaaaaataaataaaataaacagcatgaatttggttggtcatatttgcaggattagccagatgtaaatctgagttgcacttgggaggtttggtgggcttcatttaaaaacaaatagaaccccagccttgagtagaagcagatttttttaaaaaatgaaatatcttactggaaaacaaaccttatttttccaatagaaaatatggggaagaagtaagctttttttggtgccaatatttattttatttcatgcccttcttgctgatggcagatgtggcagaaataaatacccaatttcattttccaaaatgggaaaaatttaatcaattcaagaatttatttattcttaatttatagcagaggtttgaaacctgactggttaaagtatttaatatgcctcttaggaaaataaacatacatttatgtatttcccaaaccattttgtggaataatcaccacacaatgggttattgaagaggtgtgttggccttgaggctgtctaattcttaggccttttgaaaagtgtttaagagatattgaaaaagttttttttcatgtgattacaatatacgatttgtgtgattggaaaatttctgttttctgttgatatgcaaactcactgccagcaataccaaatattcatatgccacctgcttccttttttttttttttgagatggagtctcgctctgtcacccaggctggcaccatctcggctcactgcaacctccgcctcctgggttcaagcgattcttctgcctcagcctcccgagtagctgggactacaggtgcgagccaccatgcttggctaatttttgtatttttagtagagacctggtgtcaccatattggccaggctggtctcgaactcctagaccttgtgatccacccagccttggcctcccaaagtgctgggattacaggcgtgagccaccatgcccggccatatgtcacctgtttctaatcccaacaaaacctgtactcagaatgaattaaacaaacaaacaaacaaaaaaaacccttacctttgaagaaccaaaaaaggaattcaaattttattgaaactttttgtgtttatccttttagatcacactaaatcagatgagtacacaaatgccaaggaattgactcttacaagtagagatgatgtttcatgcagacacatgagttaaaggtgtgctagaaacttcccatgagctgattttgatcattctttgctctagtacccccaaagcttagcttaatacttaattatatatcatactaccttctctctctctctctctctgtgtgtatgtattattttccaccaaaatggctatttgtaacctgccatagtaaaaggtctgcttattcaagaccaggacaagactttccattgtcttgtctttctgcccatgacaccattcatttttctcttcttcagcattgagatgagatttataatgcatcgtcctaccattttctaggcataaagataatttgcctggttagcttttatttagtgattcaaaagaaatagatgatcagatctggcagcgactgacttttcacgattcattgctgaaggctttattctatgaagacctttgttgctgaaggtatgaaggatgtggtagtaatggaaagtattttactgatcttttatttccttttaaattttttgagacagagtctcgctctgtcatccacgttggagtgtggtagcgtgatctcagctcactgcaacccctgcctcctgggtttaagcacttctcctgcctcagcctcccgagtagctgggactacaggcgtctgccacccatgtctggctaattttgtatttttagtagagacagggtttcaccatattggccaggctggtctcgaactcctgaccttgtgatctgcccacctcgacctcccagaatgctgggattacaggcatgagccactgcgcccggcactgatctttatttctaaagagcttttctccccttgcaggatctttggtgtcaagatactataaaattccagtaaatatggctgcaaggaagggtaaagagaaagaaagagagacaaaataaagtaccagaagcaaatagtcctttccatattcatgtcacgtccgtaagattcaagaaacggatattgaagtggaagaaccagactttctcttcattcctatgatctaattaaatgtattttcacttaaaaaaggataacaatattagatcttaatgggattaacctaactgaaatttatttgactttgccttgaccataaagattatgaaggatccaagtttcattttgtgatggtagtttcaggtctgtaatttttgctacattccattcctgttgctgttctacttaaaatatcagttatcggccgggtgtggtggctcacacctgtaatcccagcactttgggaggcaggggcgggggtggatcacctgaggtcaggagttcaagaccagcctggccaagatggtgaaaccccatctctactaaaaatataaaaattagctgggcgtggtggcaggtacctgtaatcccagctactcgggaggccgaggcaggagaattgcttgaacccgggaggcggaggtttcagggagcggagattgtgccactgcactccagcctgggggacatgagtgagactttgtctcaaaaaaaaaaaaaatcagttatcagacaaaacttgtgtgttgtatggcggagacttagaatagactagagtttgagtatttttcttttttaagttttggagatgttaactcttactgtttttatactgaagtgaagtctgttaagttaaagaggaacctttcttttattttctgtgttttttggtttcttttttcttttttttggtcagtttcttagggtttctcttgcttggaattatctagatgaactgtttcttgagtccagcttcagactagagtttgagtatttttccctttaactttttgagatgattaactcttactctgtttttatactgaaaggaatctctttagctaaaataaagaggaatctttcttttattttctgtgtttcttggtttcgtgtgtgtgtgtatgtgtgtgtgtgttgcgccagtttcttagggtttctcttgcttggaattgatgaaatgcttctgagtccaacttcattgataactacctactcctccctttcctttgtatgtgttacaggatttcagtaatacatattttttattgtggtgaagtatacataatataaaattatcatttaagccatttttaaatgtacacttcattggcattaaatacactcatattgttgtgtgcaattgttgccactattatcttttgaaagttttcatcttccctctcactcataagtgggagttgaacaatgagaacacatgagaggggaacatcacactccggggcctgtccggtggggtgggggtaggggagggatagcattaggagaaacacctaatgtagatgacaggttgatgggtgcagcaaaccaccatggcacgtgtatacctgtgtaacaaacctgcacgttctgcacacgtaccccagaacttaaagtataataaaaaaaaaaataaagtttttatcttcccaacctgaaactctgtacccattaaacactaactcttcattcttccctcccctcagcccctggctaccaccattccactttctgtgtctatgaatttgactgctctaggtacctcatgtaagtggaatcatgcggtatttttcttcttgtgactgattttttccacttagcgtaatgtcttcaaaattcatccatgttttggcatatgtcagaatttccttcctttgtaaggctgaataatattccattgtatgtatatatcacattttgtttattcattcatctgttgatggacacgggttacttccacctgttggctattgtgaatacctctatgaacatgggtatgtaaatatctggtcaagtccccatgaaaagtgtctttgtgattaattattattattttttgagacagagttttgctcttgttgcccaggctggagtgcaatggcacaatctcggctcactgcaacctctgcctcctgggttcaagtgattctcctgcctcagcctcccaagtagctgggattacaggcttgtgccaccacacctggctaattttgtatttttttaatagatatgaggtttcaccatgttggtcagactggtctggaactcctaacctcaagtgatccacccatctcagcctcccaaagtgctgggatcataggtgtgaatcactgcgcccagctgtctttgtgattaagtaaaacaccctgatgctgatttagataccgatttagcaactttaaatattatggtattaataataaccattaattaataataaagctttttatgtaaagtgattggaatgagtttgtcaggtatgagttataaaggcctccagaagcatatggggaagttaaacacatggcaatgagaactcttttaagaatgcacctggctggataccatgacctgcttaagatctgtgttttagaatcgtcattgaaaagaaatgttgcagccaggcacaatggctcatccctgtaatcccagcactttgggaggccgaggtgggcagatcacttaaggccaggaattcaagaccagcctggccaagatggtaaaaccccctctctactaaaaatacaaaaattagctggacgtggtggtgggcacctgtgatcccagctactcaggaggctgaggcaggagaatcacttaaacccgggaagcggagtttgcagtgagccgagatcacgccactgcacctcagcctgggtaagaaagtgagactctgtctcaaaaaaaaaaaaagaaaagaaaagttgctgcatgacagacatctggaaaagttaaactataaaatgacttgcaaaattaacatcctctggttaaccaaaatcctcaaagcagagggcaatctggtgtttgggatgtgagtcctctcctctagagggtcaggcttatcgcttggaaagcagattagcactgctagcacacaccacctaaagatacgcttcccatcctcacattcttggtgttttcagtgtttcgtcttatctgttgtattctttcaaattccttaagcttaaccacagacaagctccttcttggagttaacactatttatcaagtatataccgtatgaccaagctatatattactgctagctgatgtttattcatacttggcccatgttaggcactgttcagaagccctttacatgtgttgtaagttatttaattattccttatctctgtttgtttgatatcagcaaaacttcattttacaaatgatgaaaacgagacacagagaagttatcttgttcaaggacataggaattggcaaagccagaacttgaccccaggggtctgacttcagaccatgtatctttttcttttcttgttttctttttcttagagacagggtctcgctgtgttgcccaggctggagtgcagagcaatcttggctcactgtagcctcaaacttctgggctcaagatatcctcttgcctcagcctcccgagtaggtgtgtgccaccacacctagctaattttttttttaaataatttttttgtagacatggggtcttgctatgttgtccaggctggccttgaactcctgacctcgagcagtcctcctgccttggcctcccaaagtgttggaattataggcacgagccactgcacctggcccccatttacctttgactgccatggcatgctgacctgcattttactgttgatcaaacttatgaaaacactctctagaggatgaattctctttctttctttctttctttccttccttccttccttccttccttccttccttccttccttccttccttctttttctttctttctttctttttttttttgagacagagactcactctgtcacccaggctggagagcagtggcatgatcttggcccactgcaaactttgcctcctgggttcaagtgattcttctgcctcagccttctgagtagctgagattacagctgtgtgtcatcacacccggctaattttttatgtattttttgtagagacggggcttcaccattttggccaggctggtctcgaactcctgacctcaaatgatctgcccgcttaggcctcccaaagtgctgggattacaggcgtgagccaccgtgcctggcctctagaggacaaatctttttaaggtaaataacagagcttttaaagtcaggagttctctgtgtctctctaggaacccatgctgtattaaatggccacaaagtagtttggaagtttagcatcaaaggactaaggtttcttctgaacacagtgccctttattccactttttaaggtaaacacacttcaaagaaaaggaaattttaaaaagccatgcttttttaaggaatgtaatatattttttagaacggtattatcactctttatgaattcatatttggcaaagaattttctggaaatattaggaatcagccttactcagaaatttggtgttaaaggtttgtaaagaatatctacttatgcccattcataattaacagggattcttctttttcttttaaggttaaaaaaatttttctttttaattatttcagctttattcaggttgaataagggcattccagccaagcaaagtaaggtgaggggtgagaggggtttcaggcggagaaaaaaaacacgtaaaaggacaccaagttgtagcatggtctggccagcgaactttaaataggagggaagtccattatcatggaaggagcaggggcttcgggaaaggtttaaaaaattaattattcttgagttttggttttaccctctgtgaaaagaggtaattgttgctcttttgaggattagaaataattttatgtttgttttttgcttttgttttttttttttgaggcaaggtctcactcttgtcacccaggctggagtgcagtggtgcgatcacagctcactgcagcctcaaactcccaggctgacacaatcctcctgcctcagcttcccaagtaatgaggactacaggcatatgccaccatgctcagctaatttttaaaatttttttgtagagatggtgtcttggctatgttgcccgggttggtctagaactcctggccttatgcaatcctcccacttcggcctcccatattattgggattatatcagtacaggtttgagccactgtgcctggccagataatgtatttaagttgttcagcaaaggacctgacacgcaggtttccacattgatattatcattatgttgctatcagttttttctttttgacttttgatttgttttcctgaataatattacattacatggttcaaaacccaaaaagtgtaatgttctctctttcgtctttgtgcctcatctgtcaagtcccttcttccctgtccctgcaggtaaccactgtcctgtttctgatgtagcctgcattgtccactgatgctctgtgggaatatgagtatctcttctgtatttcctgcttttacacaaaaggtagcatattgtacgcatgcttcagtgtcttccttttggttttcacttaactatacatcttagaaatcttcccatatcagtttataaggggcttcctcttataagcgccatatatatatacacacatatatatatacacacatatataaatatatatatacatacacatatataatatatatacacatatatatatacacacatatataaatatatatatatacatatatatgtgtgtgtgtgtatatatatatatatatatttttttttttttttttttttttggacagagtctcactctgttgctcaggctggagtgcagtggcgcgatcttggctcactgcaacatccgcctcccaggttcaagcgattctcccgcctcagccttccaagtaactgggattacaggtgtccgccactgtgcccagctaatttatttttatattttaagattcaggtggccaggcacagtggctcatgcctgtaatcccagcactttgggaggccgagatggggagataacctgaggtcaggagttcaagaccatcctggccgaggtggtgaaacctcgtctctaccaaaataaaataaaataattagccaggcatggtggctgacacctgtaatcccagctacttgggaggctgaggcaggagaatttcttgaacctgggaggccgaggttgcagtgaaccaagatcatgccattgcacttcagcctgggagacaagaacaaaactcttgtctcaaaaaaaaaaaaagattcacaggtagttgcagtatagtccagacagttcccatgtgccttcactcagcatccaccaatgtaacaccttacataaccttagtacatagtcaaaactaggaaattggctgggtgtggtggctcacgcctgtaatcctagcactttgggaggccgaggcgggcggattgcctgagttcaggagttcgagaacagcctgggcaacacggtgaaaccccgtctctaataaaatacaaaaaattagctgggcgtggtggcatgtgcctgtagtctcagctactcaggaggctgaggtaggagaattgcttgaacccaggaggcagaggttgcagtgagccgagatcatgccactgcactccaccttgggtgacagagcgagactccatctcaaaacaaaaaaataaacaaaaacaaaacaaaaaaaaaaccactaggaaattgacattggcataatgccattaactcaggtaagagaccttatttagatttaaccgatttttacatgcattctttttttggaagggggtgtagatttttctttttttcttttttttttttccccttttctgtttggcttatgtaatgtagcatgtttttaaggttcatgcaaattacagcatgtttcagagcttcattcctttttatgtctgaattaatattcattatacatatatactatattttgcttatccattcatcagttgatagacacttgggttggttccacctttaactagtgtgaataatgctgctatgaacattggtggacaagtttctgtttgagtctctgttttcaagtattttgagtatataccactgaggagtgaaattgctgggtcatctagtaagtctatatttaagtttttgaggaaccaccaaactattttccacagcagcccaccattttatattcccaccagcaatgcccaagggttccaacttatccacattctaactaacactggttttctttcttttttttttttttttttttacagtttcaactattaattcaacaccttagtgaacacctgctcagtgcgggcattattatgtgttaactagaggttttttttaaattttttttatttttattttttttattgatcattcttgggtgtttttgggggatttggccgggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttaaagcatctgtttaacaaagcacatcttgcaccgcccttaatccattcaaccctgagtggatacagcacatgtttcagagagcacagggttgggggtaaggtcactgatcaacaggatcccaaggcagaagaatttttcttagtacagaacaaaatgaaaagtctcccatgtctacctctttctacacagacacggcaaccatccgatttctcaatcttttccccacctttcccccctttctattccacaaaactgccactgtcatcatggcccgttctcaatgagctgttgggtacacctcccagacagggtggtggctgggcagaggggctcctcacttcccagtaggcgcggccgggcagaggcgcccctcacctcccggacggggcggcaggccggacggggggctgaccccccccacctccctcccggacggggcggctggccgggcagaggggctcctcacttcccagtaggcgcggccgggcagaggcgcccctcacctcccagacggggcggctggccgggtggggggctgacccccccacctccctcccggacgcggcggctggccgggcggggggctgactcccccacctccctcccggacggggcggctggccgggcagagtggctcctcacttcccataggggcggccgggcagaggcgcccctcacctcctggacgggcggctggccgggcggggggctgacccccccatctccctctctccccgacggggcggctagccgggcggggggctgacccccccacctccctcccggacggggtggctggctgggcagagtggctcctcacttcccagtaggggcggccgggcagaggcacccctcacctcctggacggggcggctggccgggcggggggctgacccccccacctccctctctcccggacggggcggctagccgggcggggggctgacccccccacctcccgcccggagggagcggctggccgggcagagaggctcctcacttcccagtaggggcggccgggcagaggcgcccctcacctgccggatggggcggctggccgggcggggggctgacccccccacctccctcctggactgagcggctggccgggcagaggggctcctcacttcccagtaggggcggccgggcagaggcgcccctcacctgccggacggggcggctggccgggcggggggctgacccccccacctccctcccggacgaggtggctgccggtaggagacgctcctcacttcccagacggggtggctgctgggcggaggggctcctcacttctcagacagggcggttgccaggcagagggtctcctcacttctcagacggggcggccggacagagatgctcctcacatcccagacggggcggcagggcagaggtgctccccacatctcagatgatgggcggccgggcagagatgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcctcacttcccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcgggtcactcgcggttaggagctggagaccagcccagccaacacagcgaatccccgtctccaccaaaaaaatacgaaaacccgtcaggcgtggcggtgcgcgcctgcaatcgcaggcactcggcaagctgaggcaggagaatcaggcagggaggttgcagtgagccgagatggcagcagtactgtccagcttcggctcggcatcagagggagaccgtggaaagagagggagagggagaccgtggggagagggagagggagagggaggggggtgtagatttttctacaaaattttgttatccttgtagattcaagtagccatcactgcaattgggatacagaactgttccagcatgaccaagaaattcccttctgctactttttgtttgcatttttgagacaggatcttgctctgtcgcccagcctagagtgcaatggtgcgatcatggctcgctgcagcctgcagcctggaactgctggactcaagcaatcctcccatgtcagcctcccaaatagctagggctactgccaccacattcatctaattttctattttttatagagacagagtcttgctatgttgcccaggctgttcttgaactcctggcctcaagtgatcctcctgtctcagcctcccaatgtgctgagattacaggtgtgagccaccacacctgatcctcttctgctgctggttaatagttacacgcttttcctaatgctaatcactgacaactactgattaatccacacattttatgtgtgcctacttttagaaaacccagccaaacatcataccttcctaggtgcaagaatcctatttccaacttttaaaattccctatgggcctgagtacttaatgggtgcttaataatgactccttgaaacactaagtaaaaaaaaaaaaatagaactcagagctgaaaaacatatgaatcaagataatttacaaaacaataaaaaagttaagactactttcttaaatatgagctcttcaggttgactaagtgacgatttataatttcttttcagggagtcagtacacctaaaagtgctaatgatctgaaataaagcttctctaaaacataactttttttcaaagcaattctactaatatcttttcctttaatgacctctgtgatgttggtatgatgaagtttgttatccctagctgatagagtaggacactgagactaagagaggaaagaaaggccaggcgtggtggctcacacctgtaatcccagtactttgggaagccgaggcgggtggatcacctgaggtcaggagttcgagaccaacctggccaacatggtgaaatccccatctctactaaaaaaaaaaaaaaaaaaaagtacaaaaattaactgggcatggtggcaggtgcctataatcccagctacttgggagggtgacactggagaatcgcttgaacccaggaggtggaggttgcagtgagccgaggtcgcaccactgcgttccagcctgggtgacagagtgagactctgtctaaaaaaaaaaataagaagaaaaaataataaaaaaagagaagaaagaaagctaacagtgagtaccaaagatggctatttcagtaggttcttctaacagccatgtgaggtggacgttgttatttccatttcaaagaagagaatgtggactctctgaggttcaataacttgcctgtggtcagtttatatcagagacaagattccagatcccacattctcaccctcactccacaatgaatgttttcctcaagaataaaagtcaaataattcaggccaggcatagtggcttatgtctgtaatcccagtactttggaaggctgaggcaggattgcttgagcccaggagtttgagaccagcctgagcaatagagtgagatcttgtctccacaaaaaataagacaaattagttgggtgtggtggcacacgcctgtagtcccagctactccggacacaggaggattgattgagcctgggaggtagaggccgcagtgagctgtgatcacacgccactgcacttcagctcaggtaacagagagagaccctgtcttaaaaaataaagacagggtctttaaataagtaagttacgtaagaattcaggttgcttgtctctgccccctgtttttaaaaaagtgtcagtggtagtggtgttttagtacattacctacttataaaggataatatactataatagttcataaaagtggttgagggctttgaagttagccagacttctctccaagtaccagctcggccaccctctagctttgtggactatggatgtgttgttttatttattgaagcctcgtggactcatctataaaatagagaacctggttgttctccatcaggttgagggaattcaatggaatgaaacctggaaagcacttagcagagtgcctggtatgtaccagtcattcaataaacagcagccattagtgtatatgaatctttcattttatggactttccactgctgagatcaaaatacaagcaaataaatacttagattgtgttatgtgcaaagccacatactattgttggaattaatggagggacacagtgattttttttttggacttaaaaatacttgttgaaatttagaatgccatcttgtctataaatttttttaattcatcagttaagttactctattttcaaattgaaaggctgccaattttttttttttttcaaaattcctgattttggttttaaatgagtggattttccaaaaatgaaggatttgaattagatcttactaaggtgctggtgaccccatctctctttcatttacctgacatattcatttcctgagaaatggtcaggtggagaggcagctgatacggatttttgtgtgtgtggtgggagtgggggtgctcgctgcatacagcttttgctaatattaaaagataattgcgtacactcaacaggcattgcaattgcagtcacattctcctgtcgtccagggaatggcactcggctctgcctagcatgatgtttgtttgtttagggcgagactaatggttgaggtatttgtgagaagcatttgtatcatagtgacagactgcagggcgctctttcctgtgttacagattgctaggaaattggataggacctcctgagatattctatcccatgccttccctcaagacaagcctgtgacatacatgagaatagcggtgggggtggggtggagagtcagggaccctgtgggagtgagctgcgtatcccatacggcctggaacgtcctgtattcttaggaacagcctgcacatagcaatatagagcatccttggcactgcatggaaaatggactgatactctcttgagggcctcttggaaatctctaaagtgaagaaagaggaagaaagacagctttgcttgacagttctcatcagaagcctaaatgatacagtgcaatgctgaaagttggaggctggattggtgaggctggagtcagatgggggtaggatagtggttctcaactctagatgcaaattataacctcctggtggcccattgaagggtgttgtctttaacctcccagatgattctcctgtacatctgggattaagagccactgagatccacaccctgatgaaacagcaaagcaaaacaccaacaagggcaaataaaaaactggaaacaacccacaatggttgaataggtcccgtatttcctaatgaggccactggccttcccagttggctgaaatttctcttttcacattctgaaaatgggtccagtgggcaaatatcctgttgatagctgagtccacccaactgcattttgtagcatgtgggatgtggctactctgtttgctccagagtgagaagcaggaagttcactttggaatcattatttaaaggctctctgggacctcaggctttaaacagaaatatatagtgcattctaaggggtattgtgtttaactattaataattgttcctttcatatgagagatattactgtgtagggtggacagaaaccctctgagaacaccatgtgtttcatgtttaccatgaataagtctttccctctcaaaaatcataatttggaaatcattcttttcctgtgaaaaccagaaagttgctttttttttccttctgttctcttaataggaacagtaataaaagttcccattgggaaaagctttcattttgacgtggtgcagtcagtggcggtctctctaggaaagccctggaaaaggcattgctgcatttttctctgttgcatgtgtcttttctccccttagtgtcatgtccaagcatgatgtcactcacatgtcatctgcacatcccaggtccctttgcaaatggaaactacagaagaaacaaaaattgattgagtgcataaaatctatttcaggaacatcctaaagggtctatctcagaagcactgagttccaaaggatttgctgacatttattgttctgcttcagattattaaatgtctttctgatcacatgatgccatgttttgcatagtgtgacatatctgtcctgttttaaattcataggaattggcaacaagctcatttcactggtgggtttgctgaagcattatcacaagacagtcagaatgactgatgagtgctcttcaggtagggaaatgctgccagcctggtttgtattttgtcttaccaagagttttgctccttaattttctatttcagttatgaataatcccttttcatgctagtagccataatcacattataaaggatttaaaatttgtcatttcctggtagtatttcttacagcgtaagcatttttggttcatgtacgattattctccttttattttattttttaacatgaggagatatcataggccaatattaagatttcctaattttaatgttaagagctaagcacatattctggtcaagtagagaagttaaagagtgaccagactttatctgaaatggtaggaataggagacatgctgttccatgatgtaccttgacacggtttttaaaaagcaacatttatgcctgagaatctaatgagtttggttaaaaggagatctagtaagccaatattcattcatttctgcctctccccctagattcctccaatcatgtttgtttctgtgtcttcttttttttttttttttgagatggagtctcgctctgttgtccaggctggagtgcagtggcgcgatctcggctcactgcaagctccacctcctgggttcacgccattctcctgcctcagcctcccgagtagctgggactacaggctcctgccaccatgtgtggctaatttttttttgtattttagtagagacggggtttcaccgtgttagccaggatggtctcgatctcctaaccttgtgatccacccgcctcggcttcccagagtgctgggattacaggtgtgagccactgtgcccagacctgtttctgtgtcttcttaaatttagagaccgttagctttgtgtgtgtgtgtgtgtgtgtgtgtgtgtgtgtgtgagagatggagtctcactaggttgcccaggctggagtgcagtgcctattcacgggtgtgattatggcactctacaaccttgaccttctggcctcaagtgatcttccctcctcagcctcctgagtagctgggattaccagtgtgtgctaccatgctcagcaatctttaaatttttttggtagctatttttttttttttttgagacagagtctcactgtgttgcccaggctggagtgcagtggcgtgatcttggcccactgcaacctcctgggttcaagtgattctcctgcctcagtctcccaagtagctgggactataggtgcctgctaccatgcccagctaattttttttttgtatttttagtagagatgaggtttcactatattggccaggctggtcttgaactcctgacctcaggtgatctgctcacctcggcctcctaaagtgctgggattacaggcgtgagccaccgcgcccggccttggtagccattcttgtagagcactacacatctgtctctgactgaacaggcccagagatgtggacaagttggtctcatagaaacttattttcaagttcgtcatgtgagaagcccaagggagtggaggacagccgtatatctggaaagtgaaaacacgtagctgtactttttgggcaaacataaaactacatttgaatatagtaaattcttagataactgtgagccatggccaaccaaaagcatggcacatacaaggaacatgtgccgggtggaccttgaatgatcacatttaactttgtgtctgtagaacttgtgtttcattttatttttcccttccaaagttgttttttgtttgtttgtttgttttgttttttttgagacagagttttgctcttgtcatccaggctggagtgcagtggtacaacctcagctcactgcagcctccacttgccaggttcaagtgattctcctgcctcagcgtcccaagtagctgggattacagatacgtgccaccacgcctggctaatatgtttgtatttttagtaaagatggagtttcactgtgttggccagcctggtctcgaactcctaacctcagttgatcccccctgcctcagcctcccaaagtgctgggattacaggcgtgagccactgtgcccagcccctctcaaagtattttgagtggaacattgttcatagaagaagttacatcttttctggggttaggatgtacatttcattaggtccttccagatacttaaaaggttctccgcatgctggtagaatatgtggtaattctcagttgatgaattatatgattgtggcagtttgaatacgtagatattatagatgttgtaaatggttttgtcaggcagagtgagctactattttaaactagcaagaatattcactttaacaggcagtttcttattggtggctaaggctgttacagctatgtcagtactttttagaaaagataagctgaaagtattactcatttatatttataaatctaatcctatgcataaccaatgttgagcattccaagcattaatcccgtggtacttggcgtataaaggccatgtggagctagacctggaaacacaccgtatactcatctctttttgaatctatgggtatttttccccctttgggagttcatttttcctggttgttctgggggctcactgagatgtaagagtttcagattctggtttctttgcggaaagacagcagagttcaaattaggctcatagacattcttgcctagttgccaataattccttacacagtgacgatggaggtaaaagaacactgagcaagccaagagcagggaggggaagagaggaatctcaaagaattcagatgggcctacaaggcaattaatgtcaatacatttcctgtttcccacaacttggttagaggtggagcttgcagtgacctgagatcgcgctactgtcctctagcccgggagacagagtgagactctgtcccccaacaaaaaaagtacaatttttggccaggcgcggtggctcacgcctacaatcccagcactttgggaggccgagacgggcagatcacccgaggtcgggagttcgagaccagcctgaccaacatggagaaaccctgtctctactaaaaatacaaaattagcctggcgtagtggcacatacctgtaatcccagctactcgggaggctgaggcaggagaattgctataacccgggaggcggaggttgcagtgagccgagatcgtgccattgcactccagcctgggcaataagagtgaaactcagtctgaaaaaaattaaaataaaaagtacaatttttatactaacgatggctatgttatatatatatatatatatttatataatttttttagacggagtttcgctcttgttgcccaggctggagtgtaatggcacgttctcagctcactgaaacctctgcctcccgggttcaagcgattctcctgcctcagcctcccgagtagctgggattacaggcatacgccaccacgcccggctaattttgtattttttagtagagacggggtttctacatgttggtcaggctggtcgcgaactctcaaccttgggtgatccgcccgccttggcctcccagagtgctgggattacaggcgtgagccactgtgcccggcctttttaaaaaaacttttttttagatggagtttcactcttgttgctcaggagttgcacctggagtgcagtggtgcaatctcggctcactgcaacctctgtctcctgggttcaagtgattctcctgtttcagcctcctgagtagctgggatgataggagcatgccaccacgtccagctaattcttgtatttttagtagagatggggtttcatcatattggacaggctgatcttgaactcctgacctcagatgatccacctgcctcagcctcccaaagtggtgggattacaggcgtgagccaccacgcctggccagttatatctttttacctgacgaaaactgtaaacaacttttggcattctacgcctttcaaaacaattcaacttttttttttttttttaaatttaaatcatggaattcagatgagccttcaaggcaattaatgtgagttaggtcatattgaacctgtgtttagagatacgtaaggactttgattagtgcccatcttgtgccagcttgtatttcccgtttagagttggcaaaggacaacatgttgtagcattggtcttagatgaattattggtcttaggttttattacctaaaacctggatttatttatttttaacaattaaccgaactgtgacatcaatatcagttcccattctttggtcacagtttagtcatttgagaaagggttgagaggctttttaggagaaaaattcatgcacatgcagagtctactctaacacagaaccacctcacattgagttttgaagctaaatgatctttccacggtaattataattaagaccagtatattacaaagaatcagtttaccaaaaagaactttaaaaaccctgaagaactaggccacatgcctagttcacacctgtaatcccagcactttgggaggccaaggcaggcggatcacctgaggtcaggagttcgagaccagactgaccaacatggtgaaaccccatctctactaaaaatacaaaattatctgggcatggtggtgcatgcctgtaatcccagctatttgggaggctgaggctggagaatagcttgaatctgggattctgggaggtggaggttgcaataagccaagatcatgccattgcacaccagcctgggcaacaagagtgaaactgtctaaaaaaaaaaaggccagctggggactgaggagcaatttggggttatgttgatcttcttgggctggcagagtctctgggcaacagagttcatgcagctggattaaggttgcaccctgtagtttctctttccacttggacagaaatggaggtgttgggcctataatctggtccttgcccaaagccaagttagtgttatgcagtatttctgttttgaacacatttgtccttattttcccttttctcttcttgcccactagtagggaaaaaaataatccgagttatttgcttgggtggagccactctttgattgcaatgccccagggttttctaggttaacaaattggagctttccagccggctgagtaggggtgggctacagctcttctaccctgccttctcatattcctttccttccttcccactccagaagagaaagcagaggcctggttgctgagtgtggaggacatgctgttttggggagcctagggactgttgaccacagctgtgtctttttgtggagaggagtttcagcatattcttggaaggtgtgggatgcaaaatatacaccttttagttgagtacttttgtaatgcagccctgtgtgccttagagctcagaaacactggggaaggagggtggggtagttggacgtgagggtgaggatgggtggggaggaggcgtaaatctcctgggctccatcagggcaggaatcaacatcccaggaagcagagacaaaccctttggcttctgtccttgtgctccatgggtgaatcagaaaggaccgtggtcagttatgtgggagtgcagaaagccagccagccagcacgattcgccttggaggaatgacttctcatgctgccacctcctgcttctctgctgggggtgtggaagaaacagtatgggatgtgggcggttttctgctgcagtttattgaacaaacagctgccctcctccatttctctccctcccttacccccatcccgccacatccttcttcctggggcagggtataaccatgctgtaaactttggtagtgggagaatcttgccaatactttctgaaacagcaacttttttttttttttttggcttggaactgttagttcaaagctggaaacagagtaaataaaatttgatctagtcattctagaaatgatttgtatcagtccagaaaatggccagagtccagtagtttgaatctaaaagagctgaactaagataaggtaaggagccagttttttaacctggcaaccacatgccccaacttgaaagcctgtttgctgctcttcttttgttatcataacctcttgaacagaatacgccatttgaaacaacagtaaacgcttctcagtggataagtttatgacctagtttttgaccaagagcacttacgggattgaacggcgcggggaagagcaaaggaccttggacaccattcgccaggaagttctgtgcaaaccgggagctcggggctcattagaagccggagacattaagcagcagctgttttatggtgtgaacttttgcacagaggatttcaagaggctcattctcctcggaagtctgtttgcaaagtggttctttcttggctgttgcttcatccttcttcagaggcctattttcactccgagtgtgagcatttcatgccaaacccagccatgaccttgtggctgctgagctgcccgcatggcctgaccccacaggtcttgggatggtgtgcgcagcagagctaaaccaggaggggtgtctatctcagctctgctggctctggggctggtcgcaccctgcagacttggagttgaggaccagaaacgcagggggatgttacaaaaggagcgtgatcctgcagcccctttcctctctcataaactggatgcttggccctccatcctctctccagcttttttcgtgaactcttgcacccactctcagccttcccctctgcactctattaaatctgaacttgagttcttgttccgcttaacatgggaagatatgcttttcaaggagaagtatgagaaatgaattaaaatatatctacagtttactaatggtggtataggccttagaatatggttaacgaaatttcttcctcctttcttttctcttccttctctccttccttcctttgaaattgtttttctttttatcctcccacttgtatttgcttttacagtgaaactactcaacaaagcatacttagatgtgttttagaaagaaaaatcattctctctaaagagcactattaaaggcatgatgcagtctgggatccatgagaatataaaacacagaatttaaagggtcaaagttaacgttaattatctattaacatgattaatattagtaataaaacttactgaaatgattgggtcccatttttatatttcacatttcttttttagtaatgtacatcttgtatatcacaaaagatttacctatttctgttcttttatcattgacacatgaaatctatatacaaaaagatttttaaatggggggaggcaacattcctatcatctaatggagaaataattatatacatgaaagtgcatgagaaaataatattcaacattacaactgtttaggcagtgttttacatttaaatttaaatttaatttacatttgaaaatgtaaaaggaaaatacaagactgcatgtgcaatattatctatgcaaaagtacactgtcgagtgtttagaaggaaccatgccagagagtttatagtagttgaatatggattatgaacagttacttttatttttaattttttgggggacagaatcttgctctgtcacccaggctggagtgcagtggtgcgatctcagctcactgcagcctctgcctcctgggttcaagtgattctcctgcctcagcctcctgagtagctgggattacaggtgcccaccaccacacccggctaatttttgtatttttagtacagacaggatttcaccatattggccaggctggtctcaaactcctgacctcaagtgatccacccgccttggcctcccgaagtgctgggactacaggcgtgagctgccacgccagattatgagcatttaaaattgttttctttttacattctctttcctcagttttccacaatgagcaagcaaatcttttataattagaacatctaacctttattaaaatactttaataaggatatcttcctctctgttctacctatttttgtgacgtggttcatattaatataggaattacaaaacttcaaaaagttattcttgttttaggtctgttcatatttggaaggctttcaattttatgtatacctcaccccacttggggccagcctgggagctgtgggtttcctcccagagagctctacttagagaacagggcatttcttgcctactgtggtagtctccttcatcttctcctttttaaataattattttgctgggtgcaggggctcacacctgtagtttcagcactttagaggctgaggtaggaggatggcttgagcccaggagttctggaccagcctgggcaacatagtgagaccttgtctctattaaaacttttaaaatggccaggcacagtggctcacgcctgtaatcccagccagcattttgggaggccaaggcgggaagatgacctgaggtcaggagttcaagaccagcctgaccaacatggagaaaccccgtctctactaaaaatacaaaattctcatggcatggtggtatatgcctgtcatcccagctactcgggaggctgaggcaggagaattgcttgaacccaggaggcagaggttgcagtgagctgagatcatgccattgcactctagcctgggcaacaagagtgaaactccatctcaaaaaagaaaataaaagaaaaaaacattaaaattagttgagcctggtggcacgtgcctctagttccacctactcaggaggctgaggtgggaacattgcttgagtccaggaggttgaggctgcagcgagccgtgctcacactattgcactccagcctgggcgccagagagaccctgtcttaaaaaataaataagtaaatacataaataaaaattaataaataaataagtaaatctctcactgcattgctcagtgattctttttctttgacttaaaggacatactcttttaccctgctcatattatgtttctggtttttttccttctgggattttcctctcaccccattgtgttgtttctgcccgtgttcctttttcctccactgaggagatgatccctgaattactttattgaggatgactcacaatcagggagcaacaagtcgccaataaagttgacagtgcttcttagggaccccatttgtggcaataaaatttgcaactaggcaagagaaatttcaatttgcaatacagtgtttttaattgttcagatacgtctttaaaatacagtatggcaagttaaagtcacttacgaactgctgagatttttcttaccaaaaaaggtgctgcctagaaagaacttttcagcagtgatgctcagttgttggctcaaacatttgcagtctgaaatgatgaaactgtgcttgacacatagtacagagggacatgtttcttccatatcttgattgggagaacctttgaactagaagtggcactacccaggttggtgaattgagtagatcctttaggtactggtgcattttagccctggatccaccttttatgtgctacataatagaaatgaaatgaaaactatttaactttcccttgctgcctccacttttttttgtttgtttgtttctgagacagagtctcactctgtcacccaggctggagtgcggtggcacaatcacagctcattgcagcctcaactgcctggctcagacaatcctcctccccggcttttttttttttttttttgatggaatctcactctgtaacccaggctggagtgcagtggcacgatatcagctcaccgtaacctccacctcccaggttcaagcgattctcctgcctcagcctcccgagtagctgggattacaggtgcccgccaccacgcccggctaatttttgtatatttagtagaggcgaggtttcaccattttggccaggctggtcttgaactcctgaccttgtgatccacctgccttggcctcccacagtgctgagattacaggtgtgagccaccgcgcctggccttttttttttttttttttttttttgattctaaaggcacacatattagaaattagaatcttatgctggatagacatctctcccctttttcctgtttgcccagttttcaaaggttagggggaaaacagtctccagagtttttatgctttctcaatttgtaacatgtggtgggatagcatataatatgtcatttatatatttctgtttcttgcctatatttgcatttcttattttcttcctgttctgtcttggtatttccctccatctcctactctatccctaaatcctttccagggtgcaagtcaataaatatctgaaattattgcctatttctgatgtctttcattttgtgtcatgctttataagttcaaaattctgtaacagtgaccatcacttgttactcttgaacatatcagttatttccaaagtattctttgttattggatagtcagtgaatgtctggggctgaatgaagatattctgggtagaatatgcagtactttatacctaaaagtgaattgtaggaacactgaattactaactagatgaatagcatagcaaaccatccgctgaaacctaacaaaagtagctcatttggggagtgagttttggagagtcactctgcctctgttctgtagattgtggcaaataaacatgatatagtatacattgtgtgtgtgtgtgtgtgtgtgtgtgtgtgtaggtgtaatactatctatttgaaatgacaatgtaaaatgagcaggagaccttttaagaccaacaaggagcttcctttatcactactgattctcgtgtcgaaatagagcttagagaatctatgatgaaaacactgtgacccaagttcacactctaaggtcaaacttccaaagttcagcccttgtccttgtgaatcacttaacctttctgtaccttcgttgcctcgtctgtacaatgggaatgctgcatagggcaattgtaaattctccactctgaatgccatccgggtaagtcccacctgactgaacttgtcgatcttagagctgacctgtcccactggaggaagacctcagagaccattccccatacaaaatttggccttgccatcgtctgtcttgggcaagtcgttttaacctctctgacttcagtgacttcttgtgaaatgagatgatggtgctatgtgatcttttcccttaaacctcaagccaaacaataggtccaggcataagtcctgctttttttttttttttttgagacggagtcttgtcctgttgcccaggctggagtgcagtggcctgatctcggctcactgcaacctcctaagtagctgggattacaggcgcccgccaccacgcctggctaattttttttgtatctttagtagagacaagtttcaccatgttggccaggctggtctcgaactcctgacctcgtgatccatcgccttggcctcccaaagtgctgggattacaggtgtgagacactgtgcctggccgtaagtcctgctttctacatgaatagccctgttgaacgagtgagagcgagggacagggacacattgggcatctgcactgtgtggggtgttacctcattggctttcgcactgctaccaactagacagggatgggcaatacactgacttctttgattccagtcaccttcatccttcttatatcctatctaagtgatttacttgccaaaagcagaggacatttctggaagaaaaataatccattgtggctgggcgcgagccgagatcgcgccactgcactccagcccgggcaacagagcgagactccgtctcaaaaaaaaaaaaaaatccattgtaacataaaaataaaaacaacacccaagagggctatatgtgcttgttttccagcaggaaaacctcgctgccttccctgctcattctctctccagtccttgaaccttttctttccttaagacttttccccaggtcggacttaatgatggactccagcgttggcatggttttggttgggtctgcatactccggtaaggcagagaacaatgctcaatctgtcctggcttcctgaggctgaagggcaaccctctagtagtgcaccttgtgtctgagctgtttgttgagctatacttaatttgtgtgtgtgtgtgtgtgtgtgtgtgtgtgtgtgtgtgtgacagagtttagctcttgtcacccaggctggagtgcaatggtgcgttctcggctcactgcaaccttggcctgcctggttcaagtgattctcctgcctcagcctcctgagtagctgggattacaggcgcccggctaatttttgtatttttcgtagagacggggtttcaccatgttgggcaggctggtctccaattcctgacttcaggtggttcacctgtcttggcctccccaaatcctgggattacaggcatgagccaccatgcctggctgctatacttaatttttaaggaaagtaattgttcataaacacacagaaaagagcaaaaaaatctatttcttttctaccaagtgggtcttgatgtttccattcacatctttctcatgcaatacctaacttgccagtaacgagataaagagcttcagtggggagggaggagatttcctcaatccacctacatttgatcagattttctaacttaaagaattgaaaaactctattgtggtttttcagaagaaattacgatgatataatttatgttcagaatattttttgaatcaattcttttttttttttttgagacagagtcttgctctgtcacccaggctggagtacaacagcgctatctcggctcactgcagcctccacctcctgggttcaagtgagtctcccgcctaagccttctgagtaactgggattacaagcacccgccatcatgcctggccaatttttgtatttttagtagagacaaggtttctccatgttggccaggcaggtctggaactcctgacctcaagtgacccacccgcctcaacctcccaaagtgctgggattacaggcgtgagccaccacacccggccttgaatcagttctttatctgagtgctagattccctttgaaaaagaagattctgtttttttctcattttttttctgtagcatcttagaactgcagcatgtgcagagttgatgctcaagacataattaatgggttaatggataaatgaacatctccctaaaccttgtcctcccctctattttattatactcttggccagtgccattgttcttgagaatctctgctaaagccaagtgacttggtttgcgatctcttgcacacaatgtattagttttcagtttttactttgcacaaagtattctctctctccaggttgccctccttcccccatttagtgtttcacatttgtaatcattgacaaaatctaaccccatactcaaaccttcttgtagtcctcagcttgtggccctgtccacctcgagctcctcctcactcggcagctctccattttcaccttagtcatcagcagacactagactgacttgctgtgtttggagcacccagaagctgaggttttatccttggaaacggaggatctttactgtgatggaggatttgggagtgtaaaatttgagtgtgtggtggaagggacagttcatcttctgggacagaacacccggggcagacagatcccggaaagctggggcggtgctggtggcagtcccgacactgtgcctgcattgatgggttcacatgtacctgagatgaagcgtctttcaaggatgactctttcacaggccttctcctttctctgacactagtcattaagagattagatttcttgaaatatcagcagttgttggcccccttgctgaataaagcttggtagcctaaggaggaagggatttctgaatagattttcagccctgaaaaaatgctgagttttaaaaataaacattcatggtgtaatgtactcttttacctcctgcgaacgggcatatgcttttcaaaaatgtagttacagtcaagggcatttagaggtgtttgtaaagaggagggggagagagagaaagaaagagggaaaaaaagattcttttgtttctcctcctagtttgtggccatggcacagtgtgatttgaatactccaattcttatcatatataaactttgtgttgggaaggaatggctcaaattgcttcaagatttacacagggttttttgtttttgttttttttttgagatggcgtttcactctcgtcgcccaggctggagtgcaatggcgcgatctcggctcactgcaacctctgcctcccgggttcaagcgattctcctgccccagcctccgagtagctgggattacaggcgaccgccaccatgcctggctaattttttgtatttttagtagagatgtggttttaccatgttgggcaggctggtttcgaactcctgacctcaggtgatccccctgcctcagcctctcaaaatgctaggattacaggtgtgaaccactgcacccggccagttttttgttgttgttgttttgagacagagtcttgccctgttgcccaggctggagtgcagtggtgcaatctcagctcactgcaacctcatctcctgggttcaagcgattctcctgcctcagcctcccgagtggctgggattatacgcacgtgccaccatgcctggctgatttttgtgtttttagcagagacggggtttcaccatattggccaggctggtctcaaactcctaacttcgtggtctgcctgcctcggcctcccaaagtgctgagattacaggtgtgagccactgtgcccggccagtttttgttttttaaaccaatgtttatacaagaagagtttggaacttattcatgaataaagtcattctttggcctgttgtgtagcaacaaggagtgctggattttatggaagatggcttgtggtactgaagtatcaggagaaggaatgaataagggtgaagattcaaactggtagtaacatctagaagcaaactaggagaaaattatttcacgaagggaaggatgtgactattgatgggaaggctgtagccaccaatctgagaatactttaaaacaaaaacagagatagagcctggcatgagcagtttaggatcaaaatgaacagtaggccctagaaatttgtaacattgatgttatcttctctatgaatcgttggtggggtcaagaaataattttcatcagcgtcttgacttgtgtggccaattaagcaaacgtgtgtctgcagtgtaagcctgttaagtggaaaaggttgggcctactgggtataattgtaattgagaacagcccatcatctctcttttaattttacgaaaataaatgcatattctaagtagaataaaatcatggttaagaaaagaaaaatgttacatctgtatcagtatgtggatttcataggatttttttccttcttctgtgggacctgagattcatttgaagtaaccttggcagaaagaccttagttagtcagactctaaaggatattttgagctggaatataaaaagcacatgtaataattaatgtaacagcagctaaaagtgcctgaggtcagtagttgctacatctatattgcatgtaaacaaagtgttagccaaaactactttcagagagccctaattacgtctgttttaatttaatttagtttgatttaatgatactttttatatgaatttgcttcatggttactctgttgaatttcctttccctgagaagaacccataagagatttttttcccccaaatgatttagtttggtgactttggatacagccaaagcattgtatcttacggcatagcatcttcaagtggaagaatgtaccagatataaagtcagtaatttaagatgaattaaaattttgtttagtttttaaaatatgagatttacatacaatgaagtacaaatatcttattggtgtatttgtgtgtgtatgtgtgttttgtttttgtttgtttgttttttgagatggagttttgctcttgttgcccaggctggagtacaatggcgcgatcttggctcactgcaacttctgcctcccgggctcaagcgattctcctgcctcagtctcctgagtagctgggattacaggcacccatcactacacctggctaattttttgtatttttagtacagtggggtttcacgatgttggccaggctggtctcgaacccctgacctcaggtgatccacctgccttggcctcccaaagtgctgggattacgggcgtgagccaccgccccagccagtgcattccttgagttttgacacatgcatatccttgtgtccctgggactcctatcataatatggaacattgccatcacctagctagttttttcttgctccatcccgtcaaccactgccttaccacctccaagggcaacctgttttgtgttgttttgttttgtttttcttccccattgtccattcgatttgcctgttctagggcttcgtgtaaatgaagtctcataatctctgctcttttgtaaggcttctttcatgcgtaagcttaaatttaatagtttttcacaatgtatttaatggaagctatatcataagaagtggtgtagaaaaaagagtggtcctgtttcaaagaagaaagaaggtaacattcattgttattttgaaatggctaaagttgaaaatgttttttattgatctatttgctagttagaattttaattgtgataattgtagatttacatcagctgaagaaacaatgtagctttacctggtctcccctagtgataacatttagcaaaactgtagtacaatatcataactaggattgatattgatgtaatctaccaatcttactcagatttccatagttttacctgtactcatttgcgtgtgtgtgtgtgtgtgtgtgtatactcagttgtgtgcagttttatcacatatataggtttgtatatctaccactacagtaaagatgctgaactgttacagcatggatccctcctattgtttttttgtagctgtacccagtttcttctcaccagtctcctatccttatcccttggaaactacttattgggtctccatttctaataaacttcatatatgtaaatagaatcatatagttcataatcttttggaattggcttttttctttctttttttttttttcgatggggtctcgctctatcacccaggctggtgttcagtggcgctttctcagctcactgcaacttcggccctgccccaggctcaagccattctcctgcctcagcttcctgagtagctgggactatgggcacccatcaccacacctggctaatttttttttgtatttctagtaaagatggggttttgccatgatggccaggctggtctcaaactcctgacctcagatgatccacccacctcggccttccaaaatgttaggattacaggcgtgagccaccccacccagcctattttttattttaaccattctgatagatgtgaaggagtatcttattgtagctttaatttgtgtttccctgagagctaatgatgtcgaacatcttttcttggccatccatatatcatctttggtgaagtggctgttcatgtcttttccccattttctaattgaagttttaaaaatctatgtttaaagccgggcgcggtggctcacgcctgtaatcccagcactttgggaggctgaggtgggtggatcacctgaggttgggagtttgagaccagcctgaccaacatggagaaaccctgtctctactaaaaatacaaaaaaaatttagccgggtatggtggcacatgtctgtaatcccagctacttgggaggctgaggtaggagaattgcttgaacctgggaggcggaggttgcggtgagccgagatcgtgccattgcactccagcctgggtgacaagagcaaaactccatctcaaaaaaaaaaaaaaaaaaaaaaaaaaaatctatgtttaaaagaaagattatgcaaagcacaaccccagtaggtatcaataacatttgagaagagtacctcaaaaaagatctcactagacttgagagatactattagataaataaattgagccaattgatgggtgtaggtagatgctctgcaacaaatgggtaaaaagaggaactgtcaactttttgtcgatcccacagttgtcttgtcaatagcttgggcttccagttgttcccgcttacccaggttctgtgctcttcctctcttctgccctagaccttcgattctttccattccttttctttttctttttttattttccaagacggagtttcacttttgttgcccggcatgaagtacagtggtgcgatcttggctcactgcaacctccgcctcctgggttcaggtgattctccttcttcagcctcacgagtagctgggattacaggcgtgcaccgccatacccagctaatttttacatctttaatagagacgggttttcaccatgttggtcaggctggtcttgaactcctgatctcaggtgatccacctgccccagcctcccaaagtgctgggattacaggcatgagccgctgcacccggctccattccttttctctgcgacaaacctgcgtggtgataggtccactcccttgactagtttaattctgaagcttattgatggattcctcaaacagatcttgtggaccaaattattctatttttctgtagagcctggcgatttgagataatctatctgcacagttttgtagtgtttgcttccatcactcaagagtaagacaatatgtcagagttatcttgatggagggataagagagagatagtttggagacagagcagaaaacctttctagtgtacttggtaatgagtttactgcagactgacatataggggacatcagggcatttgcttagatgatgcatttctgtccaagtaatagggtgcacaggagcccaaggcttaaagacaaaataacctgtatttgtgtccttgttctgcccttacttagtgacactgggcagattacctaacctctctgagcctccacttaattaaaatgtagtgatacttcccatactacccaccacagtgggttactgcaaagatcaaatgggataatgtaatgcacttgtcagtgataaagctctatacaaatgtagagagtatgtttgtaataattatattcctcctctccacaaaagcaaacacaacctggaagagaaacaggcattttcatagaatgaggtcaaatgatcactataagtttcttgaaggagaggaaaaccctgaagcattattgttttctttttttcttttcttttcttttcttttttttttttttgaggtagagtctcactctgtcacccaagctggagtgcaatggcatggtctcacctcactgcaacctctgcctcctgggttcaagtggttctcccacctcagcctccctagtagctgggactacaggcgtctgccaccacacttggctaatttttgtattttttttttttttttagtagagatggggtttcactatgttggccgcgctggtctcgaactcctgacctcgtgatccacctgccttggcctcccgaagtgctgggattacaagcctgagccaccgcgcccggcacattattgttttcttagatgtgattttaattttgtttgctaggcaataaactgctgaaataattaaccagcaataattgctcttcagttaggctctaatatgaccactgagcagagcatctaagagacttaaaattgagttactttaggtgtataccattcttacccatttaaattgtagttttaaaggtgggttatgagttggcttgccagtcaaagccttgcttggggtcgtatttctctgtactttcatctttaatcatcagctagattagtcttctggttgagtatagaagccagagagacctaggtttatacaaggagtgctattaactgtgtgtgaccttggaccaaagattagatccctctctttatcagtaatatgaattcaagtgaaattgttaatttaccacctacactgtcaaattatttggatatctgcctttaagtagtaatgttacaatatatagtacacacaagagaattggtatccttgtctgtaaattgagaagttcacagaaaaggttgatgaaggtctgatcaggggcgaaattgttttgttctaaaatatatcattggtagcaagcagtttaggtttggatgaaaccaaaagccagttcgcatgtgtgtagttctataccccaggtcttagtttgggcaatgtacttttgtgacttaggataattataaggtctcaaggctactgtgaggatcagatgatactaactgtatgagaaaacgctttggaaattgtaatgttctgtgcaaactttgttgtcagttgtatagaccacagtggaggaggtggtggtagtagaaaggaaaggatgtgtttgtcaagcttgaaaacttgtgtttaggaatattttcagctagttactgggcagtgcttgtaaaaaaaattcttaaaaatttccttctagcggggtgcagtggctcacacctataatcccagcactttgggaggctgaggtgggcggatcaccaggttaggagatcgagaccatcctggctaacaccatgaaatcccgtctctccaaaaaaatataaaaaattagccaggcgtgatagtgcatgcctgtaatcccagctattcgggaggctgaggcaggagaatctcttgaacgcaggaggcagaggttgcggtgggccgagatcactccatcgcactccagcctgggtgacagagcgagactccttctcaaaaaaaattaaaaaaaaaaaaaattccttctagactgcatggatctcacactactccactcttggaacacacagccatgaattgaatcactgtctactttacattttagcaattcagttttatatggtgacatttacaaaattgtcccttaaatctgggagagccaatgcaatgacttcagatagcacaatggggagaatcttaatggaaacccagccaatgattagattaggtgacaggaagggggtcaaatggattaggggaaaatgaggaaggaagtgagttgagtcattatgcttttacttacagtatatttttacaattgattctgtgggtagtatgttgtttaattcattacagctttcaaggaccaattttagattaaaagcatgaatgattgaagctctaaccaaactctaatcctagatactagaaaccgatgactttttaatgtcttttaatctgaaatagattatggcttttctgtagctttggactgttcaaatgtttatttcctttaaaataccaacagcttacttcaccctctttgcaaacttctaaaggggttgcttcctgccgtttaatataggatattgactttctaaagagtgtgcatgttttaaagagacttacattagaaatttgatgtctgaagcttgtcactcttttattaagaatttaaacattgtatctgattacaattacaacgcataacctttgtaaaaccttattacttatgtttatcttacttgcatccaatgatatgtcaattactatattcagtcattgccctgaaaaataactccaaggaatttattaaatggtgctttttccttgatttccacattgcgccctttgtggctgatttcatgtagccctttacctggaagtcaggcttgggagtgatcttggccagctcttgtgagtggggccaggtgaaaggtacattcttctttctttccctctgcgtgcttggcggcttctggagcaggttagcctcacaagtttcttttgttcttgctctaaaatttgtggatgttcattaattcccatgtgtttaagcagcctgcagctttttctactgacccatgcgtggtggccactttgagagggaagttaatattattctcattttttgatttagtctataatttgactaagtcttcggagtagatttctctgtccaccctatttaaaatagcaatattgtccctccaatactttgtcattctctgtcccttttaccctgccttatttttcttcggagcgcttaaacgtatctgatgttatactaaatatttgtttgctgactggtttactgttggccggtctcctagaatgtaaacattgtaggcaacaactttgactctgttcattcagaagagcgctcggcctggcaaatacacaagtatttgttggattaattaattaattaaatttaatgccatgaaacacaccaatcaaggagatagatccccctaaggttaagcttattccaaattctaagtttggtatctttgaaaccttgctcctttctctccggcctcagtaacactatcttttgttgcatgagaaaaaaaaaactcccaaagaacattattttgggaggaagagaggcaaatgaatatgggtgtcaggttatcaagtaaatattggaacaatttatagcctatgattgggaatgtttattttgcttaaatgtgtatttggtctgaccttgcagttagagttactcaggaagttgcctaaatgttaatgaatgtttatgatgtggactataagctgaaagcacttaaaatataaatatttaagccatatgttaaaaaataaccagagcatttgcagctattttggattgtggagggaaattgcctgatttattgatagagctgggaatttggagtcctgggttctagttccattcctgcttttggcagcacttcacaaaatgtctatgtttaataaatgtttaataggacaatattaatccttttaaaaataatatctttgtatcgcttagactttttttgtgctccaatttctccagcttttttttttttttttgagatggagtctcactctgtcacccaggctggagtgcagtggcaggatcttggcttactgcaagctctacctcccgggttcaagcaattctcttgcctcagcttcctgagtagctgggattgcaggtgcatgtcaccacgcccggctaacttttgtatttttagtagagacgggatttcaccatgttggccaggctggtctcaaacccctgacctcaaatgatccacccgccttggcctcccaaagtgctgggattacaggcatgagccacctcacccggccccagtttctccaactttattgatattttgttagcttgctcctcagggttttctttaaacaaaaaaaaaagccagaagtttcccacgtgtgtgtgtgtgtgtgtgtgtgtgtgtgtgtgtgtgtgtgtgtgtgtatttgcagggagtttgattccgtcttctcattagtgccgcattaatacatttttctgcctcacatttgtttaagcttcacctgaaaaaacaaagtaatgtcgtacttaaaatagagtataactgtacctcatgtagtaaacgtaatttataaagaaccgaactagatgaattttgatggggaaaagggaatgttgtttccaatgaaggtaaccaaagatgagagctttgttatcccaagcacagaggctggacctggataaatcttgaaagcaagcaactaggcacaaaccaggtgcctatcgaaagaggtccctttaccaccattagtgttatcagggcttttatgtcaaacttctgtctgtactgtgctgggtgaatttttaactgaacaggctttacaattggagcaatggggctaaaaccacttcagaattccagaggccttactcagccccacctctcagttggctctttccatgcactcatctctctgcggggctttctcgaggtgtggtcctgggaccaccggcatccgatcacttgtggcacttgttaaagctgctaattcctggtttcgacggtagacctgctgaatcagaaactgttggggaagagtcttgaaatcttcatttttaacaagcacctatcaggtgattcttaggcacattaaaatttgagagcctgtgatatattcccagattagtactgtcacatctcttaaggtggcactttattttacttttattttttaacttttatttttatttatttatttatttttttgagaccgatcatactctgtctccaaggctggagtgcagtggcgcgatcttggctcactgtatcctgaggcgattctcctgcctcagctccttgagtagctcgaactacaggcaggcgccaccatgcctggctaatttttgtatatttagagagacagggtttcgccatattggccaagcttgtctcaaactactgacctcaggtgatctgcctgccttggcctcccaaaatgctgggattacaggtgtgagccgctgcacccagctggcacttgattttatatctttttctggactgtgctatgctatgagtggaggggagaaaactgaaatatggagaaagatctttgttctcctccagctccagttccttaataaagttcataggaggaacagagagcctatacactcatttcttcaatgtgcctgctctttagcgggatatcctatatctactagattttaacatactgatttacataagcaaggaacacttcgacagaccattgagaaaatctgtgagcttagcaagagcacgccactgatgcgcgtcaccgttgggtgaggatgttatctggctgaccaagccagatgcgtttaatatgcagggtgggttggggctaacatttcagtactgagtgacattgaggactggttaatgtgattgactgatgtggaatcttctcccacacggtatatggtgggtcttacgagagagttgggtaaaaatagtgtgctaaaggttcaaaaatggaacatatgtggtcaaacctctgtgatacttgtttatgaagactgtaagggttggagtttcctgatgtgtgaaatgcagccctactaatgtaagggtatagtctgcctgagtttttcaggagtgggctcagggaggatgctttcaaaccctttcgaacagttaggaattctggagctttcaactagtcatggaaaaattgagttttgttgtacattgagcacctgtgatgagaggggaaaaggcagtttcattggtttacttaagtcagcagagaaggctgctgtgcacagcttccattgcatcattcaaaaagagagtttgtgtgggaactttgcaagtcagtttccctgtatgaagtgatggagagagtgattaagatactgagctttctctgtgttcttgccgttaaccattgccggtttgtgggagattaagaagtcgatgcgttttatggagaattaatttattttgatatagacagatggacgggtcatgaaaatttgttgacatactttactaaactgctacattagatcaaatattccaaaaaaaaaaaaaaaggggtttgaagagacccagtgacttacagggtatgcttttatcactgatgtgagaagacatatgaacacattgaacttaaaacagtagcaaacccagagcatggctcagctgtttgcagaccagcagggcagacacagctgtgcttatacattatgcttgtaggagctgggggctgtgctcagtcctcatctcagaacccacccacgacatgtggatgcagggacgtctcacaattttagaagagattcacagtttttcttgggcccaatcctgacttaaattcctatagctgcttttggaatatacacctcttctcattcctgttcaaaatttggattctctacctattttgtaggcttgtgggaaggattaaaccagacaatatttataaagttcccatccacttaccgatgcacaataaattcttggcaaaatgagtcccctcccctccgtgaaaaaataaaacgtattgatagagggaaaggaatttgtccagagatgcaaagcactggtgctgtcagcggctttctcaggctttttccttccagcagttttcacccgagacaaccccaaagtgtccttttaccttttagtaggacatgcagttgtgagggagagtcaggttttccttgtttatgcttccatagtttttaccctgcagaccctgaatatttttgcccttagaacataaaaaggagagataatgaagcagcctgttgtcactaaggaatagaacctttacctgttgttcccatgacagtgtaacaatacacaggatcaacatgtgacaagaatctttttattccttgtaaaccaagaaacgaaaagtcatcttataagctgagacattttaagagaacaggcccatggtgttttcacccctttgctctgttgttttttggtttttgtttccaggatgggtaaagaaacaggttatagaggtttcctggaacacctgtgtgaggatctccctggatgctgggtgttggagagctaacgctgcacagcctgttggtgggaagagtgaacagacggttggttgcatgttgataggagctgtggacactctagtaaatacagagctctccttagggggaaaatgctttagctttagatgttttgactttagatcttattgctggggtttcagacttttagagaggcacagcttgactaagattagccaaagcagcatcttaattgaacgagtgacagctattgggacaaccagatataattaactctgatgttttagaattccttttccattctttgattggttcgcttgcgttttgatccttaatgatgtgtgctcagtgaattacactagaagagaaatgtctgtgtttatattcaatgttaccagattattctttttgtcgagggccagggcattttcacctcatggaaagatggattggtaaggaacaggctgtactctgctaagtatgttttcagtaacagctagtaacatcacaaattcagggtcagaataaactatcacagactagacaagtatttgtgatgttaggaaatggagtagagtatgcagatggactcataagataattagtaagtgaaaatgaacttatatcagtcttgaagcaaactcactacctccttatctgtgtgtagttttttgcatgtgatattcctgacttggggaatagttggaaatttaccagattttcatattgttacttccttctaatctctttatttctataaatttggagatgatataaaaatatggcctattactaagaaatcaaaagttatgtattgtgcctttctagtcacttgctctttgtgtcttctgggtaagtcatttaaatttcctgaacctcagtttttctcatctgtaaaggggatatgcctacttagtaaattgctatgggatcaaatgagataaatgtatgtggaaatgcctttgacactcggaagttctttataaatagaattctgttatgcacagagaatgaaagggcagtctagagtaagtgaagaacatacctgctgccttttcaaagtctaaccacttaccccccaaataggtacttgcaaaggaatgtttcctcttccaggcatgcacgcctcatatcagtcttcctttactcatcttatcactgcttctattattttggaaccttaggacattaggtgacagacactgttttatggagcatactgaagaactgtttgaaaagtatcggctaggcatggtggctcacgcctgtcatcccagcactttgggaggctgaggcgggtggatcacttgaggtcaggagtttgagaccagcctggacaatgtggtgaaaccccatctctactaaaaatacaaaaattagctgggtgtggtggcgggcgcctgtaatcccagctacttgtggggctgagccaggagaattgcttgagcccaggaagtggaggttgtggtgatccaagatcgtgccactgcactccaacctgggcaaaagagcaagactctgtctcaaaaagaaaaagaaaagaaaaggaaaattattgtgggctcaaataagactgggtcagttagtagaagcaaatagaactcccctctcctcccttcccctcccctctcctttctctttccttccctctccttcccctgtcctttctctctcctttccctctcctcttccttcttttttattgagacagggtcttgctctgttacccaggctgtagtgcagggatgtgatctctgctcactgcagccttgacctcccaggctcaagtgatcatcccacctcagcctcctgagtagctgggcccacaggtgcataccaccatgcccaactaattttttaaaattatttgtagagacaggatcttgccgtgttgctcagactggtctcaaactcctgggcttaagcagtcctcctgccttggcctctcaaagtggtgggattataggtgtgagccacggtgcccactcccttttttcttttatgttttttctgttttcctcttcccccacttttttgagcatatatactaaaattttgcatatcagcccagattttgagatcaaattgtgggtacaagaatttggatccattttatccaaaaaatgatattttacattttattttcaagatagatgagctggtttataaacatgtatctaatctattttttttttttggcctttgaagcttaagaagttgaataaatatcactatgcttattctgaccttgcacccattatgtttgttggaatcaggtcctcctgcagttttattttcatttttacacctttttgatcatcaccacactgcgagttagtttaggacggtgatttgaagcaattgcttctgttgagtttacttgatgatcttccttgcagacacgtccacttacttatcatgtaaaaattatttacctatcatacataacgacacaatccttgccataagtgcatgctaagtaagagattagcatgctggcatttagaaaggttcctcccccttgttcctttaaatgtattttgttgttctgtgtggcatcaaatttatacttgtccttttcttttaaagacaagttgtgggaaggaaaagacaagatcataacattaagattgaatgtgtttctcaatcttcgcatccttaactagtttctttgatgtattcgagtttgctataaaatgtgaggggaggaagaaaggcaaccagtgataatcaaaggggaagaaagatcagggtaggactcggtgacatttgagggtaagtttgggagctgttgcaagagttattgctgcctgtgactatttggcctggctacatgtcagagccattaacttcagaataacagaggctttaagagaatgtactcttttagaaaactcctcattaatttaatttatggaaggggaggggagttgaggagcagggagcgggaagcatgcggtttcaccggtgcctagagtttaagttaaaaaagaaacaaaaaaagtacaaaagctgagaatgctggattatatgaaagatttaaaaaaatcccctgctctgtctctggtggcctcagagcctgtcctgcttgagaaggaattgcctcctcagtgatggcttttggagctcaacccctaacatggatcccagctgggaaatcttcagctctaattaagcttggcttgttttgattctcttccagccttgtggttgaatagctttgtgtatgcagccttttgctaacaagttttcccacagtcaggaaaaccttcgtcttcagtgtcaatcattacctggaagtctttggctgccatctcacaggaagtggctaacttgtctacatgactctccctcttgccccctggcctcccccaacagatttcaccatattttgggagtggaaggaatacagctatcgttactcatagaagaacgggaaaagacagtgttgtctgggtccatggagccacaagaacacaccaggattgatcattcctctttctcttaattgtcttttgccttgccctcccctgctaggatagaagaggtaggataagatggatggggatggaatttattaaataaattattcaaaaatacttgttaaacctatctactgtttgccatatgctaagacccaaaggagggaagagtgtcatcatgccaagtcatgggatggcagtgatggtattgctatggtgctgtgtatacaagaccatgagagcaagaggaaggagcccagtgtgtggcctgggagggtcaagggaaactggattcaggaaatgccattttggctaagaactatagagtcaatacacatttgcaaggttttaaagtgaaaatggaggccaggcatggtggctcacgcttgtagtcccagcaatttttgaggccgaggcgggcggatcacctgaggtcaggagttcgagaccagcctggccaacatagtgaaaccctgtctctactaaaaatacaaaaattagccggacgtggtggcacgcatctgtaatcccagctactcagtaggctgaggcaggagaatcacttggacccaggaggtggaggttgcagtgagccgagattgcaccactgcctgggcgacagagcgagactctgtcttaaaaaaacacacacacacaaaaaactaaaattgttcatatgattgggctggatgctagattgtttgggagatgaagttgtacgctctgggggtgttttggaaactcatgcaatactttctttggtcacagtgattggaaggcgcttctggcattgaatgagcaaagcccaggcagcaggtacgatgcaatgtacaagatagttctgcacatgaagaattgtcctgtgtttaacacgattattctcaagcgtctcaacagatatttatgtaaagttaattacagaacctgtctataagagtttgagctagaacctaactttgttttacatataggtacaaagtatttgttgccaggcttaatgcacactgaattttccaggaataaaactactttgtcagttggggaaagattgcgcatcgttttatgtggacctttactaaatactgttcacaatttagagaaattgtgtcagccatggccacaccactttggaaatttgaatgatcgataaaacatactgtgtggatctgtgtttggagctgtattcacggtgattccatgcacacagctacttcatggtgtcttctgttggcagttttgtgccaatatgtaaaaacaaaagttatgttattatcaattccattcccccctttttcttctatacttaagatattatactgatttacttttaaaaattattacgcaggtaggttatatactacttacgatttttatttcaagacagaaaagtgtgttataaaaagggacttgggattgataggcttgaaaacccctgcctagatctcgaagtaccttgtatactattaaaaggagctatgtattttatagtccttgaagtatacccttcaaactatctacataagagtcacctggtgagcattttcaaacttcagggtcctgggcccattttagaactactgaattccttgtgggagacttgaatctatcttatgtcaccctctccccaacctacacgtgacttttttttttttctttctttcttttttttttttttgagacggagtcttgctctgttgcccaggctggagtgcagttgcatgatctcggctcactacagcctctgcctcccgggtcaagcaattctcctgcctcagcctcccaagtagctgggattacaggtgcccgccactacgcccagctaattttttgtatttttagtagagagggggtttcaccatgttggctaggcaggtctcaaactcatgacctcaggtgatctgcccacctcggcctcccaaagtgctgggattacaggtgtgagccaccatgcctggcccccaacctacacaggactcttatccctctaacatttgagaatgcactgctatagaatttctctaaatttaagaatttagagaaatggagggatataaacaggttttaaggttaaaaataatactctgggttgggcatggtgacttacacttgtaatcccagcactttgggaggccaggacaggtagatcacctgaggtcaggagttcaagaccagcctggccaacatagtgaaaccccgtctctactaaaaatacaaagattagccaggtgtggtggtgcgcatccataatcccagctacttgggaggctgaggcaggagaattgctggaacctgggaggcagaaattgcagtgagcccagatcgatccactgcactccagcctgggtgacatagtgagaccctgtatcaaaaaaacaaacaaaccccaaaaaacaaaactctaataggacttcaatggtagatggaaggagcttcagactcacagttgagaaccggtgaagtttctattgtaatgttctagttgaaaaattttgatgaaatacagcatggtatgtggtagacatgggtgagagaagttattatgaagtaaaatgatacaatgtagtgatagcattggcagaataaaagagaataaagctagattaaagataacaaaggatggtttttgctaggtaaatggtgttatcatttatcaagttggggatttcattggggtgggtggctagtctgtggtttctggtttgggcatgctgacatttagtttcctgtcatacctgtcagtggagattgggtatatacagatatgatttagtttaggagaaccatctcctagagataagcattagggaatcattcacatatggatggtagttgaagccattcaaatggtagagattttgcccagggagtacacagaatgtccacatacaggatgatatatatgtgggcttcttctccttgtttctaagtgaattttactcccataatattcaggactccttttagatatgatagttttaattattgaagataatgtagttccgttgtagctccatatctttgctgaataagcttaattgggatgtggtgtgggaaacccatacactttcagacatatagcatgccacttgtttttttttgtttggagacagagtcttgctcagtcgctcaggctggagtgcagtggcatgatcttggctcactgcagcctccacctccagggttcaagctattctccctgtctcagcctcctgagtagctgggattacaggcgtccaccaccacccggctaatttttgtatttttttagtagagacggggtttcaccatgttggccaggctggtcttgaactcctgacctcaggtgatctgcccaccttgacctctcaaggtgttggaattacagttgtgagccatggcacctggccaacatccctcttgttgtttagtccagcctcgggacaaaggatgtgcctggaaaagactaatgatatagtttatgatacggttaaaaaaaaaggttatagtgaaaacagctgccagtctacaaaattagtgtggtttatagaacttgcatcttacagatctattgattattaagaccccaaaccaattggtttttacttgcctctgcatttttttccttaaagaatacacataccctagtctttgaagtgtataatttatttgggttggggtatcttctctaaggagattctagcttcgttgtctgatagtcattttccgtgcagttccttcctttccaggcattcacatttaaattgacaaagacaggtaaaatttaacacaaatagactgatgtctttgtttagccattgacctctgagtgtcaaatatcacaggttctttctgtttttgtctttctctttctttcattatgacaagtggcactatcaagtttttccttacatgaacgcttcctatttctctccttcctctgataatttagaaacaagtttggcaagtgctttttcgaactttccgtcgtcaatactgaatgcctttagttagaagtctatgattccagtcttccctatggttttcactcttggcgatttcactttaatggtttaaaatcacaaagttctgggctctggggactgacttcataggggagagtctacgtatttaaaagcatttttgcagtgccagctgtggctaatgttgtgtcagcatttccatcatcataattcccaacattcgagggtttataacgagactgttaaatttcaccacaaaatgaagcttggtatgcaagaattgagcctgaagcaaactttttcattttaaaaaaaatgtagtttgtctataaagccactaataaagaagcaaagctagtgattattgttgttacactacccaaactgcttggtttacttaatacttcagggacattagactgtaatgtaaggcaatcactccaggagtctgcagaaaaaacagagtatgaatgtgggtgatatttaatttcggagggtgtctgaacattagaaaacattttcttctcaattttaggataattttctagccttgtttatctaaatgtcctgtggggaagcaaaaatgtttggggcccatgataatgaactcagtataaatatgcaaatgcttaaaacctcaagcaggtccctttcctccaacctcagagcaagagaaatgacaggcatgtcgatgagggtgcagtacagcatgggactggccattgagctgctacaatcttcatttaaaaatgttctttcattcccatgaaatgttgatccttaaggaccactgtagggagagcagatacctagagaatttttttttccttgcggtaatgatgattgatttctgcagatacctccccattctctggctccgacctcccttgtgactggcaggaagcatatgcaagatgctaatttgagttaagcacaaaatctatggccttgcaacagaaacagcatgattcacatatggatgaacccatggctctggcctctttagtgctccatacttaaatcacccaaatgacttagcccgcaggttaatggaatgaaagctaaagataaccttgtgagggtcaagtcggccagccttgtcttccctttacagtgttcagagatattcattctattgttcttcctctttttacctcatattggctcttttagccatattctctccattttcatcacctcttctgggtgtattttctttttctttctttttttttttcttttttttgagatggggtctcactctgtcacccaggctggagtgcagtggtgtgatatcagttcacggcagcctacgcctccaggactcaagtaatcctcccacttcagcgtcccgactagctgagaccaccacaggtgagcgccaccactgccggctaattttttgtattttggtagagagggttttaccatgttgcccaccctggtcttgaactcctgagctcaagtgatctgcccacctcggcctcccaaagtgctgggattacaggcgtgtgccgccgcgcctagccttctgggtgtattttcttctttcccttcttccttactccaaatagtccagactgaggaactgtttgtagagagtctgctaggtactaagtgaaaagctcggctttcacatacatgcactacaacatttgagcggatgggtgcagattgatagataatgaagtaatatataatttgtatatacatatgtgtgtgcatacatacacatatataatatatatacctgtatgtatatacatttataatctgactgcagacaccctcagcaactcagtaacaaacagttatgctgtttaggttacagagttgcaaaaaactgtaatgagttagaaaaaggtgttccttttggcctcagggtgtgtggtttggcaagcaggtgagggctggctgtgtgtccctactcccgccctgggttgggcatgattgtgtaggggacatcttgcacagccttatgagcagccctgagaatgtcattgattggcattaatatttctttcaatgtgtcagtttttcttttgttattcaaaaccgtcacaaatacttaatggataatgaagtattgttaatataatgtaagcttcttttattttatcttaatttactttatttttgagacaaggtctctgttgtccaggctggaatgtagtggtgccatcatagctcactgcagcctccaactcctgggctcaagtgttcctcctgcctcagcctcctgagtagatgggactacaggtgtgcatcaccatgcctagctaattatttatttatttttaattttttatagagacagggtcttgctatgttgcccaggtggatctagagctcttggccttaagcgatcctcctaccttggcctcccaaagtgctggaattacaggcataaaccaaagcacctagcttctttcactttatacttgagaatgtattaatatctgaatttttagactattagaagaggcaaatggttagaggaattgtttgtgcagacaactggctgttcgtattacagtgtgatgatttgtgggcaaacattagccaggcctctgagtgtaacctaggattatttttctccccctcagtaattcggaagataactttcaaacacagatatctttttggtactgaacaattaagttgtatgaatgccatgactaggtcttttagattcctacagtttgatggttgttagttgagattatatgcgtggataaataagtattttagtaattattttatgtttttatgaaattcacatcctaggctgggcgctgtggctcaggcttgtaatcccagcactttgggaggccgaggtgagtggatcacctgagtttaggagtttgagaccagcctggccaacatggtgaaacgccttctctattaaaaacacaaaaattagccaggtgtggtggcatgcacttgtaatcccagctacttgggaggctgagagaggagaatcgcttgaacccgggaggcggaggttgcagtgagcaagatcacaccattgcactccagcctgggtgacaagagtgaaactctgtctccaaaaaaaaaagaaaaaaaaaaagaaagaaattaatatcctagtcttttctccaaatttagtggcttaactataattagagaaaatgttagaaccaaagagcccagataacagggaaaccaggctggctttaggacattaaatttatggaccactgtatgcatgttaggaaatcagtgggctttttaacctgccttcaccatgctggtcaaaggactcacttttttttttttaaccattttattgagaaaaaaatgttttatgtatttcatgtagaacttgatgaattcggggagaagtgtatagccttgacaatcaaggcataaacttaacactttcagaagtttcctctgctgcttttattgatttagttttaaatttctttttgttttctttttttttttgagatggagtcttgctatgtcacgcaggctggagtgcaatggcacgatcttggctcactacaattatttttaaatttctaaaattttttttacttttgtggtaagaacatttaacgtaagttctattttcttagcaaaatgttaggtataataaaacattattgttaactagaggccctcttttgtccagaatttattcatcttgcatataaacactttgtaccttttgaatcactcctccccatttctcccttctccagcaactattctggaaaccacctttccactctttggttctaccactttgaatatttcagattccttataaaagtgggatcatgcaatatttgtgcttctgtgtctggcttgtttcactcagcttaatgtcttctaggtccatccatgttgttgcaaatggcaggctatccttcttttccagggttgaataatattccattcaaactcatttatttctgtcttcctcctgtgtgccaaaaacataatccatgatgctgacatagccatgtcctcctttaatctcagccataattgatgttgtagacgttctccgctgacacatacgggtaacggactacaagagagagaatatgaatctgctgctgccattatgagaccttatttttacatggaaaccaaatcatattgagtgagatgcaaactgcttagatgaaatgtttataagaaccaatttaggtcattataaacagaatgaataacttgattatctcgaagcatattgtttcagaataagaagttaactctcgagttctgtgtctttttcctttgaaaatgataaagtagttcctcagctctgtgattcacttcctgttttgggggacaggatgttggataaatggtaaggcccagacatgtctactcttctagctttgcaaatgggtcaaatttcccttgtttattcaaggaaccagggataaagttgcctcttgtcaaactagaggaaacttcttagaacagaaggccatgctttagggatgttttaatccatatattctttttattctgtggccttggctttactctgtttctataattttcccttttggtttgtcttctctatgtcttctttctgtaatgacgagtagcagttgatcatatgttgtctataagaagatgaatgattcacagtaactatgcatctcccctattcccttcctaacaaaattttggaggcatgcaaaaatgagtcttttaaatgagatttaaaacttttcaggccgggtgtggtggcttatgcctgtgatcccattactttgggaagccgaggcgggtggatcacttgaggtcaggagtttgagaccagcctggccaacgtggtgaaaccccgtctccactaaaaatacaaaaagtagccaagcgtggtggcacatgcctgtagttccagctactcaggaggctgaggcaggagaatcacttgaacctgggaggcagaggtttcagtgagccactgcactctagcctggtgaaagagagagactccatctcaaacaaaacaaaacaaattttctttcctaaagtctcaaagctttattcgtttccattgtacatttcaaatgaacaatgaaactaatacttgtatttgatttgactattgatttgtcacaaatcctactcttttcttgatggtgaggattataggaaattttacttgggctgggggcaggtaaagaaagacagttgttttttatgatattgttctaatatgcatatttccatatgcatacttttatttttttcttttcttttcttttctttttttgagatggaaccttgctctgttgcccagactggaatgcagtggtgtaatctcggctcactgcaatctccgactcttaggttcaagtttttctcctgcctcagcctcctgagtagctgggattacaggtgtgcaccaccatgcccagctaatttttgtatttttagtagagacggggtttcaccatgttggccaggttggtcgcgaactcttaacctcaagtgatcagcccgcctcaacctttcaaagtgctgagattacaagcgtgagccaccacgcctggccatactttcctttcctaaattttccttcatgaatttcagaggtatacaggattcttctgcattcttcacaagagattacatgaaaagaaaacataacattggattgatctgaatgaaaaaacaaaagcctgagatgaaaaagagtaaaaaagacactatgcaagatagcttacataccaactccttggtattacaggtttagcatcccaaagtggaaaatctaaaatgtaaaatgcttccaaaatccaaaactttttgagccctgacgtgatgctcaaaggaaatgctcatgggagcgttggtttttgtttgtttgtttgtttgtttttttgagatggaattttactcttatcgcccaggctgggttgcaatggcatgatcttggctcactgcaacctctgtctcctgggttcaagtgattctcctgcctcagcctcctgagtagctgagattacaggttcccgccaccacgcctggctaaatttttttgtttttttagtagatatggggttttgccatgttggccaggctggtctcgacctccggacctcaggtgatccacccgcctcggcctcccaaagtggtgggaggccactgcaccctgcctcgtgggagcattttggatttcaaattttctgacttgggatcctcatctagtaaatatataatgcaaatatccccaaatctgaaaaaatccaaaatctgaaacacttctagtcccaagcatttcagataagggatactcaacctgtgttgaagaaaaagagaatccataataaagatggcaaaggaagcagatcctatgatacctaaacagagacaatgagagatttctgtactttttctaaataatagaatcttagccctgattcacgtctactgggtccaatcactaggcagttagtctccaaatagccttgtgatttatgatatagtctaagtggaatcaaaattggagcctggattctccatgccatttctgacttttctgagtgtgggtgtgttgtaaatatgtaggttggatgggagttgaagatcctaagaaatgtaaacaacagccctgtctttgaagaactggaggaaggctcagggttatgaggatggaacatggagtaaggggtgtgattataatgagtgaaagacatctctttgatggatggtattccacccagtgggtctcacacctggccatacctcatcacacctttgtttgcacatacctgacatcattggcaaatctaggtctctggatgcttcccaacactggcaccctgagctgaagctaattctgtcaccatgattagctgtgtacagataacttatctatgacaattaaaaaaaaatccatgattggctttttgctgttgccagccagccactgtctgcagttgttacttggcttgtgtggagggaatataaaacttaaaattattctaaagtaaacttaattagggagggaaatttgtagccaacttaccaccctcatataatgcaaccaaaaccaaatgtaaatgatttttggatgatccaaattagttctcccttctgccagctcacatggagcaccaagattagagagtaataagaaggccttctaataggtaggttttggaacggatttcatttgcattaggaaagagcattgggaagagtgccctttagaaacacttgcccacatatttatttttggatttatgataccagcatactgcattttaatttgttcctttttgttgagtgctcagatttttatgtctggctttttattttgtcttgtgaatttgtataactttcaaaatgacaacacccattgcttagcataagggacaaaagaaactctttttttttttcctcccctcttgtgcctttttaaaataagctatctaacaaagacacaattttttccctccctctcctaagccccagatgacctaaggatttagaggtctgaggtcagatttctttcttctttgcttcacagacaactgtctcttctttatattgtgatctttctgatttgtatagggactcggcaggtagaagaatgtgtgtgtgtgggttgtgtgtaaaatatgtacgctttcacatgcggcgggggcatctttatgctttggctcagatggcgcatatgaaagaaattaggtgattctaattatatagcccccaaatagtgaggatcccaattcttctccttccctctttgaatctatttaatagtttacctttgaaccaagttaattaggaaaagggacaggctacagtcatttcatttggctgtttttggcatccaggaaagtgtggggtggggagctcatcagagggaaaccaagggaagctcgtagacattgaacttgctctgatcagattattaattttcttctccttgtacgttgttaaatctgtagaaaaggaacatcagctcaagatctgtcgctctggctccgggccagcatgccaaattctgtcatctttgcagcatggccaagcatctttattacatgttataattctggtttttgagcttgatccagtgatcctgctacagcatcagatggtttgggatgtggaaaaagaagagggctatattcatctgtagatgaggtttggggagaattgtaagagccagaaaggtggagtggttgtctagggcagggacttttcatggatgctacagacacctcctttgtgctgcctcgaatttgaaatgcattattaatttctgttcaatacagatcgttgatgtcaaaccaaaaataaatgtgggccctactcctgctctggccattacatctctcagcagcccagcaattagcaccaaccttgagaacagagtgccatcattgatgtgacagtttcgtccctattgtcctgttcctgggtgcatgggtgacccttgacctccattggtctcggagtgggaaactgaacttatgaactgttcgggctgcgctggcctcagattaacctgggcaaggttaactttctcactctcttcttcaaaagtgctttagagggtgaggaagtactaggagtaaataataattttaaaaaatggttgggaggggaaaaacaattgcatcaatttcctgagtacagacacccctaacctgccttttgcaaataatctcccttttgtctgctcttaggggttttgcagatgaagccttggctttggcttgtcaatgaggacttttcagaagctccagaatgcctttagcggctttgcaggaagcggtgacacaaagttccagccagtctccccctccttccacttattgtttcagaattgtcagaaaacaggctgggatgaggaggaagagctactgtgagggctttttttttgttgttagtttggctgctgaatgaaagcaagcactttatttagaagtgagtagggagggaaatgcagcttagggttgacacccttctggtgcttatccataaatatgaaatggtgttagaacaccagacaccagagagctttctgattggctgttggtgatgtcatcatgtcattaatactgtgctcagaaaataaactgatccgcctgttttccttctttctctctttctttctttctttctttctagctgaaatgtatgaaatccattttgtaatctaaaatgaggtgcttcagtcaggacatttcgaaagaattattatgtttctcatgtgttcagagtcattttggtattcacttgagcaaagcaatagtcacccacaagtattcagcctatcttgtcttattgcttaaaagtaaaggcagacgctattcaacacctgggtaccaacagttgacatttacccacattaagtgctaaggctgtagatgaggatttcttcttgtcggcctttaaacatcctagtaagcccagggccaacgctggcacaggggaaggtgagggatgtgggtgagtaataaggagtgctttcttttttattttcttataaactaattttgtttctctacctgtgataactctgcagtccaatttaaacctgcctgcttttccacttaatgcatgctcatctgatctgttagccttataattgtgtttcagcaggaggaatacacttgtggcatgtccaaggtgtgtgtgtgtgtgtgtgtgaaaaatccaatagcattcttgatatgcaggagtgaaattctcgggaggaaagccactgccaagcaacactctaacctctgcattgattttggatgcctagaggtctggaagatttgacagttctccattcctactgcttcactctcatccaagaaggaatactgtttcgattaatcattgggaagcattttggatagatatagctctgtgtgttttctttaaattaaatatagaactgtccttttgagggaaagccgtgattctttattgtcagaaagtttggctagaataaccttcccttttcttgtaatatttaactttgcttgtgagtaactataacaattcacttccttgcatgccagtgtcctcttgggtagaatctcctaataacatgtacaaatgttatgtaaatcccccctcccccacaagatgtttattgagtgaaaatgcctctaagattttattccattactgtcaaaatgtccaaggttattttacgcatgctgtggacatattatttggattagcaaaatgtctagcaagcaggtataactgattctggcatgcaactgtaatctcttgttacagggagacagtgcattccttttcaaggttaccctcatttttttgcaaggttataaaccatagatttaggaatcactggggtcaaagggaaaagggaaagacaatgagccccattcatccttatgagccctaatgagtatagagatagtatattttccaggttagagccccatctctgacaggctttaattatctatgagctgaaacaagaagcaatataaacatacaaaagcatttcaggaacaggtttttgaaggagatgaatcacccaagttggtgtcccactcagcccttttgcaaggggccagctccctccattctgcctgccacttgatcacgtgacagctgtttgcagactaaaggaaagaaacaatcattcactagcaggaaacccaatcccgggcaggtgcagtttgagtaacgactctaggcctgaaggtcagaatggctgcaaagacctaagcttttgcagatggtctgagtgggaggagccaggttcaataacccttctgtagcccccaggttggtccttcctcggggagggtgctaccacttctccagatactgctgaacttttgaacccaagtacagtacgctatttaggatgtttgtcatttatagcttttagataaagcagtagcggattttaaggaaacagtagacagatccattttccttttcctccagtgatgttagtgatctaattagaagtcagtgttttagcagcttcctctctatgtgctttgggttctttttttctaagagacgcctatggacatgaacaaaagccggatgttgcactagggcttctgaacaagtgctctgcattagatacgtctggagtttacacaccacgctttcctctgtgcagaccaaatgagagcctgccgggtgttacgactccctgtgtccattgtcaaagctgtattttcactgccttgaaaagtgcccttctgccacttcattttatatccattaccagtggccactttttctatttatattgcttggaactaattgagattccaggtgcacaagtgtgtcacacgcaagggcttgggtacttgggcaagtgtaacaatagttcaggaagagatgatcagcagccaccctttctgggttgaggaaacctccaaaaaaaccgaatagaaagtatcaaatacataaatttgaagggagaatatatgagcctggcatcttctcagctgcaacctgatttattgaaaaaaatggtgattgggggaaagtatagaatatttgcttgaaggaatccacttctctgaatagctccctcgtttctgtggcttggagactgagacttagaattccacaattatactgtatagatgagccttgttctatatttgggatgtaatctccacactcaggagctacatatggccgtgagcacccacttaagagctaaaaatgtaagttaccgcctactttgtcctgaattggaatcatacataattgctctatgctttaaaaaatcttcctttgaggaaagagttcaagatcaaattgttagtgggtaatcttatatgaagccaagtatcactagctgttgaaagaagctacataaatacttgttgttgaacaaataaaataaatgaaggaagaattcacatctctcattacttaatcagaaagtaacatggtgagtcaggaagctgtaggcttatcctagaagtaaatacccatcatgaaatgggcagagatctggaagcaggaaccgatggggtggactcctagaactaatgaaaatggaaagtatgcaaagtccagtggtttctaaatttggctgatcatcagagtcagcttatgagctcttaaaaacaaaaataggctgggtgcagtggctcatgcttgtaatcccagcattctgggaggctgaggtgggcggattgcttgagctgagaagttcaagaccaggctgggcaacatggcaaaaccctgtcccaacaggaaatacaaaaattagttagtcatggtggtgtgcacctgtagtcccagctacttgggaggctgaggtgggaggattgcttgagctcagggacgtagaggctgcggtgagctttgattgagccactgcactccagcctgggtgacacagcgagaccctgtctcaaaaaaaaaaaaaaaaaaaaaaaaaaaaagctggtgcagtggcttatgcttgtaatcccagcacttctggaggtcaagataggaggatgcttgaggccaggcgttcaagaccagcctgggcaacatagcatgaccccctctctgcaaaaaaattaaaaaacaagttagctaaatgtggtgatgtgcacctgtaatcctagctattcgggaggctgaggtgggaggatcacttgagcccagaagtttgaggctgcagtgaacgagactttgactctaaaaagcaaataaacaaccgaaaaaccccaaaagacaaaaataaaaacaaacacaacatcaatttcctggcctagactccgaaatctcttaatgcccagcctttgtccacagatcagaaatgccggggatgagaaggggatgtggaggtcgagggcatgaaccaaggaggtggccaggctttgccagcacagagcaaaggaaagataccattttgggggtttgtttttaaatggattccgcaaacatttttttgagcacaacacattgtatcacattttgtgatggaagtatacaaaacaaaactcacttctgctgacaggcccacagacagatttatcttgagcagaatgacagctccacttgctcagtgtattgtggccctctgagtatcattagtagaggaacgtagaggagggaggaataacaggttcgtagaagcctttgaggtgatctttaaactggtgttctgaagggtgggtagggtttttctaggagtacgaaggccagaggggagattaggaagatagaaaaaaaaaaaaaagggcaaagacaaggaaggaagaaagaacaaggtgtgtttgcagaatggtgaagaaggcaaaggatgattggaggtgagagctgagcctgtggccagtgccttcgtttgcaagactaaggtatctggagttcatagtatggttgaccttgaacaacatgcggttgaatggcaaaggcccacttataggcagattttcttcctcctctgccatccctgagaaagcaagaccacttcctcctcttccaccttctctgcctactcaatgtgaagatttctaagtttcagtctccaaggatgaagacctttataatgatgccctttcacttaaagagtagtaaatatactttttcttccttatgattttcttttctctagctttattgtaagaatacagtctataatacatatgagatacaaaatatgagtgcatcgactattttattggcaaggcttctggtcaacagtagttaagtttttggggagtcacagttatatgtgggtttttgactgtgcaaggtggtcagtgcctctcacccccacattgttttttgtttgtttttgagacagagttttgctcttgtcacccaggctggagtgcaatggtgcagtctcggttcactgcaacctctgcctcccgggttcaaacgattctcttgcctcagcctcctgagtagctgggattacaggcgcccaccaccacgcctggctaatttttgtatttttagtagagacaaggttttgccatgttggccaggctggtctggaacttctgacctcaggcgatccacctgcctccgcctctcgaagtgctgggattataggtgtgagtcaccgtgcctggcctacccccacattgtttaagggtcaattgtataatcaaccctgttccccccagaaagataagatgagatgcttttaggatgttagccttaccactctggagtgtaaaagaaactgggggggttgccctcaggcttaaaggagctgtggacagggagaggcacgttgggttttgtctctaaacagaatacaagccctctgaggatgggcaacttaacttccaaagattattctcatctctgcagcatgtggtaggcactaataccattctttggttaattaaaagatgtttaatatatgcctcattaagcagaataatcagtatctctgagatgcttatgtgctttatttttctccttttaataaaaacaaaaattagagggataagaaataattaggggcaggctgttagctctcacttcatttttttttctcccttgatgattctctttcattttttttccatagctcacatagctcactttctcccttgacctagtcctctgctgataacatcaaagttagcacagcttgcagacctaagtgggtttagaacacagctctcaagatggagccatgcagatatggaaattggattttaagcatctgtgatctctgcccacttcctctttaactaacacatgagacccctcacaatctctctaagatgtagaattgtccatatctgtagactcgaagtgctgtggctgaggacttttttttttttttttttttttttcccaaggcagaagaatttttcttagtacagaacaaaatgaaaagtctcccatgtctacctctatccacacagacccggcaaccatccgatttctcaattttttccccacccttcccgcctctctattccacaaaaccgccattgtcatcatagcccatccccaatgagccgctgggcacacctcccagacggggtcgtggccgggcagaggggctcctcacttcccagtaggggcggccgggcagaagcgcccctcacctcccggatggggcgtctggccgggcagaggggtcctcacttcccagtaggggcggccggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcagggggctgacccccccacctccctcccggatggggcggctggccaggtggggggctgacccccccacctccctcccggacggggcggctggccgggcagaggggctcctcacttcccagtaggggcggccgggcagaggtgcccctcacctcccggacggggcggccggccgggcggggggctgacccccccacctccctctcctcacttcccagtaggggcggccgggcagaggcgcccctcacctcccggacggggcggctggccaggcggggggctgatccctccacctccctcccggacggggcggctggccgggcagggggctgaccccccctcccccctcccggacggggcggctggccgggcggggggctgaccccccacctccctcccggactgggcggctggccgggcggggggctgacccccccacctccctcctggacggggcgactggccgggcagaggggctcctcacttaccagtaggggcggccgggcagaggagcccctcacctcccggacggggcggctggctgggcggggggctgaccccccccccacctccctcccggacggggtggctgctgggcggagaggctcctcacttcccagatggggtggctgccggacggaggggctcctcacttctcagacggggcggttgccaggcagagggtctcctcacttctcagacggggcggccgggcagagacgctcctcacctcccagacagggttgcggcccagcagaggcgctcctcacatcccagacagggcggcggggcagaggcgctccccactcagacgatgggcgggtcaggcagagatgctcctcacttcctagatgggatggcggcggggaagaggcgctcctcgcttcctagatgggctggcggccgggcagagacgctcctcactttccagactgggcagccaggcagaggggctcctcacctcccagacgatgggcggccaggcagagacgctccggctgaggactttctttgtgcttatttttatggctggtttatttgcatcgttgcagaatattcataaatcagaaaagaattttttttctttctcctttaaggataccaaatccaggtgggaagtaatgatcttggtgaattctagcacttgtcaatttgagagtgttcagggaaaacaaatgaaagagaaaggatgaatttgtttgtatgctatcgttcactaattcaaagctgcagacatttctttcttactatacttttgaagttaaggattggaactgaataatagacagccttccaacatgaaacatgaccaagcttgagggattttattggggtttttgatattgcattgttttctagtttccctttgtctttgatcaacttattccgatgacaagaatttggtcatgttattgcttttctctttccccaaagcttgtcttatgtcatgggaattctttctcttttttcttttctcagtaattttgttgattgcaaataaataaactaagtatttatctagacttagtttaaatataccagtcagttggaagtctgcttttatttttccttcaagtattttcagttttctatttaaatgtgttcatagtaaagaattttaaattctaaattatataaaacccattcatcctgaatattgggctaaggcttatctttgcttcgtaaacctttctcagtgctgcaaattaggagctaagtaatactgtcctagtggtggtggtggtggtggtggtcgtggtggtggtggtggtggtggtggtgtgttaaaaatcctggagtatgaactgttttcaagtgtcttcaagtacttcagaagtctccatttttatagtagcacttgatatggtaattatatatgattctcctgtgttcattaaaataggagcctagggcttctctgacaatttgttagcttcccataggttgcaagtaataaaattgccttgctctaaaaatctgtaattcattgctttcactaattcagatgggctttctctccattctttttcctggtagataatgagaggattttttttttctcattcctctgagaatatgagggtagtccagctatgttaggaaacagaagatatgggttatcttggaaggtgaatgtggctatttttattgctttggtcttaaaggacctgtaatttcaaaagcatgataattccctacctcttagttcctgcagttaactcctaggcccgtatttccagaaaggatgtatatttttttcctgaaaccaaaataaaagtttctatcatctcaataaggcagctttttaaaacgtggaaaaaaagtttaaaaacaaatccgcctaatagccaaaaggtagaaccaacccagaagtccatccatagatgaatggataaacaaaatgttgtatatacacacaatgggagattattcagctttaaaagatggaaattatgacacatgctacaacatggatggatctgaggacactgtgctaactcagataagccagacacagagggacagatatggtatgatctcaaaaatatgaaatatttcgaatatgcaaattcatagaaacggaaagtagcttagagcttacctggagcaggggtggaggaatggagttactgtttaatgggtacagagtttgttttgcaaattcaagagttctgtggcaggctgctggtgatagaaaaacaatgtgaacaaatgtgcttaatgccactgaattgtatacttaaaaatggctaaaatatggcgtgtgcctgtaatcctatctactagggaggctgaggcaggagaattgcttgaacctgggaggtggaggttgcatgagccgagattgtgccaccacactatagtgggagactgtgtctcaaaaaaaaaaaaaaaggctgaaatggtaaattttatgttatatatatatatatatatatatatatatatatacacacacacacacacacccacccacaattaaattttttttttttttttgagatggagtctcactctgtcaccaggctggagtgcagtggcatgatctcagctcactgctacctccgcctcccgggttcaagcgattctcctgcctcagcctcctgagtagctgggactacaggcgcccaccaccacgcctggctaatttttgtatttttagtagagacggggtttcaccatgttggtcaggctggtctcgaactcctgacctcatgatctgcccgcttaggcctcccaaagtgctgggattacaggcgtgagccactgcgcccggcacacaattaaaattttaaagaaatcttcagggaaagggagtactactaatactaagtttttagaacttacaagttatataatacaaattggtcatttgagctgattttcaatatgctgacacatgcaatataaattgcaaatatgtatgtcactaccacaacatctaaaagaagtcaaagatgtacacaatgtttatgacaaataaaactattgcatgtaatgtcagaaaaatatcccccaaaaaaaacccaattagatttgctaatttgtggtatttgtgtgtctcctgtacagacattttctcatttggattcctgacacttggtaaataaaattactattattgttctcttgtttctttgaatttggaattcctggaacacaggaaaatttgatacacgtcctaaaagaaaaagaggagaacaaactgagtgctacttaatatgggggcagcacagtggctcacaccaataattccagtgctttgggaggctgaggctggaggattgcttgaggccaggagttccagaccggcctgggcaacatagcaagatcccatctctaccaaaaaaataaaaattagccagggtggtggcatgagcctgtagttctagctacttaagtaggttgaggcgggaggattgcttgagcccaggagtttgaggctgcagtgagctatgatttcttcactgcactctagtctaggtgacagagtgagaccctgtctctaaaaaaagaaaaatataagtaaataaagtgagtatgcatgtctgaaatttgtttacctgaatgttctgatttagtgggtctggcgtggggcctgagagtctgctgtgctcacaagcttcacctgaatccctacttcggaggtcctgggaaggctttggatggttctgctttcatcactgctagtttaggatccacgctaaatcacgctggttacttaccatgaatcagttttctggctttcgtgatattgttgctgctgtcatctcagtcttcttgtccttgtagatttctgcattctgagaaactcctttagttttattttagtggagtattttgatagggcgaaatgaagggaactgaggtggcactcatttttaaaaggaagttcccaattctgttttcactttttttctggctaagtgctcattgttgggggaggggagaacactgactaatttagcagaatcagcagcatgtatcagcattcccctctgacctcaagtttatttgaatcaatgttgattgagcgctaagtatgtgctgggcattgtgcttatccttgatggttggtagatatggtccctgctataatgaaactagtgctatatgctttaacccaaaaaaggagggtggggcacacagatgacacaatcttgacggagcatgttcttacagtctgttgtatgtgacagttgtgaaagctgcttccttagaccccacccccactgtctcactcggcaatttcagtctcatccccagattgttctcctttatctgtttttatgatttctacccctttgctatcccggttgaagtggaaagttttaagccatagaatatgcttgtttctgtgaagggtctttctaaattgtgtccatgccactacatcattcttacttcagacagaataattgctttctaatttggcagagttaggggaaatataaacatgcccttattagcattgtgtggaagaagaattctgacatggcccccatgattcactcccagacccgtgttgcatacacaccctgagtaatccctggaactatgtctgtgatgaatttactcccttgactagttatgttctatggtataattgaccttaagatctggagaatatccaggtgagtctgacttaatcacaccagccctttaaaagcagagagttttgtcttgctgcttgaggaaagagaagctggagattcttagcatgaggaagattcaaatgcacctttgtgagctgaagatggagggggctgtgtggcaaggaatgccggcagccccaaggagctgacagccagcaaggaagtggggatgtcagtcctacaactgcaaggaactggattctattaatgacaagaatgagcttttaaggggctttttcctctagaggctttagatgagaactcagtccaacacctagatttcagccttgtgacacactgagcagagaacccagtcatgatgggctgggcttctgacttacgaaactgtgagctagtagatgcctgttgcctaagccactaagtttgtggtaatttgttatgcaccaataaaaaactaatatacatattagtgtgcaaatgcatttgaaaaagagtctacaagtacattcgaagaagactgtagaaggcttgcctgtgaaaaaccaagctaatgctgcttagccagctgggcaaagaaagtctagctaccttacacataataggaatgtaaaatgtcatcgatacataggaagtatcaaaccatggaaagggcatagatttagagagaagaaatatgagcaagtcttggctctcttacttcctagccaggggaggccattcctctgaatctcacctataaaatgaaggggttgaccagatgcatctcatcacaatgtaacccctggttttatttagcaagcgatgtactcatttccataactttctgtggtttagcctagccctgacccactgggtataggataagggttgttgtctgatggatgtcatttttgggtagtttttttaaaagcagcttaaaattttatgggtttttaaggatcagtccaaaatattcctgtctcagtacaataatctgatatttgcatcaaaaagctaccgcaaaatatattacttggggctgaggcaggtggatcacttgaggtcaggagtttgtgaccccagcctggccaacatggtgaaaccccgtctccgttaaaattactaaaatgccggcgtggtggctcacgcctataatcctagcactttgggaggctgaggcaggcagattacctgaggtcaggaattcaagaccagcctggccaacatggtgaaaccccatctctactaaaaaaaaaaaaaatacaaaaaattagcctggtgcagtggcgtgcgcctgtaatcacagctactcgggaggctgaggcaggagaattgcttgaacccaggaggcagaggttgcagcgagccgagatcgtgtcactgcattccagcctggacgacaagagcgaaactgcatctcaaaaacaaaaaacaaaaaacatgcacctagaaattgatctttaaaaatctgtttttgaaactcagggtgattctgactagaagcatttctctgcctggaacacctgctcatcagaactcattcttagtgtgcttccacagtgttttgggggtgggcacatagcccattcttgtgcatcactgtgcgttgagtctggtctgttgaacttagaattatgtttaaaaatctgtctgtgtgtctaagtactggtgttttacaagaagtggttgcatggagcatctgtgttgctagtctttttcctaggaaatgattcttctctgagcttaaggatcttgttcacactgcaaaataaaaatctgtagaaaattaaggacactcaagttataatatttcagggatataatgatatttcaatgggaaaatgctaattatggggagcttgctttcccccaacacctggagcttcttaacctgctaccaactagctgctgattttcataaataggactgtacgaggggaaaaaatccctcatcaactcagccaccaggaagatgctggaaagtgtctgtcagttgtttaaaagggagaaaaggaatacctcagccgcctcccaggatgcgtgaagcctccaggaatatcagccaacctgggctttccgcatggaaaacaaagctgcctgaatgggtatgttttaagactataacttctgagttgctctcctggatattttcaaacacatcttaaaaaggcaggtggacttagtggctcacacctgtaatttcaacactttgggaggctgaggtgggaggatcgcttgaagctaggagttcgaggtgcggtgaactatgattgtgcctcagcactccagcctgggcgacagagtgagatcctgattctaaaaaaaacaaaaaccaaaaaaaggccagaggcggaaatgcctcactgttgtggttcatgattccatcacagacattaatgaaaccttctatccacccaaggggcacaccactgtttccccctccatcacttttaattttgccccaacgttgccagccctcacttgacatctggcttgtgaggatgacttctgtggagctagctattgtttcttccgtcatttttaaacaatactagaggacagtggggaggggagagggaatcacagctcccacacaagcagatgcctatttgagagtgtgcaaaagcagtgtgacattctggaaatagtagtctcttttcacttccttgcccattcttctccatccatacaaatgacgtattttctgacattggttcagggtttgaaacctcaggctttcagagtctgcccacatttttgagaattctgtcttaatgaatgtatgccgtgaaaagcattaaccattactttcattctgttctagtgaaaccgcccaatgctctgcgcttgtacaaaatcctttggacttttaattgggcgataactttgcaagtggttaagcactatacaaattaaacttcagtcattcagcaatgttattgaacacttatatcttcccttaatttccttactcttcatatctatgttttatgaaattgagggcagcacaggttagcaaaagtggtttgatcttagaatgctttggtatttaattctgtgcagagtttctggtaattcactctcaccagcttagccatgtaatgccacaactccatagatggtggttgggcaccatgggtttaggcaccacctcctctcatttctgtttgatgttttcaagtgaagttaatttacagtaggatatagaaaggttaatgatttgggcagagaacttgctttccctctaccatataattgtgattttgactctactttttgttttgtgtgtgtgtgtgtgtgtgtgtgtgacgaagtctctgttgccctcgttggagtgtggtggcgttatctcggctcactgcaacctccacctcccaggttcaagcgattctcctgcctcagcttccctaatagctgggactacaggcatatgccaccacacctggctactttatgtagttttagtaaagacagggttttaccatgttggccaggctggtcttgaactcctgacctcaagtgatctgcccacctcagcctcccaaagcgctgggattacgtgcctggcttgattttgactctgttgaagtcaaagacaaatgatccagcagagacagtataaggtcttatcctgattctcaaattgtgtggaagacaaatatgacttaaaaatgacattaagacaaaagagtaagtagaggctgagaaatgggattggatgaggcatgtactccatgtggaatgcctattcagttaattgaagggtgaaaatcttgctttgtaaaacaaagtgctataaaaatggatacctggagaccatatcctacttctccctgcaattttcgaatattaatctgaaagggagaaataaatgacccaaaagggtcttggggtagagaaccatgctctagacgtttcttgttggtcatgtctccatctcagcaggaggatgagtggtgtcctgcacccatgcaagacttttaagttctggccaggcgcagtggctcatgcctataatcccatcactttgggaggccgaggcgggtggatcacatgaagtcaggagttggagaccagcctggacaacatggtgaaattccgtctctactaaaaatacaaaaattagccgggcacagtggcgggcagctatagtcccagctactcaggaggctgaggcaggagaatcacttgaacctgggaggcggaggttgcagtgagctgagattgcgccatcacactccagcttgggcaacagagtgagactccgtctcaaaaaaagagaagatttttaagttcctaagctgctgcttgaggtctgaagcctcaaatgatgcagctaatgagtaggtcaacatattccttttcttccccttataaatggagtaatacatttaaaatgtagaggctggttgccagcagtggcttaggtctgtgaggtccagggtgacgaagtgcacatgtgttgattaagtttcaatcctctgcctctagaaaggcctcgtccttcagcctggtgtcatggatggcgtgtccatggcctcttctgcctggatggaggtcccatgatctccatgctgccagctcctatcccatggccatgcttgggggctccctttgacatcttcagaggaccctgagaacttttcctgacgcctccgtctcccaatctgtcttagtctgttcctgctgctgcaacaggaaacctcagactgggtaatttttaaacaacagacatttatttctcatcattttagaggcagggaagtccaagatcaaggcatcagcaaattcacttgtctgttgaggactcagcctccgcttctaaaatggtgccttgttgctgtgtccttgcatgtcgaaggcaggagggcaaaaggggatgattgtgttggctgtgtcctcacatggtggaagagatggaagagggaggcagctctcctttttttttttttttttttttttttgagacacagtttcgctcttgttgcccaggctggagtgcaatggcgtaatcttggctcaccacaacctccacctcctgggttgaagtgattctcctgcctcagcctcccgagtagctgggattacaggcacccgccaccatagccagctaattttgtatttttttagtagagatggggtttctccatattggtgaggttggtctcgaactcctgacctcaggtaatctgcccacctcagcctcccaaagtgctgggattacagtcgtgagccactgtgcctggcctgaagcctcttttataaagccattaatcccattaatgatggtggcgcccccatggcctattacctaacaagggtcttgcttcttaatacattacatcaccttggaggttaatttccagcgcgtgaattttggaggaagacatacgtccaaaccatagcagtatctcattatgctttgagtctctctttgcttctggccaaggcgtttcagtttcttctttcttgcttcagagatgaatagtcttcctgggcccagcgctgcagtggtctcccttttcctgtggtgccttgttttttttgttttgttttgttttgtttttgtttttgagacggagtttcactcttgttgcccaggctggagtgcaatggcatgatcttggctcactgcaacctccacctccagagttcgagcaattctcctgcttcagcctcccaggtagctgggattacagatgcccgccaccacacctggctaattttttgtatttttagtagaaacagggttacaccatgttagccaggctggtcttgaactcctgacttcaggtgatctgcccgcctcagcctcccaaagtgctgggattacagatgtgagccaccgtgctcggccggtgccttctttttgtgtttaaatagctcaggtcttattttgccccttcctctcctcctccctactttccttctcttactgcctatgatcaggtagcaggaaaggtgggtgctttcatgtggactgtcaggttgatggactcttgggagtcaagtcaaggccttgtctaactcatcttccctcatcttaatttccttgttttcgactgggtgcagtggctcacccctgtaatcccaggactttgggaggccgaggcaggtggatcacaaggtcaggagttcaagaccagcctggccaacatggtgaaaccccatctctactaaaaaaaaaaaatacaaaaattagctgggcatggtggcatgtgccagtaatcccagctgcttgggaggctgacgcaggagaatcacttgaacctgggaggcgaaggttgtagtgagccgagattgtgctactgcactccatcctgggcaacagagcaagactctgtctcaaaaaaaaaaaaaaaaaattccttgttttcttgcatcaaaatttaagaacacaaatcgtaaaatgtggaaggtctgtgggacagtaggggtaaatttccactagagtagaagtcagaagcctggcctcaagtgccctctctgctattttctagttggaaaacctttgacaagtgagttaaccttttttgagcttcaatttcctcattttaaaaatagacatcgtattgatcttatctatagggccactaaaaaaatcaactgggataaggtatacctacaaactttgcaaattggctgggcatggtagctcaagcctgtaatcccaacaatttgggaagccaaggcgggtggattgcctgacctcaggagtttgagaccagcctggacaacatggcaaaactccgtctctacacaaaatacaaaaattagctgggcctggtggtgcacgcttgtagtcctagctacttgagggggtgaaggcggggggatcgcttgagcgcaggaggttgaggctgcagggagctgtgattgcaccactgcactccagcctgggtgttagcaagaccctgtctcaaacaaacaaacaaacaaacaaaaaatttatagataaatgaaaacaagaaaaagctttgcaagttctagaaagagcgagtaacctgtttcaggcaatatgctaagcaccgtaggacaatagtgagaacagtgcaggaagctgggcgcggtggctcacgcctgtaatcccagcactttgggtggccaagccgggggatcacttgaggtcaggagttcgagaccagcctggccaacatggtgaaaccccatctctactaaaaatacaaaaattagccgggcgtggtggtgcatgcctgtaatcctgcctataattttagttatttgggagattgaggtgggggaattgcttgaactcaggagttggaggttgcagtgagtagaggtagcaccatttcactccagcatgggcaataagagagaaacaacctctcaaaaaaaaaaaaagttaaaaaaaaaaaagaaaacagtgcaggattaaaagtgggaagactggtttgaatcccaaacatggcatttcctagctgtgtgactttggtaaattacttaatcactttgaagtttattttcatcatttctaaaatagggacaataacgtgaggtaaaatgtaatgctattgctagatatcaaaaattaccatgtgtcatacaaatgttagctgtttcattgttactctccaaaattatttagtgtagtgatacagagactaatttttggatatatttaaaagtaccatactgttagaatcctgggaaatgaaggagtatttcttgtgatccacgttgcaacctcttttggaatctagacatgaatgtaaggagcctggccaagtttctttatcttccacataaaataaagttcacttgattaattaagtgcattgttttatcttttttttttttttcaggatcttgagatacaagaaaagttttctatctcgtatttggcaaacctaattcactaactgtggtgtaacttttaaaacctttggtattttaatgtttatatttttaaaagggaggtaaaaaaatttgtcttactaggtgggatggccgtaaggtaaattgagataaattaaggatagattttggaaacctgaaagctaacatgttttactgccatcttttcaatatattttgaaacaaatataaagcttttgtccaaaagtgctttgtttaggacaggcttaaaattactaaaaaactaaaatgaattaggttctttcattatttaaaattatttcaatttaaaggtttgtttcattaaagtagccttgactttcacagttcaaaataatgttaatataaaatatagttgaaataatctttctaaataacagaaacagagacattaacaaagacacgcaattttttttttttttttttttttttttttttttttttttttgagacaaggtttccttctgtcacccaggctggagggcagtggcgcgatctcagctcactgcaacctccgcctcctgggttcaagcgattctattgcctcagcctccctagcagctgggactacaggtgcacgccactatgcccggtgaatttttgtatttttagtagagacagggtttcaccatattggccaggctggtctcgaattcctgaccttgtgatccacctgccttggcctcccaaggtgctgggattacaggcgtgagcaaccgtgcctggccaaaaccacgcaattttaaggagtactcagacatgccagtgtatcacaaatcaaacagataccaaataagaatgctaaggatttgatcaatgtaattaataagtagaattaagagatacattgtattttgcatgccactgagaatggaacctttcaaatgcacaagacatatttccaagagttcatcatatctttgtttccattatttttaaatgtctggataaattggtgactctttaccattaagtttaaaatagttgagttctactctcctactcttctattcttagaatagatgtgtagggctccagctaaaacaagaggctttgaacagccggctgtggtggctcatgcctgtaatcccagcacttcgggagcccgagatgagcagatcacttgaggtcaggagttagagaccagcctggccaacatggtgaaaccccgtctctactaaaaatacaaaatttagccaggtgtggtggcaggcacctgtaatccccgctactagggaggctgaggcaagagaatcgcatgaacccgggaggcggaggttgcagtgagccaagatcatgccactgcacttcagcctgggcaacagagcaagactgtctcaaaaaataaaataaaaaataaataaataaataaaaacaagaagctttgaatacttcttcaagtctaatgagactgaacttttgccaccagttaccacccctacccccacccccagccttttctagtctgcatagaactttggggaagggttgaggaggagaaggtctcttcagctttatagaggacatgagagagacaattcccagagacacttgccatgaggattggggtgcctgcaggaagacagcattagcattggattttctggttgagtgactgctcgggctgagttgccaacctgcccctgtgcctatctgggttgggaggagagaatggagaagaacagcaggaagaaggttgccaatggagcagcccacatatctccctttcagtttgtcaaggatatgcatggtctccaagggtgaaatggacactgggaatggtggttggtcctgagccatcttgctagaactttccctaagtggctggcttttgataatgggagccaaggcgtgggtggagaaggttgagccagacctatatcagggaagctgtgcagtgaggagctcccataagaccctcagaggaactcacatcccagccggcattatccagagacacgatcgtggccacttatgcagggagatatttgcctttctctctctaccagttcctcatgggaggaggatgcgctggaggccggggaacgagaaagaaatgtgtaaaaggctataacccagcccttcctgtttagaatccaagtaacagctttgcctgaccaaggcaggaacttacataaaaccaaaattgaatttgagaatagaaatgtaaattgatcaggctgggcatggtggctcacgcctgtaatcccagcactttgggaggctaaggtggttggaccacctgagttcgggaatttgagaccagcctgaccaacatggagaaaccctgtctctactaaaaatacaaaattagctgggcgtggtggtggatgcctgtaatcccagctactcaggaggctgaggcaggagaatcgcttgaacctgggaggcggaggttgcagtgagctgagatcgcgccattgcactccagcctgggtgacaaaagtgaaactccatctgaaaaaaaaaaaaaaaagtaaactgatcaagaatataatcacctaaagtatgacccccaaattaggagatcggtgtcattaaagatgagaaagaggtttataaatagcaatttggggccaggcatagtggctcatgccagcaatcccagcactttgggaggccgaggtgggtggatcacctgaagttgggagttcgagaccagcctggccaacatggtgaaaccctgtctactaaaaatacaaaaattagccgggtgtggagtcaggtgcctgtaatctcaattactcgggaggctgaggcaggagaatcgcctgaactgtagagacggaggttgcagatcgtgccattgcactccagcctgtgcaacaagagcaaaactaaaaaaaaaaaaaaaaaaaaaaaaaaaaaagtaatttgggggcggggcttgctggctcacacctgttatcccagcactttgggaggctgagatgggcagatctctggagtctaggagttagagatcagcctgcacaatatagagaaaccctgtctctacaaaaaatacaaaatttagctggacttggtggtgcatgcctgtagtcccagctacttgggaggctgaggcaggagaattgcttgagcctgaggggtgggggttgcagtgagccaagatcacaccacagcattccagcctggatggcacagtgagactttgtctcaagaaaagaaaaagtttggtagccttgacgtgattaaagtaagaccatttcatgttaattgcccactgagaggataacactcaaatgaacccagtttcagattctccttttcacatcattatgatatcaaatattcatcctctatccaaattcatcccagaagagttggtattaagtacttagcttctaggagcattgttattaggcctggagcccttgacattatgtatggtgtgaagtatatgtaaagatgaaaagatgactcaaggcagtaggtgtttgcttaagtgaattacttgtgataattgcatggcctctgtacacaaatggaaatatcttcattttaagaattgggtttgcattgtcaacggtgtgtgggacagctcctgagacacctaaaagatatataatagacaaagtaacactgagagatgctcaaaactactgagttgaaggagccatactctaaatagaagactgtaagcattatgataccatgtcaacacagcttaataaaaagctactttacaaagggagaaatatcgttcctaatgttttccatagagtcagtgaatgaattgagaagtggatccaggatttcatgtatcagcaccataggttttatcatttatataatccttttttctgtcactgtcaagattttaaaggggggattatggtttgacttaaagagagtaggcaattcaggcataccacacaaagctgttaaatctcagaggcttgagatttcttggctccttttaagttttggaagcagagcactcctagggaatgctattcggaattggcttcatggagaaaatgtagcttttgggcagttagcttttgaagctgagagaggataataggttggtgaacaagaaggcaaaagttgcttcaggtttgaaaaataaaggagtgaggaggtgatagtcttgtgaagactctcactgtaatagttctttgcaggaccaagtggttctccagatcgagctcaattttcccctgagtgcattttctgagttgtgataaagcccaggtaccctcttacggagcgacttatctctttgtgcccaattgctagggctgtgctatcatcttggccaactgcccatttcctttgggtctgagagaacatttcaatttaaatctgattgtatagatttaggacttgggggaaaaaaaggtatctggagtgactttttttttttttttttttttgagacggagtcttgctctttgcccaggctggattgcaatggtgcaatctcagctcactgcaacctctgcctcctgggttcaagtgattctcctgcctcagcctctgaatagctgggactacaggtgcgtgccaccacgctcggctaatttttttttgtatttttagtagagatggggtttcaccatgttggccaggatggtctcgatctcttgacctcgtgatccacctgcttcggcctcccaaagtgctgggattataggtgtgagccactgtgcccggccaacttttttctttctctgcctcctactatgagagttcccatctttgatggatgactcagaattcaaattacacctagaagcaaacacatcaggcttgagggtagagagggagagaaaagaacaactgtcccatctgtgtttcatcctgagtgggaggttcaaatctaggtattggcagaatgagataaaggaaggagagattgagaaagagtggaagtgggatggaaagttattaagggaagtcattccaggacagttttcacccactcagtagattacaggacgccatggaagaactgaactacctcggtaggctgcacctcaggctctgtgcagactaatgtttttattgcttaacaggtattgagtcaccttgttaaatgccatccctaatatagagatgggcttattccttgccccaaagctattgggagcctagttaggaagacacgtaacacacacaggtcccaacaccacacaagaatggtgctcctgtcattctattaagtggcttaccaggtggaatgaagttatcttgctgggagtcctctgccagcgagttcagtctgatgagaaatttgaaatttgatgcaaccacattgcatcaatagtaagggttttgggaaggcttcgctttgctatatgttgagagagacttgattcttggcaccgaggaggagagctaatggccctcaccctgcacgtgcttgagtgtgaagtggttaaaacaaaattttcttttactttttaattttaggtgatattttgatagggtcataagaatagtgtttcctacctaggcccattgctaataccactgtattaagtcttcttagaagcccatgaattctctggctaaaaagtcctgggggctccctgtgctagacgtagggggacatataaatggttttgaatttcagtttctatgtcagtgagaattctgtgccagaaaagagcatctgctctttattttacagatgaggaaatttagtcccagagagagcgtgatttgcctcttcccttgagattagccagcagagtcaataagaaaaatctaggtcttctgattcagtccagtgcctttctctgtatgtcgcactgtttccctcattatcttgagatttgctggagccacaggactgcacaatggttgtgcatatgtggatttgagtgccacagctgaattaactcatgtcaatctcagtcccaagcctgttcccacaacacgtggtaaatcgtcactccttgtggtctcagaattgggtgcctggaggatatcataatcaccagggatagttttttctgttgctgcctggtgcacacatctcctctgccttgacttgtctgaagtctttccctctttgaggcagggactgaaggggtggagcccagctgtgcaagtgcaaaggcatgcagccctaagctgagcctaatttgagcccattgagtagtactaattttgactcattatatttttgaaaattcagggcataggttttttgtttgttttttgagacagagtctcactctgctgctcaggctgaagtgcagtggcgtgatctctgctcactgcaacttccgcctccgagatttgagtgattctcttccctcagccccccgagtagctgggattacaggcacgtgccaccacacctagctaatttttatattttagtagagttggggtttcaccatgttgaccaggctggtcttgaactcctgacctcaggtgatgtacctgcctcagcctcccaaagtgctcggattacaagcgtgagccaccgtgcccagcccagggcatagttttaaggcaaacgtagttgtggttttaagaacgccggtttgaggtgcactgagactgagcagggaggggtatttgttactgtggacctggtgatgaggactcccttatgtcttctctgagctagaacttctcttttgaattggcttcatgcttcaaactcatgacctctcttaccttattggttggcaggttttgtgcaatggattttatcagtaaggaactgaatttaaatcttgcaattagataatgtgattacttaaggggactttcactattttaggccgggactccaatcaaataaatcccaggccctgcccaatctatgtgctcaaaattttcgagttttcagttgtgatgggtcaccctctgtatattcttactgtagtacacaatgcaaaatgtatcaagataattaactgatttaggtgttcacagtgctattatggaacattacttcttttagtgtgacacgcattaggctctatcacttgtgtcatgctagcctgattagcacctcttcctagggctgtacgctgactcttattttttttgagacggagtctcgctttgtcactcaggctggagtgcagtggcacaatcttggctcactgcaacctctgcctcctgggctccagcaattctcctgcctctgcctcccgagtagctgggatcacagccaccatgcccggctaatttttgtatttttagtagagacagggtttcaccatgttggccaggctggtcttgaactactgtcctcgagtgatccgcccaccttggcttcccaaagtgctgggattacaggtgtgagttaccgcacccggccccctgactcatttttagagaagaaatgttctgttttctagaagcattttctaacttctcaaggggccaaccgaagtttactttcgttgttcttctgtacgtgtgcctggtttcctaaagccctttgcttgggaacagctcactcagtgaggctgcctggggtgttgcagcctcaggtgttggtggtgtagggttttctgtgcttgcccttctgccacaacttctgcagtttctcatttcctgctctgctccctgggtcccaggtactggtcgctcatttggctttattgcctatgagaggcttgggcaggtggcattgcaacacctctgcctttgtttcttccttcttcccatgagggctgggagaacaggagggagagaaggcagaggggagcacgggtgctgatcgcccattaatttaaacacagagaagggtaactggaaacaggcttcctttctgcccctacaaagcctctttcctcctcttttctgctgcaggcccttaattcctctttcttgcttaggttctatatcttatgggattttttactttaggtatatagggactctctcaaaatgtttctataggctggtctggaaaactaattgctgtttatgatattgtttctatgtgaagctgtcttatgagatccagataaattgcaaacactccttaggaatatgaaccatctgcaagttttggtaagtaaacatatccttcgtttttgggtctttttaagtttgtctgcacttcattttggagtctagagttgtgacatgtagttttaaagatatcagagggcacaaagtgtattctttcctggcattaaatctcatttgccacctccccgcacttctaagatctctacgttttcctttccatgggtgtctttcagaggatcatattttggtctttggataattctgctttcggaatacagcatgtggctggggacttgctttaaagtgctatgcagagttttctccttttagagtgcattatttttcccccttggttgacttcactaaatactgcaaacccaagaagagtcccatggttgcagatctggtattgattatcattaattcttctctttatgactttgccacttaaatacacgtttagaaacaaactaaataaacattaaatggcataactagattttggacttgggtggtccagtgagtttcaacatatgcttagctttgaaaggtggttataaaaacactccatttaactaccccattaaatgattgggatatatttttaaagatttttaaatgtatgagttcagatatttttaaaaagaaagttggaattatttataatttattgtcatacaaattagctgaaaagggaaagtaaattttgcttatatggatgcttagtctctgtgtttcagtttggctggttgattgattggtctctagctgtgtggctttggtgaagtcactcaactctctgagctttggtctcttcagttgtaacagagaatatttcccagttgattcccaggctctgtcccactttggaaatgctagaactctgcaattctgtgaatttaaaagttgatatttaaaataatcatgtgaagcagaaggtatactgtctacttagccatggaagtggggagatggcaagttctggaatgatcaaaaaaggtttaggaatagtgtatgatcctgagccttgtctccaaagtcaatccttttttgttgccctgtttattgaactgtacgtacggttgggacaatagatggggcatctggaaaaaatattaaaaaaaaaaatgtatgggcagagacgatgcctcaggaccttaaatgtgctgtcatacagtgttcagtgatgttgctgttaaatgcagtgctctgtgactcagccctattagaagcattttggatttggcccaatggtgttttggcggtttttggattatgtgttaggagtcagagcgtctagagtaattcttggcattggatcatcatggcggacaggaagcaggactagattgcagctccagacagagcagcttgcggaaacttgcactacgaattttagctgcagatcgactgcaagaaaaaaccagcaatcccgagaggacccacagaccctctgaaggaagtggactgctcctgcaggagtcaggagacaccctaaatactgtgagtgctctaactgtggaagtgggaaagggagaccctcctctcctaaacacacccccgctggagctgaaggtctgtttgtgggagaagtttctgactttacctgcagctgagtcactttagagaactgagtgaaatacaggggtagaggaagcagcagaaaggccctgggagctcactgtatcccttagcaggccattcctgcctggcatcacagagatccattgggagggtgaccagaggagcagcaggtaaaactccacagggagaaggaactctccgagctgaactttgtaacaatttgaacaggaccagaagcctggtcagaacttgggggagggtgcaaaactagtgtgtagacaccacaggcgggggaagaaccaagctttttcttttgcagctgggaggtaggtagcccagggcaagttttcaagcccatcctgccctgcgcctggaaacagactcggggctgtttccagatatcagggcagggggcatgatgggagtgaggctggcccttcactttgtgtgggagctgggtaagacctgtgactgccggctttcccccacattcctgacaacctgcatgactcagcagagggagccatgatcctcctaggtacacaactccagtgacctgggaatctcatccccatccctcacagcagccacagcaagacctgcccaaggagagtctgagcttagacacacctagccctgcccccgcctgatgatccttccctacgcaggttggtagcagaagataaaggacatataagcttgggagttctagggctggtccctctctatgcaactatagctgatactgtctggaaagtgccacctgccagcaggaggccaaccagcaaaaaaacagagcattaaaccaccacagctaaggatccccacggagtccattgcaccctctaccacctccactggaacaggcgctggtatccaccgctgagagacccatagatggttcacatcacaagactctgtgcagacaacccccagtaccagcccagagccaggtagactcgctgggtggctagacccataagagagacaacaatccactgcagtttggctcacatggaaccacatccataggaaaagggggagaatactacatcaagggaacaccccgtgggacaaaagaatctgaacaatagccttcagccctagaccttccctctgacagagcctactcaaatgagaaggaaccagaaagccaaccttggtaatataataaaacaaggctcttcaacaccctcaaaaaaatcacactagttcaccagcaatggatccaaaccaagaagaaatccttaatttacctgaaaaagaattcaggaggttagttattaagctaatcagggaggggctagagaaaggggaagcccagtgcaaggaaatccaaaaaatgatacaagtgaagggagaaatattcaaggaaatagatagcttaaagaaaaaaaaaatcaaaaattcaggaaactttgacacacttttagaaatgtgaaatgctgtggaaagtctcagcaatagaattgaataagtagaagaaagaaattcagagctccaagacaaggtcttcgaattaacccaatctaacaaagacaaagaaaaaagaataagaaaatacgaataaagtctccaagaagtctgggattatgttaaatcactaaacttaagaataatcgatgttcctaaggaagaagagaattctaaaagcttggaaaacatatttaggggaataattgaggaaaacttccccggccttgctagagacctagacatccaaatacaagaagcacaaagaacacctggaaaattcgttgcaaaaagatcattgcctaggcacattgtcatcaggttatctaaaattaagacaaaggaaagaatcttaagagctgtgagacagaagcaccaggtaacctgtaaaggaaaacctatcagattaacagcagatttctcagcagaaaccctacaagctagaagggattggggccccatcttcagcctcctcaaacaaaacaatgaccagccaagaattttgtatccggtgaaacttagcatcatatatgaaggaaagatatagttgttttcagacaaacaaatactgagagaattcgccattaccaagtcacaactaaactgctaaaaggagctctaaatcttgaaacaaatcctggaaacacatcaaaacagaaccgctttaaagcataaatcacacaggacctataaaacaaaaatacatgttaaaaagtaaaaacaaagaacaaaaaagccaagtacacaggcaacaaaaagcacgatgaatgcaagggtaccccacatttcaatactgacattgaatgtaaatgtcctaaatgctccacttaaaaatacagaaccccagaatagataagaactcaccaaccaactttctgctgcctttaggagattcacacaacacataaggactcatacaaacttaaagtaaaggggtgaaaaaaggcatgtcatgcaaatggacaccgaaagtgagcaggggtagctatttttacatcagacaaaacaaattttaaagcaacagcagttaaaagaggcaaagagggacattatataatgataaaaggccttgtccaacaggaaaatatcacaatcctaaacatatatgcacctaatactggagtttccaaatttatgaaacaattactaatagacctaagaatgagatagacagcaacacagtaatagtggggggcttcagtattccactgatagcactagacaagtcatcaagacagaaagtcaacaaagaaagaatggatttaagctataccttggaacaaatgaacttaacagatatttacagaacatttcatctggcaaccgcagaatacacattttattcaacatcgcatgggattttctccaagacagatcatatgataggccacaaaacaagcctaaataaatttaagaaaattgaaactatatcaagcactctctcagaccacagtggaataaaactagaaatcaactccaaaaggaaccttcaaaaccatgcaaatacatggaaattaaataacctgctcctgaatgagcattgggtcaaaaacgaaatcaagatggaaatttaaaaattcttcaaactgaatgacaataatgacacaacctatcgaaacctctgtgatacagcaaaggcggtgctaagaggaaagttcatagccctaagtgccacatcaaaaagattgaaagagtacaaactgacatgctaacgtcacacctcaagcaactagagaaacaagaacaaaccaaacccaaacccagcagaagaaaggaaattaccaagatcagagcagaactaaatgaaactgaaacaaacaaacaaaaaatgcaaaagataaataaaacaaaaagctggttctttgaaaagataaataaaattgatagaacagcaaaattaaccaagaatagagaaaatccaaataactacactaagaaacgaaacaggagatattacaactgacaccactgaaatacaaaagatcattcaaggctactatgaacacctcgacacacataaactagtaaacctaggagagatgggcaaattcctggaaaaatacaaccctcctagcttaaatcaggaagaattagataccctgaacagaccaataacaagcagcgagattgaaatggtaattaaaagattaccaacaaaaaaaaagtccaggaccagacggattcagagcagaattctatcagacattcaaagaagaattggtaccaatccttttgacactattccacaagatagagaaagaaggaaccttccctaattcattttatgaagctaacatcaccctaataccaaaaccaggaaaggtcataatcataaaagaaaactgcagaccgatatccttgatgaacattgatgttaaaattcttaacaaaatactagctaactgaatccaacaacatatcaaaaagataattcaccatgatccaagtgggtttcataccaagggtacagggaaggtttatatatccaagtcaataaatgagatataccacataaacagaattaaaaacaacaatcacatgatcatctcaatagatgcagaaaaagcatttgacaaaatccagcatcctttatgattaaaactcaggccaagcacggtggctcacgcctgtaatcccagcactttgggaggctgaggtgagcagatcaccaggtcaggagttcgagaccagtctggccaacatagtgaaaccccacctctactaaaaagacaaaaaattagccaggtgtgatggcgtgtgcctgtaatcccagctactcaggaggctgaggcaggggaatcgcgtgaactcgggaggcagaggttgcagtgaaccaagattgcaccactgcactccagcctgggcaacagtgcgagattctgtctcaaacaaacaaacaaacaactctcagcaaaatcgctcatacaaaggacataccgtaatgtaatagaagccatcatgacaaaccaatagccagtataatactgaatggggaagagttgaaagcattcactctgagaactggaacaagacaaaaatgcccactctcaccactcctcttcaacataggaagtcctagccagagcaatcagacaagagaaagaaataaagggtatccaaattggtgaagaggaagtcaaactgtcactgtttgctgacgatatgatcatttaccttgaaaaccctaaggactcctctggaaagctcctgaaactgataaaagaattcagcaaggcctggcgtggtggttcacgcctataatcccagcactttgggaggccgaggtgggtggatcacgaggtcaagaggttgagaacatccttgccaacatggtggaacccaaaatgcaaaaattagctgggtgtggtggcgtgcacctgtagtctcagctactcaggaggctgaggcaggagaatcacttgaaccctggaggcaaaggttgcatgagcctaaattgagccactgcacttcagcctggcgacagagtaaggctctgtctaaaaaaaaaaaaaaaaaaaaattcagcaaagtttctggatataagattaatgtacacagatcagtagcaaccaagcagagaatcaaatcaagaactcaaccccttttacaatagctgcaaaaaaaacaaaaaaacaaaaccttaggaatgtacctgaccaaggagttgaaagacctctacaaggaaaactacaaaacactgctgaaagaaatcatacacaatacaaacaaatggaaacacatcccatgctcatggatgggtagaatcaatattgtgaaatgaccgtattgccaaaagcagtctacaaattcaccgcaatctccatcaaaataccaccatcacagaattcttcacagaattagaaaaaacaattgtaaaattcatatggaaccaagtaagagcacgcatagccaaagcaacactaagcaaaaagaacaaatctgggctgggcactcacgcctataatcctagcactttgggaggctgaggcaggtggaacactagaggtgaggagttcaagaccagcctggccaccatggcgaaacccccgtcactactaaaaatacaaaaattaaccgggcatgatggtgggcgcctgtaatcccagctacttaggaagctgaggcaggagaatcgcttgaacccaggaggtggaggttgcagtgatcagagatcgcaccactgtactccagcctgggtggcagagtgaaactccatctcaaaaacaaaaaacaaataacaaaacaaaaaacaagaacaaatttggaggcatcacgctacctgatttcaaactatactataaggccatagtcactaaaacaacaacatggtactggtataaaaataggcacatagaccaatggaagaaaatagagaacccagaaataaacacaaatacttacagccaactgatctttgacaaagcaaacaaaaacataaagtggggaaaggacacccttttcaacaaatggtgctggcataattgactagccacatgcaggagaaggaactggattctcatctctcaccctacacaaaaatcagctcaagatggatcaagaacttaaacctaagatctgaaactacagaaattctagaagataacactggaaaaacccttctagatgttggcttaggcaaggatttcatgaccaagaacccaaaagcaaatgcaataaagacaaagataaatagctgggacctaattaaactaaagagcttttgcatggcaaaaggaacagtcagcagagtaaacagacaacccacaaagtgggagaaaatcttcacaatctgtacatctgacaaaaaacctaatatctagaatctacaatgaactcaaatcggtaagaagaaaacaaacaataccataaaaaagtgggctaaggacatgaatagacaagtctcaaaagaagatgtacaaatggccaacaaacatatgaaaaaatgctaaaagtccctaatgatcagggaaatgcaaatcaaaatcacaatgtgataccatcttactcctgcaagaatggacataatcaaaaaaataaaaaaaacagtatagatgttggtgtggatgcggtgaacagggaacatttctacattgctggtgagaatgtaaacaaatacagccactatggaaaacagtgtgaagattccttaaataactaaaagtagagctaccattagatccagcaatcccactactgggtatctaccaagaggaaaagaagtcactattcgaaaaagatacttgcacacgaatgtttctaatggcagaattcataatagcaaaatcatggaaccaacccaaatgcccatcaatcaatgagtggataaagaaactgtggtatatatatacaatggaatgctatgtagcatttgcagtgacctggatgagattggagactattattccaagggaagtaactcaggaatggaaaaccaaacatcgtctgttctcactgatacgtgggcgttaaactatgaggacgtaaaggcataaaaatgatacaaaggactttggggaattggggggaagagtgggaggagggtgagagataaaagactaaaaatatggtgcaatgtatactgcttgggtgatatgtgcaccaaaatctcacaaatcaccactaaagaacttactcatgtaaccaaatactacctgtaccccattaacttatggaaaaaaaaatagagtaattatttcactcctgtaagttgacattttgcatgtaactccccaggagggagagagagtacttttccttttcatttttgtttcttttatgtcttttcatgatcgtctttgttctctttctctatgatccattctatcttttttttgttgtttttcaagatggagtcttgctctgttgtccaggctgaagtgcaatggtgcaatctcggctcactgcaacctctgcctcctaggttcaagcaattcttctgcctcagcctcccaagtagctgggattataggtgtccaccaccatgtccagctaattttttgtattattattattttttaaaatttcttcaagagatggagttttgctcttgttgcccaggctggagtgcaatggcatgatcttggctcactgcaacctccacttcctgggttcaagcgattctcctgcctcagcctccccagtagctgggataataggtatgcgccaccacacctggctaattttctatttttagaaaagatggagtttctccatgtgggtcaggctgcttttgaactcttgacctcaggtgatccacccacctcggcctcccaaaatgctgggattacaataggtggagccaccacgcctgaccattttcatatttttagtagagacagggtttcaccatgttggccaggctggtctcgaactcctggcctgaagttatctgctcgaaatcccaaagtgctgggattacaggtgtaagccactatgcccgaccaatccattgtattttgtgatccatttccccacagcaaagagttttttgggggtgattagttgtcctaggttacttccattgagggttcttaactggtttccttgagtaagaattagagattaggtggtgatctcatgaaaccactgtagagggggtggttatacagagaacaaatatattaaatgttaaagaaacttggcacttgaacttaagtgttctcaaaatcagaccttgactgttatttaagtctggttcctgcaagcagagcctggggcaagccatttggacttgtcacagaggtagcctttgggcagatgctaatggcacatgaagaaagagtgaccacagtgttttatgtaggttcctttgatcattcttaactggtttttaatattataccaacatttaatcagaaaccaacatagttctcagtactctaactctgggaatcatctctatatcccagccccaaaacctacagtggaagattggctgttttgtcaatatctcatgtaagaaactcttcctttgagaaaaactatagcagtgaggacttaggatttcttcgtgtttatcccagaatgctgagggaattcaggaatcatatctttcagtatctcagaaccctacacagtgcccgtctttttagtgtggtttttcagttggattgcgtttctgaggcccctgtaggaatcttcctttggaatctttataaaccagatagaatctaattggtgagagaagccagagaatccaataaaccttgtcccttctctcttactgtactatatccatctatacctattttttaggtttaagttgttttaaactctaaaggtagagtaaacattaaattgtatgttttactgttcacatttagcaatggtaaattgctaagagaattaaaaaaataagaaaccctacctttcagtaataggctggtgaagtatcattaaatccttagaaatcaaaaagaaatgggcaaaattcaagatattgtgagtaccttgttaggataatcgtggtagagacttctgtctgcctatatctatcccgattttctttcttttttcttttttctttttttttttttgagacagagtctcgctctgtctcccagtctatagtgcggtagcaccgtcttggctcactgcagcctctgcctccaaggttcaagtgattctcctgcctcagcctccctagtagctgggatcacaggcacgcgccacgaagactggctaatttttttgtatttttagtagagacagggtttcactgtgttggccaggctggtctcgaactcttggcctcaagtgatccacccgccttggcctcccaaagttttgggattacaggtgtgagccacatacccagccctgattgtttctttgtggatggttgggctgtttaagaaacatggatttttttttttactgtctccacttagaattttgttgttcaggtctttttctatgagttccatagcaatattttggccatgattcttgcttggacttgatatttttaggcttcgtgaggatttatcattctatcgtctaggcatcctgccttctgatcattctccttgttgcttccatgctggaagtgatgctagaggcacaggtctgtgcaattacttctacaccgtaggtacctggggtgcttaatggcagagactgtatttgtcagttggtggtttagacaagttacaggtaaaacactatgaaagcctctgtctagattcttatctctctttctctagcagaatcaaacagacagaaatgaagttgaatgctgggaagtctttgtttaaaaaagtggttgctgttgtctagaatcacagagacactcagaaggaattgggactggatgtggaggaaagacatcataaaactttacattgaaagccaaagatgtgaagttaggcctagtcaagtgttaattctgaaagatcaaaacacatcatcctggactgtgaaggtgtgccttctgtaagttaaatggaatgagatcttcttcagtgcacctgatgtcttgggaagggtgagttgaggcgtggtggatgtgaaacatgatctcattataaatgttcccatttgttttatgtgttcagtttgttttgtgctatctagataggaaatctaaaggctgagaaaatgtctgctgtagacatggcagtgattctttgatactaaatagttggaggggagccgagtgattgcgtgacttatttttagacaatatagggactcccttgcaaagggaggagttgggaagaatagacgtgttaggaaccaggttagcctggagatttctctggttacctgaagctggaaaaatattggaagaagaaattattcaatgagaactcatgcagacctgagtctccagttatgcctaagtggccatgtcagatctgtgaacctctctgctggcttcttaacaaacccatatttttacaaggaagatgatctgggttagaggaattattaattatatttcagctcacaaattcctctttactatcacccctttagccccatgtaaactctgttagggtttggttaagtgtagaaactgatatgtaagcaagagtaagaagatgaagtcacttatctggaaatttctttaaacctttaattattgtaaacaaaagatctggtctctttggagctggtagtaatgtcttagttttgtggctgttagttttttgactctatcagactgagtcattgttttatttgaagatctagaataacatcatctacaaagaaatgattacagtaattgatcttgatactgcctcctcctagttgtatttatataattatctaaaagggtttttaatagaattactgcaacaagcctgaaaaagtctgtgctaagtggtaacaccttgaaacaggatcaatatgatcccgccttcaaggggcttttggatttgtctagcctactatatggctgagtactagactcagttatcccattcctcagcaaaagaaactacagaagtttgagggaatatcagactcttggcacacaattgacatttagtaaacacttgataggcagttggtagtgggtggcagcattcacagatgaattctgaagtagatggtgaatgatgctgagattttctttaccagtcctggtgacactgcctgagctcacatgataagatcctggtagagtagcatttattcttcttttgcagactcagctaagaggactttgcagttgaggctgaatcttgatccatgtagtccattcccgatggtgctatttagaaggccttttgttgtctgagcaaagttgtcttcctggccttactactgaatcttggcaaaggatcaatgggtaagccccatcctccaaagatctcatataacataactggtatcaggacactgattacatgcaagcagttcccacatgaagagctttaaaattgagatttttctttgaaatttaaaagaaggtggaataaaaatgtgcttgctttccaacatagatcgattagctggcacggagagaacaccggcctttgaaatctataggcatcctgttgcaggcctgacccagctgaccctgggagattagtaatggtctgtgcagcctgctctgtcagcaagtctggcagggtgtgcacagatggtgccagttggagaaaatcactgccgaacagtgcactaaagcctctgccttggccattctgccttggaggaggagccgagagtgagactgggtggtttacagacgtgttcctgccaaatgccttggaagagacctcagaggataccagtccgggtttaggatgcatttgctgattattacttaagtaatgttttcttgtcatagcttaggccttcctgagttgttgggcatctgggatttttacagggtctgtggccttggggttgttctgaaagggaatttgaaatgagaactgatctcattccaaggagtcaagcataatgcaatacttgttttcctagagtcaatcagcctagggaaaatgcgagtaggctggaagcggggaggaggaggagtctgagagtttgagtaatcaacttaacccaggggtaaaaagaattttattatagaaagcagcacacatgacctctgtccttccagctgccaccagtttctgggttgtcgagtgataccctgaaagtttacagtcaacactccttgtgtggggtcagtcctagaaatggcgacgctgctctccgaagataggaaagaaaaggacctcattccattgagccattgaccgaaatattttctcaacaaagttgaactgagctgaaactgtaagcctgttcttcctaattagacattttattctttgaaaattctacttggagttgcgttgaaaagtcaaagttgaggaaatgcatctttctaaaatacttccctctgagctgtatttcaacaggttgaggacaggctgaaaaaatattaatgttgaatgaaagatgtgagggtgtctgggtgtctgtaattacagagggtaactgaatcagtgagtggacttttcccattcccaacttttttggtattcttcctgccacaactttgtcttttaagtctccatccaggttagttctggctttgtagttcgttactgtttaacagacttgtttgattccttttgtgttgttttatgaactgtggtgttgtttcactctggaagaattttccttggagatgctgctgctgtgaaatgagaacttctcttttgggtttttgaatgaccacccccacccaaagatacaaagaaacctatcgtgttcagtgcactctagtgcttttgaaattggtgtatgggagcatgctctggagggagagctgagagaatgaacagggcatttgccaacctcacacagtgagtgcagactgacacatacagcaatacttgctggaatctggaagagagagatagaaagcacacttaaatcagacagaagtgtaacttttcttgtttaatagagcatagctcaggcatgatagctttattgacaagatgggaggccgaagaaaggagagaagtcaaggatgactcaaagtatgagttaggagaaagcagtgggtactgaaatactttggcaagaggaagatgaggagttcagttttaagtagtttgtttttgaaatgtccattaggtctttggatatctgggtctgggtttgatcagagaggtctgggatggagatagtaatttcagagttgctgacacacagctggtgatgaagccacaagagtgaataaggtagcacagagaacgaagagaaatgggagtggatgaaatttggtatagaactaaaagcacactgtgatttctctcccgcgctggtatttgaacaatgacatgtatttgcctagagaagacaaataacaaaaatgactgggtgattgtgtgtggatcacgcttgttatatctttgatagggaaattcaaaacggtctgtggaagtgtagaaataaattcttgaaaatgaccctgaagtagatttttggagtgctttggtccgtttcacagatgctttaccatttgaagtagatgccaaaacaaacgagaagatagatagctcagggtttgtagtacatgaagccagcatctgctagtttatttagtagcaggagcaggaagagcagagggagaagagtgcagcagccgccaagaataaaacctggtcaagaggccacatcagcccagcttggcagacgggcctggtggctttggtaattatactggtgcctgctgtatgtgggccttttccactgagtttaaaaaaggctttcctctaactaccaggtctcccagcagttgggccacttttgccctcggtggtttttccctgtggaatatttgccgtgtctgtgctccgtggctgtgtttgctgactccagggtaatacccttggccctgctgtttcatgtggctcctgcccgtctccccctcctgacttagctcatagaaggtttgtgaggacatgcccttcgggaagagcccaggagaaaccacatgactgcatggctagaccagcacacgtggacttgaccaaagccttgtctttttccttctctccacctccctccctttttaatctattagtacttttgacataaataatatgtaactgactcagatctacagaaatatcatggcaaggcacatacctagtgatgagggcccattagcactgagacttcctttgggttaataatttcattatggatagaactcccttttgatactcacctttttttttaatttttattttttgagatggagttttgctcttgttgttcaggctggagtgcaatggcgcaatcttggctcactgcaacttccgcctcctgggttcaagcgattcttctgcctcagcctcccaagtagctaggattgcaggcatgcaccaccacgcccagctaattttttgtatttactagagacaggatttcccatgttggtcatgctggtctcgaactcctgacctcaggtaatccacccgacttggcctcccaaagtattgggattataggcgtgagtcattgcgcccggccttgacacccacatttgccaccaattctattttaagtatgctaactctgataatgacataggaagaaaacatactttaaaactgtagggaaatcaatcccaaaaagaattccatgctttttcctttgtgtacttccactatctatagtcccagagtacatctccaagaggcatttttgtttctatccacattgggggtattgctcgtatcactttatgggagaagaaatccataggtaccagttaataatgcattttgggcctcttgttatttgtattattcttcagaaggtgtcatagagtacattgagaccagggtatcctgaatatgtgcagttggaaacacttctggcatttgttgaagtttttgttgttgttttaagactccattctgctattcttaagtttgttttctctttttgctcccatcagtgttttcttttctttttaaaaatattcatccacagtctcctttatataaatatcagacagtaataaatagttaggtttagtctttcttttcttccccctgcctatcacgtactaagtactgtactgccttctggaaatggtctctgtcttcaaggaacttaagtgtccagcggtggtggttgcagggggttggtgggggtgggtggacataaataggtgcttttagtacagtatgatatgggctatgggggtataactaagccatttttgtcagggactgaaatcaggggccacttttgagaaaatgctctggccggatcttaaggaatgacctggagttaatcttttttttttttttttttttttttgagatggagtctcattctgttgcccaggctggagtgcagtggtgcgatctcggctcactgcaagctccacctcctgggttcacgccattcttctgcctcagcctcccaagtagctggaactacaggtgcctgccgcccacctgcccagctaattttttgtatttttagtagaaacagggtttcaccgtgttagccaggatggagttaatcttatctaggaagtagggcttgtttcctagccagaggggtgatctgggacttgaccatcatggggtagggcgatagctacaatagtttggtattggtgggttaaagggggtaggggtcaagtgctggaagacaaggctgcagagcaaagccaagatcaggtcttagactaagggtcatgtatgtagctggcgatgtgtattctatagtagactacttttccagctatgtggaggctggatggaattgggtaatgggaagagatgtgcagtagggaatccagttgagtggttattgccaaatggatgaaagatgagggtctgctgggcgtggtggctcacacctgtcatcccagcactttgggaagccgaggcaagtggatcacctgaggtcaggagttcgagaccagcctgaccaacatggcaaaaccccatctctgctaaattagccgggcgtggtggcacatgcctgtaatcccagctacttgggaggctgaggcaggagaattgcttgaactcaggaggcagaggttgcagtgagccaaggtcacgccattgcactccagcctgggcaacagagtgagatcccgtttaaaaaaaaaagaatctgggcgcctgtaatcccagcactttgggaggccaaggcgggtggatcacctgaggtcgggagttcgagaccagcctgaccaacatggagaaaccctgtctctactgaaaacacattagctgggcatggtggcggtcgcctgtaatcccagctacttgggaagctgaggcaggagaatcgcttgaacccaagaggcggaggttgcggtgagccaagattgtgccattgcactccagcctgggcaacaagagcgaaaactccatctttaaaaaaaaaaaaaaaaaaaagatgagggtctgaatggaggcaggtgtaggcactggggatagtcaggaggagacagatatgaggaatatttggagattaattcacaggacttcgtaacggttgtgatgtggtagttatggtgtgatgtgcgtagggggtggtagcaggtgagggatggggctcttaattttctagctgaaatgattggatagacgttaccagctaggattggaaacaagggaggaagaggggttaggaggtagggataccaattgcaagtttgttctattaacacatttcttaaacatttcttcaacttttaaactgcacctacggtcatgttttacttcttcctcataaaagttaaggtggccgggcgtggtggtgctcacacctgtaatcccagcactttgggaggccaaggtgggtggatcacttgatgtcaggagttcgagaccagcacggccaacatggagaaaccccatctctactaaaaatgcaaaaaatcagctggacatggtggggtgagcctgtagttccagctactcaggaggctgaggcaggagaatcgcatgaacctgggaggcagcggttgcagtgagccaagatcacaccattgcactccagcctgggtgacagagcaagactctgtctcaaacaaacaaacaaacaaacaaacaaacaaaaaaaccagttaagtatatgttcaggctaggcagtagctattttgaaaactcaggactaaaggaattcctgggagtatgtataggatgattagagttgcagtttccattgtcatgcagtagaacatcttgcgggggtaggtacacaatggtgagccatcagcaggcaacattgccagcagctggaggaataagggtcttggtcctgaatggttatccggatggtggacaaccgctgcctctacacatggcctgcaagaccttatatagcctgccttcttatgctaccacctctgggatctcattcctactgtttttcccttccctttgcttactttgctgtacccacattgtctttttttgcaaatgttgtttgaacatgtccaagcaaacatgctttagtttcaggcttctgtacttgctatctgattgactggccatttccttcctttctgttcaaatgccacctttaataaaggcctcactgagtgatttaatatagcacaccctgccttcaaactctctctatccctttatcctgcttttcttcatgaaacgcatccctctgacgttgcataaacatttagttgggtttttgcctatgttgctggtgggaatgtgaactctgggagggtagggactgcacgccattagtgtattatttgattgtgtatcttcaggggttttgaaagttgttcttggagaagatatcctgtaaagttgtgctttgctttagaaaaagttaacatagaaagattttattttatttttattttgagacagagtctcgctttgttgcccaggccggaatgcagtggtgtgatctcagctcactgcaacctccacctcctgggttcaagtgattctcatgcttcagcctctccagtagctgggattacaggcatgtgccaccatgcctggctaatttttgtatttttagtagagatgcagttttgccatgttggccaagctggtcttgaactcctggcttcaagtgtgccgcctgcaatggcctcccaaagtgctgggattacaggcatgagccactgcacccggcccaaagatttaagattgctagtgaatggccgggcatagtggctcacacctgtaatcccagcactttgggaggccgaggcgggtggatcacgaggtcaggagatcaagaccatcctggctaacacggtgaaaccccatctttactaaaaatacaaaaaattaactgggcgtggtggcgggcgcttatagtctcagctacacgggaggctgaggcaggaaaatggcgtgaacccgggaggtggaggttgcagtgagcctagagagcctagatcgtgccactgcactccagcctgggtgacagagtgaagctgcaactcttaaaaaaaaaaaaaaaagattgccagtaaaatataaacaaaggtagtagttgatattatgtattgcttattgtgggactcttagactggtgacttcacccagagcattttacatgtaacgagatttacaacaaagaccttctatgtacccctgttttcagcactgcatctattgtggaaaataatgtaaatgaattgcaccttctaagggtgtgctggtttgtcattacaatatactcttatcattggacaaacttcaattgaaataaatatgtatttatctgaaggcagaaattatgctattatcattaataattcagaagagttttcagttaagcattaacaacatcattgcctttggctgtgatctgactgcttgaactcatagtagtatcaaattatttttctcaatgaagacaaaattaaactccagataaccagaactcagaaatctcaactctttaatcagcatatgctcctttgagcatgtatcttataagaaagagatatataattgtaaaacatattaaggatttaacatttttgaagtgtcttttcctggagatatcctgggatctgtatccatttggcccagtgtcctatgacaacctcatctatagaacattaaagattctggttccaaacatgaccctgcacaatttgaaaatcccttgtcatcaaagaaagattaaattatgttcattacgtgaaaacatggactaattaatgtatatcctaaagacgtcagcgataactatagaaaggcttcctttcattgggtgggagatttaattggctgatctatgctgtccctgctaatgctgagattctctgattccctcacctcttaccgcactcagaaggctcaaagtataaatgggtttctggttaacctttagtgaatcagtaatttgatttatcaaaacacctcattcagtctaggagtctaataatatgtttagcgcatgtgcttttgtcagaagaatcttcataaaacatagtgatcgtagacaagagaatgcgtctttttgatttcctagaccaatagtggatgcttctctacattgcaagtcagcatagtgtgattctttaggctcccagtggtgttgaagttacttttgttacttgtcatgcttcctttattgcgtatgtgtgtgtgtttgtgtgtgtgtgtgcgtgtgtgtgtgtaaaaagcaataacagtggtgttacttttggagatttttatctacatgtattttttactctattaattttgcagtggaagtaatgtgtttccatctaatatacatcttgtaggccagtatcactctcagcacttcacattcacccctaattttttttgttaaaggcatgtttccacctcagacactaattattaaaatcgcatgatttgccagataaacacaaccaagtagtgtcatttgagcaacaaatcaatgagcaaatattgattcaacacacattccacatgagtatgacaccatctgcggttctgtacatgatttatacaggaagacacagagtgtctctgcctttaaatggctcaaagtcaaattagtggtagactatggagaaaacgcagaaaatcttaatgaaaactcttaaaccaattttcaacagctgctaacacagcagtgtggtcattcattgagtatctgctgagtgccctgctacaagttggaaggcgtgctgagggctggggttgcacagggatgtgacacagtcctggtcctctgggagtttaccgaatggagtttaccatctttgaccgtacagttagtaagatgaaatgatcaccttcagtaatccataagtgtgaatacagtaattatgttgattactcctaggtaaattgtctggaaggtctaatatctgttatagaaagagtagtcttcattgctagttactggtgaatttgcttgtggatctctaaattgtggggtgtgtgtatgagagagagagagtgagagagagagagagaagagagaatgtctgtagtaaatcatgttggatttgggagttctatatatttccaattctattttcagcctgtatcttttcttgtagatggtataatgcagttagaaagagcatgactgctgactttggagttcatagttctagttttaagtttgactttgcaacttaccaactgcatgcaattaggcaaataacataagctccatgagcctccacttatgcatctataaagaaaacacaataagaaaccctaacctatctatgtcatctgttatgtgagggctcaaatgagacaataaaaataaaatgaggggccgggtgcggtggctgacacgcctgtaatcccagcactttgggaggctgaggcgggcggatcctgaggtcaggagatcaagaccatcctggctaacatggtaaaacaccatctctactgaaaatacaaaaacaaaattagccgggcgtggtggcgggcgcctgtagtcccagctactcaggaggctgaggcaggagaatggcgtggacccaggagtcagagcttgcagtgagccgagattgtgctgctgcactgcaccctgggtgacggagtgagactgtgtctcaaaaaataaaaataaaataaaataaaatgagggccgggtgcaatggctcatgcctataatcccagcacttttggaggccaaggcagggcagatcacttcaggccaggagttcgagaccagcctgggcaacatagtgaaaccccgtctctactaaaaatacaaaaattaggtgggtgtggttgtgggtgcctgtaatcccaggtactcaggaggctgaggcatgagaattgcttgaacccgggaagtggaggttgcagtgagccgagaacgcaccactgcacttcagcctgggcaacagagcgagattttgtctcaaaataaataagtaaataaataaataaataaataaataagtgaaatgaaaggatttagaaaattagaaatactctatggaaatagtaatgggtggtggtgaaagactggttctcattaaatacctcttctatgaaagaggtgttttcatgaaacatggttttcagtttttgaagataattttggttgcatccaagggcaagttatagtttgtgggcctaatagtagtatgatggaaatttaaggactctggctcatgtccttgaacatttatcattgataaagggaaatccatgtgtcaagtgataattctaggattctaaatttcacttgcaaaccaggcttagacttaactttcgcaatgtgaaagaattatgtaaaagctggccatgtgcgtgttttgtttttgtttcactgagtaaagtttccgatctatcaagaagatgttggcgctctaatgttcattcatttatgtaaacactgcttcaatgtaagcttatgtttatgctgccgtatgttttgttcacgggtgtaaccccagtgcctagagcagggcctggtcacgaacagatgctcaatggatttttcttaaattaatgaccgtgttgagggactgttgtgttttaggcactctgcaaggcatttggaaatattgggaaagtagagtaaagatgtgtgacctgaagaacctcaaaatcgagcagggagaaagaaaaataaacagcaaatgacaactgtttaacaagtgaggagttatggggacctggatgtggggaaggtttgcagtcaggaagatttcatggaggcgatggtgacaattatgttccatgtaatctgttcttcttcgaagggcattgggggcggtgggagtgcttagctctctttacaggcaatgagagagttcactgtctgtaggaaatttaggaacaatagaccccgcatggtggctcatgcctgtaatcccagcactttcggaagccgaggtgggtggatgacgaagtcagcctgaccaacatagtgaaaccctgtctctactaaaaatacaaaaattagccgggaatgatggtccatgcctgtagtcccagctactgaggaggctgaggcaggagaatcacttgaaccctggaggcagagtttgcagtgagcctgagattgggctccagcctgggtgacagagcgaaactcagtctcaaaaaaaaaaaacaataataaaattgactattaaagtcagtctgtgcttttattatccctatgcaggggataattctgaagtaagactgtgataaaacactcgtggctgggtgtggtggctcacgcctgtaattccagcactttgggaggccgaggtgggcggatcacctgaggtaaggcaagaccagcctggccaacatggtgaaaccccatctctactaaaaatacaaaaattagccgggtgtgggggcaggtgcctgtcatcccagctactcgggaggctgaggcaggagaatcacttgaacccgggatgcagaggttgcagtgagctgagatcgcgcgattgcactctggcgacaagagcgagacttgtctcaaaaaacaaaacaaaacaaacaaaacaaaaaaaaaccacactcctttctccagtccctttcagatacttgaactccagagacaatcgtctctttgaaggtagagccttcctaggcacagtggctcatgcctgtaatctcagcactttgggaggctgaggtgggtgaatcagaaggtcaggagtttgagaccagcctggccaatatagtgaaactttatctctactaaaagtacagaaaattaggctgggcgtggtggcgggtgcctgtaatcccagcactttgggaggctgaggcaggcagatcacttgaggtcaggagttcacgaccagcctggccaacatggtgaaactctgtctttaaaaataaataaaaaataaaaaattagccaggtgtagtggcaggtggctgtaatcccagctactcaggaggctgaggcaggagaattgcttgaacccaggaggcggaggcaggagtgagctgagatggcgccactgcactccagcctgggcaacagagtgagactctgtctcaaaaaaaaaaaaaaaaaaggccgagtgcagtggctcatacctgtaatcccagcactttgggaggccgaggtgggtggatcatctgaggtcaggagttcaagactagcctgaccaacatggagaaaccccatctctactaaaatacaaaattagccgggcgtggtggcgcatgcctgtaatcctaagtactcgggagactgaggcaggagaattgcttgaaccccggaggtggaggttgcggtgagctgagatcatgccactgcactctagcctgggcaacaagagcaaaactccgtctcaaaaaaaaaaaaaaaagaaagtagagccttctggcttggtaataattttacagatgtgttgtattaaacaaaacaaaacactgaaaaaaaccttaactgtgaatacacatacgatccaagataaccccaggaaaaaagaaaatatgttttctctaactcttagaagtttagaaaagcttttcttttctcattctttcaaagcaagatgatctttttaaaaatctgctgcatcttaaaattgataccttcttgggtcagcctcatgtactatcacacttctattatcaaagaatgacctttcatttgttgaaagataatttttatgaaaaattgatgttgaattccaccatgtgccttttcaaagtcctagcttgatctaccaggggattattgttatatagtacttttattcctagacttaaacaaaacaaaaacctttcttgtaccagccaactgtgtcccaaaattcataactcagtactcatcattctctgttgaaattttatcttttcagtgttgtgcaatattttggatgttgtccatattataggctagtcaggatctgccaccttgctatttttcaggtatgtagaaggaggtggaaaattagtctcaatatctaaatcaaacaaaaaatccgtttatgaaagttctgaattccttaggataaatttttgttctttgaaggctatgacttatcaaatggtacctaatgctgtgtggatagccgtgcccgccaaagtagcttatttacccggcaggattgagaccactgatttttgtagagtaagtcataacagcctattaacattccgttatgctgagcatagaactaataggagaacatctgtgaggtcagagatcagaagtagacttcagaatgtactattcaaaaaaggatgcaatggagaacatttacagaggactgtgggtaaagcaaagtcttcaagggaagataacaaaggatgaaacaatggtgttgtgtgacttcctagtgagtgagatactgtgaatttaatctatagctaacttaatttactcttcatcaaaatttagctgactccaacatgcatacaccttttgagcttcctctaattttctgttattagggttttacatatttagctcaactaattgaattagaagatgcaggaacattgtcggaatgtttgaatctcatttaatgcttcatattgggacagacgaggcactccgaaggcagaaaggccagttgggacacaactgctggggaggggcaggaggctgtggccattcctataagacagttcagggggccgttccaagccagggagacctggcagggatctgagaaatacacaataagtgaaatggaacaatttttctactgttttagctattatctagaacccatgttagacccttaactggccttggcgtgaacttgacatttgaatcatttgggagctttaggcagtaaaaactggaagaatatacctggaaaagcaggtttgaatgcgaggattaagttatattaagattaaattggggccgattgcagtggctcacacctgtaatctcagcactttgggaggtggaggtgggtggatcccttgaggtcaggagttcgagaccaacctaaacaacgtggcgaaaccccgtctctactaaaaatacaaaaattagccaggcatgttggtgtatgcctgtaagcccagctacttgggaggctgaggcaggagaatcactcgaacccgggaggcggaggttgcagtgggccaagatgaggccattgcgctccagcctaggcaacaagagtgaggtttacattgtggtaggcattgagaggtgtaaagtaaataaaatagaaccctcactttcaagtgacagctctagagagcctatatcccgaaggctctagaacctgcaaacttcaaaagaaccccggcaatgtgtgaaataagtttaaagtaaatattacttaattgctcattcagtcatcgaatagccattgtttgggtggaaattggggaagaaaatgtgttgcttaagaacacgataaggaaggagtggtcagacaagtagaaggattgctgggaagaatcgtgtccagaaaacagagggaagagataatttccagaaggaaagggtgggtcaactgtatcacatgccacagagaagccaagtgaagataagcttacaaaagtgagtagtggtgatacggaggtaattggtgacctttaggagaactgattagtgggagtggtatgggggaaagcctgtttgcaggaagttaaggagtgaagccgactcttataagactctttagaaagagaaggggcgtgtatgagataaaggagggtgaaatatgggacaaattccctcagtttgtaattgtgtgattttgcaaaacttatttacttactctgtgcctcagtttccttgtctgtaaaacaatagatgatactagtagctcttatttgagagaagcaaatgagtcaacaccattatacgcagtagattcttattagattgatatcttaaaagaagtccagtaaaaatgcaattgtaatgtaaagagcaattccagtttatgggtttgaaagtatttctcttttttatgtatttttaattatgattaaaaaacaatgtgaaacttactgtctttactatttctaagtacactattcagcagtgttaagtatatcacatcatcgtgcagccaatctccataacctttcatcttgcaaaactgaaattctatatccactaaccaacagctcaccatttcccgctccccgcagctcctggcaaccaccatgctcctggcaaccaccatgctcctttctgtctctgagtttcagtactctggatactccatgtgatggaatcacaccctatttgtttttgtgtaactggcttatttcacttaacatgatgtcttccaagttcatccatgttgtagcctgcatcagacttcttttctttttaaaggctgaataatattccattgtatgtatatgtcacattgtgtttttccatttatccaatgatggacatttaggcagcttccaccttttggctattgtgactaacgctctgtgaggaagggtgtataaataactatttctcttttttaaactagtgatgtttactcttctgcatgtgtgtgagtcatggctggtttaaggccagcacaagaatggatcatgcaggggaggtggaagctctcaggagaaatctacaagaccacaggttggagacagagctcagagacagaaaagcatttttcctttagaacatagaagtaccattcacaagagtactgtgctcctggcggtattttccaacagagaagggaaagtcctgtcttcagttcgtttttaaacttaagctgctagaggacctcaggtgtgtctctcattgtgttgggatgtcaaaacattttgctttactgtgcaatttatttttccttgtattgtatagagcagtgataatgaggggcaggaagcctctagatagctgaagagcccattacagaagtcctactgtgagttaactgcaaaggttagatgaatctaggagctgagagtgggccccatcccctgctgtgggtggttaattcctggtggttttcggcatttgtcctatttaattattgttccttttccgagtaagaaatgacatcaggctgggtgtcatggctcacacctgtaatcccagcactttgggaggccgaggtggacggatcacctgaggtcgggagttcgagaccagcctggccagcatggtgaaagcccatctctactaaaaatagaaaaattagctgggcgtggtggcaggtgcctgtaatcccagctacttgggaagctgaggcaggagaatcgcttgaaccagggaggcagaggttgcagtgagccgagattgcgccactgcactctagcctggtgatagagtgagactctgtctcccaaaaaaaaaaaaaaaaaaaaaagaaaaaaaagtagaacagtattacccagtagagttgatgttccagaagtttcttcagaccagagcagagttcataacttacctgtaagggagcatggtaatgtcacagtttactcttcaactctcttaaggtttatttttattctttttcttgagacaaagtctcgccctgttgccaggctggagtgcagtggcacgatctcggctcactgcaacctccgcctcccaggttccagcgattctcctgcctcagcctcctgagtagctgggattacaggctcgtgccaccacacccagctaatttttgtatttttagtagagacgggatttcaccatgttggccaggatggtctcgatctcttgacctcgtgatccgcctgccttggcctcccaaagtgctgggattacaggcgtgagcaccgcgcccagcctcaaggtttatttttatgtttctaaagacagagtctctctgttgcccaggctggagtgctgtggcacaatcgtagctcactgcagccccaaattcctgggtccaaggggtcatcccgcctcagcttcctcagtagctgggaccacagttgcatgccactgagcccagctaatttatttttatttttagtagagatgaggtctcactatgtagcccaggctggtcttgaactcctggcctcaagtgatcctcctgcttcagccccccaaagtgctgggattataggcatgagccattgtgcccagcttctcttaaggttttatgaacaaattagctttgatttctcctaggtggcttgatgttgaataagctaatgcagaactgtgtgcaaagtagactgggactgccatttctagatgaaaagaaaggagggggaaaggagaatacatttttacagccacctttttctatggcctacttaatgatcataatggcttccaccccccggaactagatgctagtcttatggccccctctctcattcaaatgttttgggaacacctccgatgttctgctgcttccaccctggagtctcagggtcacctcccactctttcagatccccttccctggttgtcttcggccctatgcctcatcccaactcctttgaacttttgttttacccagttgctggttcctttagatgcacgaacagtgacagtctgctgagttatgtgaatgatgttgggtattactgccaccagcagttctaaagctccccctcttcacattctttgtcccagaaggggctctcaatgctgaaggtaaatcgcttcgtgtgagaatgcgggcctcttgtttgggagagtctgcttggcctctgaatacagaagcataaacttcaggacattacttaggccattacttgaggacattacttagggaagtatttttttgtcttggtaggtttttaaatgttggtttaaaaacctaaatagaagtgactttttcagaataataacttgtgaggaacaactggtcctggtggataaagcctagactcagaatcaatagaccaggattgtttttctccttgttcaaatatctgtgtggtctctgaagtaaacagagcaacactttccctaaatgtaaatattttcggcagatggggatttttaaaagcttgtggctcgcctggacaaaggatttttaattattctttctgaaattttatgaaagaatgggagaaaagaataagaaaaaaaaaaaatccggagcaattagaaagaagaagatcccagtgattataggcaggggaaggggacgttgagggctggcaggtacccagggcatggagggagagaagacagaattccagacaagaccaggaagcaagactttgcttctccagccagtgtatgttggttttacttgactggcagtgcagattatgaaaaaacaaacctagatatactggaaactagatcccagccttttcttgtttttttctttctttttttatttttatttttattttgagacagagtttccctcttgttgcccaggctggagtacagtagcgcagtctcggctcacctcaacccctgcctcctgggttcaagtgattctcctgcctcagccttcctagtagctgagattacagggatgcaccaccatgcctggctaattgtgtatttttagtagagatggggtttctccatgttggtcaggctggtctcgaactcttggcctcccaaagtgctgggatgacaggcgtgagccaccgcacctggcaatcccaacattttctacttcaaaatggtctaaagttctgtctggtctggtaggttttccctggacttttatctcttgtttcctccatcttcccactgcctttggtggcccagttcacactcattacaaacttttctccctaaatagaacttttcctctgcttccctctcctaccatggtttacctgttcaattgattatgtactttgagcattgaccaatagattcctgtatgaagtaaatttattctaaaggtttaatagctaggtattttatcaaggggctttggtgcctaagagaccaagctatggtggggatttgagtctttagacaagcagcccaggaagagattgttttgagagcagttcggcttcttggtgctcctgaacgtcttgtaggtatatatgcttcatgaggcaaaattgtgactctggacttactaaaatacgttccgtagtaagaattttttaaaaaatgcagttttctatgactcaactttagaggttttcattaaatattagagctggaaaggaccaatactggtcacactctaaagaagttttttcatgaattgatacatatctaatttgttgatacctcttaaagtgagagaaggcaaagaaagctcctgagattgtgcttgtcttgatcaatacaagcacaatgagttgctgagatgaatgagtttggcaattggctataatctgagaatgttccgaacttagtagattggggatgtgtttgtgttcccaggttaattgcttatttagctggcattcatttggggctgctagtccatttgttaattctgaaagttgttggacatttgtttaataaaaacaaatatatttggagaaatccagcatcccaagtagccacattagtaggaattaagtaggtacaaagtaatggtttaagaaatgatagtcttttgtatggcaaggtaaaagcaaaatgtcttttagaaggaaaatttcaaattgattaatttttaaagtctgttatcctgtttaatacttgtgtatctctgagaatataaatgaggtaaagaggtaattaagacatttaatatttgtatcacaactgtggaagatatgaaattgttattttccaattgatcattacgtaagagagatttgagaacattttgattagaatcacttagacttttctgtccctatatgaagcgtaccagattgaggcattttcctagtaattacaggaagtcttatttaattaaataaaactgtttctcatggtgtttctggccttcagtaactgaaggtttttattttgattatgtgttttttgttttcagagactgtatttaccatctagaagcatatcaagcccatcacaaaagtgtgtacaaaacaacagcttaatttaacttgagattcaatattggcccttttacctaaagcacctgatttttgaataccagttgtgaccatctattgacacatgctaggaatacatgctagtttttgtaacgagaagataaatgaaaaggctcttagaattattagaaaacaatattttctttttgactttttccagagaaaaatcaagacaagactttgttctatttcatcaagtccttgacgcctcctcccagctggtcaggttctttttatgtggcatttaagccttgagttgttgtgagtcaacaaatggacaacagcaaatgttcagccatcttattggtgttaagcctagcaaataggcaaattatatgaatacaccaaatgcataaacaagttttcatgagccaacgattccaaatgagcccagcagctgccagttatgtccttaagaatagaagtggccctactcatcctctaatctgttattgccccaagttgggaaatgtcagctgtaagatttatagatttagggctctggaataacaagttgcctcttagaacttttcagctctaaaagcttcttgttagccagctagacagagatatagaaacatatttatgctttccatatataattcttgaatcatttacaacatcagtggtgggctttaaaaatatatatatatatatatatatacacacacactataacatataaattacacacacacacattataacataaattacacacacacacacacacacacacacacgtctctctctatctgtatctccctaagacattgatacaagtactcatcagtaaaccatgataattttcagaagaggcttgctttgactggtaaactcatattggtacctggaacacaaaactcctacagctacgcttgttttgtagtctgagcttaataagcaatatccttaaggtaatgaaaatcagttcctcttctgctccctaataacatcagtcctttttgaatctgtacgatttttctcgtactcttctcccccaaatttcccccttaaaattgtggcattggatataatggttttatgatttggaggactgttaatttctaattgaaattgaatatctatggttcactattcagtgctgaacttgatatgagaaacatttcctggtaaatcagtaaaaccagctttatgtcttcccgcaaataatcaagtggcaggtagaacggacatctgacctagttgctccttggactgcttttggtcaaaagaaattggtaaaccactcagtctataaatttttctttctgtgattctgtagtgtcaggacaacattgccatgggtactttacttatacggagaaacaaaacctaaatctcaaaccaccatttataaaacccacaaactcttgggctgtcatttgggttacagacttgaagctccctttctggttgcgttctctggagtgggtgaatgcctgtctgatggggatgcatttttaaaggcaagacagatttaagggtataatttagtgacattttgctgactgcatttctctctatatacatgtctcttcatatatttcacaattttaccaatattcagttacctcttagcctacttgaagcaggccccacaattttgggactgtttcttatatacataatgactcaataaaggtgtctcattatgacattagtcattctgttaacttaagtgctattttttgactgtatgtataaatcagtgtatatttaacaagtgagctgaccaaatgccattaaatgagttgtccttattttggtttttttcctgctccaattttaagttttcaaagaaatccagcatgtaactaccacttttaagtctccactttttaattttgaataccaaatatggcagagttattcaggtggccaagtagactttttctgacctcgaatgtggtttactggtattacacttaaaaaaaaaaagacaaaaagtagatgtcagtatttgctgttttaggatagcataagcctttgagatttcccaaagatcattttaacagtctgatatgcagctgtttgacatctacgtttttagctaaaaggcgtcatccccatattcgtatttaagtggccctggaacataatgcggagataggtcactgtgggttaatctttggacacttcatatctgacaggcaccagcatctgtggtttattttgtggtgttccttaggtctagaaataaaattcttttaaacctgatgatagtcaggggaatgtttactaagatagttttccttccatttgcacagttttaaagctggagctaaaatataacacatgggattaaaaaaaataaaatctgtcatccataaagtaattcatggcactggtaaggttgaagtaacctcagggactcatgttctgtggtggagtgtacatcaaggtgtattccttttattaggaacgtattatatccatatactttaatatggatggcagatattagcagaggcttactggggaaaaagaataatttttgtgtgtgcatgtacatttaggctaaggcattataagttgtagatttccacagcacaacccaaaattcaaaggagatgccttttaaagaatatagtggtgatggagtctgggtaagaaaatcctgtgttgaaagttgagcagaccacaatcatttatatgcagtcaaagagcttttggtcctgcaatgtagggcatataatcttattacaaagccctttaaaatcaataaaaacatccctaaaagtgtggtagcattgagttcattctttttttaaaaaaaatctattttcaattacattattccatttaaatgtatcacaatggcttttatttcaaagatacttctagcctatgtatatattcacagctgtcagaaatacgtgtcattctttgtcttacaaatccctgttctcagccatttcagagcctaatccttgaggcggccattttgctgaaaggcagttaaagaaacagtctgtcagcctggtctgattcttgctgaaaaagcgtcatttctgtacccaatgtgagctttagttccagatttttgaatgatgtaaaaattaaggtcagggaatcaaatataaaaaatacatcttgcaggcagagccctcattagcatccagtcatcaatctcccaaatctaggagctgggagaccattgtactgttatcctgctgatattgagttgatagcaagtttaatggaacaggctggcagttgtgaagggcagctgataatgatggtgcaagctcaacgaaaaagttgggtaaaatctgcaggaggtgttttctctcatttggccttgttctgttggctgttggcatttgcttggcaagagggaggtgttcttatctccccagctagagaaattttaaatgtgcttaaaaataccgagtgtgcacttctgttactgcctcttcctaacaagaccagtggaagcagggcagttgtgtattgagtaggaaaatccactcaaactgataacattcaggtaaacctgaaaacagtttgcattttctggtaattaaattaaaagaaggcggttgactatcaaaagccctttttcctcatgtagtaaatgagcacataatcttaaaaaataaggtaacctcaaatatttttgtcttcaggattaatggtatgttttgatttttaaacacttctgggtaaagtttgatgagtgcttttatataattaggtagcatcttaaaacatatgattggttatgtttctgccttgcagagtttatgagacgaaagttggccaaacaacagggctaattttactaattaaagtcgtgctgcccaagtgggttaacatgatatagatgtttggttttaatagagcttggaaagggtacggagtcctaaaatgttctgtttggaaagctttggtctataaaatttgcctttaatacggctgacgacccttaattagaatgataaactgtacttgctggtgtgatgtctatttgagaagaagcaataccggtgtgcctaagtgtcattgtttttagtgtattaagatgcctttttttctgggcatggcatttctgagtacctgtcttctctgctctgtttcaggtgtgaatcatggcaatacagtgaaagacagtgatttactgcttttgagggcgtgcatgtatatgattaacggatggaagtgcaggactccaagatttacttccttccctttccagcagaattacctgagacgagtgagtaatgggataatttgtaataccacaggccccttttcaagggaccagtaatcaaaacaggaagatgaaactgagaagatttcaactggaagaatacaacttttgataatttctggatatacctcttaattgcaagcaggagagtcttcagagttttcctgtggtggtggttgttgttgttgttgttgttgttgtttgagatggaattttgctcttattacctgggctggagtgcagtggcatgatcttggctcactgcaacctccgccgccccaccccccgggttcaaccaattctcctgcctcagcctcctgagtagctgggattataggcgcccgccaccatacccggctaatttttgtatttttactagagatggggttttaccatgttggcctggctggtctcggactcctgacttcagatgatccacccgcctcagcctcccgaagtgctgggattacaggcatgagacgccacgcctggcaaacatgagccaccacacccggtggagattttcattaaaaacgttagtatgtcaatcctggtttcatcatgcagacaccctgctaaattttatacatctttcttccatgctttctgctcttgatattcttatatcaagacatcagagaaacttcgtggcttatttgtagaactcagtttctttttacaaggttaaagaattatcaagaattgggagttggctgggggcagtggctcatgcctgtaatcccagcgttttggatggccaaggcgggtggatcaggaggtcaagagatcgagaccatcctggccaacatggtgaaaccctgtctttgccaaaaaggcaaaaattagctgggcgtggtggcgcacacttgtagtaccagctactcggaaggctgaagcaggagaatcacttgaacccaggaggcagaggttgcagtgagctgagatcgcaccaccgcactccagcctgggtgacagagcaagactctgtctcaaaaaaaaaaaaaaaaaaaagaattaggagtgttggctgggtgcggtggtgactcacacctgtaatcccagcactctgggatgctgaggcaggtggatcacttgagcccaggagtttgagaccagcctgcgcagcatagcgagaccttgtctctgcaaataatacaaaaattagttggatgtggtgacgcatgcctgtgattccagcttctctgtagggtgaggtgggaggtgggaggatcacttgagcttgggaggttgaggctgcagtgagccgagattgcactccagtctgggtgacaaagtgggacactctcaaaaaaaaaaagaagtgtaatgataaatacagcaatatttttagggtggggtggagtgtacacaaaacgactagcctgtgttcatacttaaaaaaagtaacaaagaacaagaatttcatacttcataaaagtaaaaaaagaacaagaatctgaaggctgtatctgacatttagtgtatcatcatcactttggaattgcatgctgttcagagctttcctgttgcgcctaatgtgatggggtcttctgacttgtcattgttgataacattagattcatgaaaactgagtagcacccatgatatttttatgttacaaatattaatttcagctttgactttggtggtggcagtagacttctcatattagagattacaataaaatgttaatagttccaagctcttcctcctctcccatcatgtcaggtgactaaaacattcccacaaataactgatacctttttaatgggacctttgggttcataagaggtaaatattgatgaccttgacattttttcatatgtgtacagttcaggaggcacaatgtctccagataactaaaagcaggtgaacaagtaggtagacagccatgggctcccactgatccccgtaattcacaggggccctggccttgcttctggagcaaaagcataggcaaaggaatctataagtttaggtcctgtaggtatttctgtaggcaaatctcactggactgggtgtgttttagtctggcattttaataagatgttttctaaggcaaatatatgagtctcctcccttacccctgtgaaactaaggactctagtactaactaccagggtaatattgtatagtagctaagtgcttgggagccgaattcccaggtttaaatcccagttctgtcaccactagcaatgtgaccttaggtaaattatttaacctctttcagctttaatttcctcagctagaagatgaggataataataatacttaggttttcttttcttttttaaataattaaatgagagctatccaattgtgattagcatgttagtaaagatttctgaaatattattcattaaccagctttcaggtatcctgtgctcacagagactaacctacaaagctgatgaggtctacagcttaagaaaattttctatttggagtatacactcagttacatgaaaattgcgtatggaaaaagatgagaatgtagcactgattttgcaaaacgttttagaaagttttatttcgctgcttgtcttaaaagtaatttttctggttttatgtaatgtgtgtattagaaatgggaatattggaatacttacttcattgtattgtcaagcattattggtagccctaatttatatatccattgtgctgcagtttcagttgcagaactgccatctgcagggattattatagcacttgaggggatggaattactgcactctgttttggatacttttttcactaagaagtatgggcaccatgagatggtacttacccatctgtctgttgaagcatttgtatgtatattacctgagcacttaggcacaccaccgaggggggatttcaaatggaagggaaaaaggaaaaattgaaaataaaataacacgatggaaataacagaagcctctttgcaaagaatacctaaactattcttaaaagcagacttaacagccagtacaaaaccattcactattgtctttaagagacgaagctcaatccacaaagttgaaagtgaagtgtgaatctggaagttttccaggaaagtcaagcattacagacttctagggctcaaattcaagggagaaaaaaaagtccattttacaaagtaacttcttacattgattgtgagctgtcaatgtttgatgggtagatcctgaaacattaactgattaaattcttcaatgctatgcggtcatattggtggcctccgctgttctgagcttctaaatttgtgtatcgacacatgggaattcactaaatgtgcagcagagagcagagtggaacattgtggcatcagcttgaaatttcctaaagagaaccagtggaatgatgttgaaatcaattgaaatattatttattgattgcctatgttttatagcacctaataaattgtccaatcccttaaaaacactccatctgcctaattctccatttccagttgcagcagatacaaggatacaaagatactctgtactggtagagagggatgatttcaggttttcttcacagcaccgggctccctgacagctattcttcgtgcttgtgcacactcacagttttcaatttcagttgggacaagagaagtgtttttctcccatattcagttgtcttggtattttttaccctgacggcctcccctaccctccaacacatgtgcttcctcagagcttcttcatccatatgctaagagtggggtgtggcttctcagcattttgtgtttcactgcacacctggaaacctatgggctaatgaccctgtgagaatttgggtggtaaggaggctgcagagatcagcttccttttatagatgtagaaactgaggcctggagaggtgaagaaattcatctgagatcattcagccaacaaatatcaggacagcacctctaacgtcagtgcaatttcagcttttccactaaggtatactgggaggagtgcagtggtatgtaccgggctgagtcctggttaaggggttatagtggactgaccaaggagtgaaagaaaaagaatatagtggccgggtgcaatggttcatgcctgtaatccttgcattttgggaggctgaggtggacggatcacctgaggtcaagagtttgagaccagcctggctgacatggcaaaaccctgtctctactaagaatacaaaaattagtcgagtgtggtggcacatgcctgtaaccccagctacgtgggaggctgaggcaggagaatcgcttgaacctgggaggcagagactggtgagccgagatcgagccactgcactccagcctgggcaacagagtgactctgtctcaattaaaaaaaaaaaaaaaaaaaaaaaaagaacactgaatcagggtttgggtcagggtttgtttgaggttgtattagaagcatatctttcggtcaggaagcatgaatattctctctctgatataagcgaaaaggaagagattaaaggcatgacgaagatcaggtctttttaaataggtgtttactttctattgaaaccacggaacaatgaatatttattcatcatcaggtaatttggggtaatggagtatagacaatttctggttttaccttcttgcctctttgggtccgtgctgccttttgttttgcttaaaatgggctaaaagagaaagcaactgaaacactttccagatctgataacttccgagatctcaagtgaaacctctggctcgcgtccaagggtgaggtcacacagtctgatattagttggatttatgttggtgtgtccaccaaaatacagagcagcacactgccataattcttgacagccatttattaggtaggtaggaatggcacttgggtcagttgtatgctgtgtattgccacccagaagcatagccgatccatggccataggcatttcttttctttttcagttgatagttttaagttcatgtggaaaacgtgcctttggttttacctggttttatgcctttggccttatctttgctcactcatactcttgaattcagatctgtctggacacgtctggaggtctggtgttttggtctccaacagtttgttttcatgattgtctgaagtacctctgggaaagtcctcattctataggaagacagttgaattggataagaaatatctaaagcacaaatagacattgcttatgtctgtcaacagatgagaacctgaaaaagccaatttttcaagatggatcccaagtggctaagtgggcttagatttaacatagagtcaagcagccatttgctgacttgaggccccacacatactctgagttcccccaaaccctggaaacccccacatctttttaactttgggacgttgagaactcacctgaaccaaccaatcaaagctcagctgtattgaccaatcagggctcagctgtatcaaccaatcaacagaactcacttgtgtcaatcaataggaactaaacaagtttcagatctttgaattaacagactcgattggaaacttgggtgggaacatttgctgtaaaatccaaaccctcttgttgttctctggaatgcaccttccttttacaccaaagcgtatttctccagtttgcagactgttcactgaaataaagtctcttttctccaaattccttttcagagaacttttgttcacatcttatacaaaacagtaagtagctgttaagtatatagatatggatagtgacatttattagatgcttattgtatgctgtgtaccagacatttattagatgcttattgtatgctatgtaccattttaactgctttacagatcttcgcagcaacgctttgaagctcgtgctcttatgatttcattttacaaacaagaaactgagaaacagaaaagtgaataggagcttgtacagtctcaaagagcttacagtggagttagaaagttaatactcaactcattcattcaacaagctgaatgcctactagcaatttgagtttatgaaagtttatgtacctctttaaggcttgcccaaaggagctcacaatcgaatagagggatgtttatgtaaaccaaagttgaaaaatgtgttaatagacagaaagaggattccaagggaagcatgctgccaatcacttggattactttccagtcgaacagaatcatgttggaaacctagggagaatgggctgtgttaaaagtgaaagcaaaatctcaagatgactgatttaccaaaatctgtgtgccacattgagtatgttaagtggcatcagtaactacatcagggacagggttggcagtagaagagaaagtggcttgtgcagccttgggaagtgacatcactgggagctcagcagctaaatcagtatcttggccattagcacttttgacactggttctcactggcagataccactggatgggaccgagcaggagaggaggaaagtggcagatactatgtgatggctgagaagcagtgttgatgagcttattagtcatctcctggcaagtccatgacatttgcttatgttgatggggggtgtgtgggatgggaggaagagaactgacaattaaggaggcagaaaattcctagtaacataatcttgcacttcagttttgtatgtgttttgggacataaattccagacagtgtgagttagcagatgagtgttctaggcatattcctgtgcctcagctcctctgtagaatggtgctggcaatacagtttgcctcattgggctcttgtaagctttaaataggttattatacataaagagctaatagtgatgcctgtagccgttgtctaagtgctagctctgatgatggtgacaaagaagtaatagcaatcagtggtttagattaaaccattttaggcataaactgttctgctagaatccaaggggagattttttcccatcaaggagacatagcttgttgggaagataagacatacccaattgcagaagtaattaattaattcttttttttttttttttttttttttttgcgatggagtttcgctcttgttgcccaggctggagtgcaatagcatgatctcggctcaccacaacctctgcctcctgagttcaagtgattctcctgcctcagcctcccgagtagctgagattacaagcatgtgccactacacctggctaattttgtatttttagtagagacgggttttctccattttggtcagggttgtcttgaactcccaacctcaggtgatccacctgcctcagcctcccaaagtgctgggattacaggtgtgagccactgcgctggccgaataattaattcttaacatctaatttcctacctgtgcacacttatccagcccaggattaccttttagtacctcttcttatgcatcctcattctctctagccatgccagatgaccccagagacctagattaggttctcttatgtgttcatgcattcacataagccattgtaatcagtctagagttcctttctcctttgatctgcctgttgaaatggacatcctttctgcaaaatccttcatattacccgccctagaccctcagttaattcagctgtcactgcattgccatggtgccctgaacatgccttttggaaaattgttttacctgcgtatttctctactagattatgaactccctgggagaaatttatatatattttcatatttcagattcgatgtagttgccttatggaataaatgagtgaatatttttctaactccatggtaaactgttttgagactggatctgttaatttttctgaggctgtttttttttttttttggcctataaaatgggttatttataagcaggaagtacagtggttagaacaaaatgataactcactgaatgttggttatttctatgaacataactttcaaatatttgtattcagtccaaacattgtttggattacattaaggtaacaaaaatggctactttttatgttctgttcttcctgaactcttaacttccctgatttatgaaaggactcttcctccactcctctcagacatgcttccctggggccatttacctcccactaaaaatcaaatgaagctaatctccctggcttgatattgattccatctagtccagagagaatatgctaatcacctttgctaagtgctttctggctaaaggtgtaaaagcctgattccatttgaggggaaaaaattgaaatttctgtcttaaaatttgtgattatggaatttgcattttgaaaggcgatagtagctcaaatttaacgagccatttgtagtggattgagcataaattttcatggctcgtttggataaaaactacaccaaggcatagatttctatgactatagtatttaattttgttaaattcaatttaatgcctacaaaaatagtggaaatcccttttttctcctctatcagtggcatgttttttgtacatgtttaaagctactcattttcaaaaagcaaagaccattttaaagactgctacttaaggctgtcaggctgcctcagtttcttcgtcaatgagtctaacctaggccacctgcatacttccctggagtgtttagatgaatggctctgagcttgtaaagtactttgaatttcctggatgaaagggtccctgtaagtacaggtcttatgaaggtattatagctgggcttttaaaactgccgcacagcctgttttgcaagaacactaatgcacttctgggtttagagttgtaaaaagatgtgtgttcagaagcctcaggcttcgtcttgtgcggttcctgaggcatgtgccgctgcttgtttacttctagcatagattgtctccacactacagggatgtacaggtgtgcacttgcacagcgaccatctgggcttaggatcacctaggatcacatttggctgccgtggtattgaggagaaaacacaggttgcaaggagagaggacgggctgttcctggccccatggcctcaactcttgggatcctccaggatttctgtaatcacggtggggaagcacgcacaaaagtgctctgaagtggttgaagtgagggaggggttcgccctaggtaccgatgcttggattatgaagaactgggtttgggttctagctcttccagctcctagccctgtgccctcaggcaggtcagctgccctgagcctcagtttctctgatgggcagtcttgcccctaacatttgtggtgcccggggctagaatgtgaatgcaggaccacatactctgtatgtaaatatttaaaagttacaaatcaaacaaaaaagtgtcaaaacatgtttggaaatttttctgttctgacaaatacacctttataaccatcttgaagggcaggtttgaattttgagttttcagattcttagccaacttccatgcctgaccaggtagtgtgggtgggagcaggaatctagtcgtcatgcttgtggacagcgtggtctgtatgtctgctggacccacccttcaccctgtgggcctcgggattctatattgaggattgtctatcttgggggagtgtgtggagggaacatctgcacaggccttataaatgagcatgggctgttgggataaggaactctggggcccgagcacctggcacatgatccagaacaggatttttgggttccgatgggcaggtgactttagtcctcactctgtgggcaggggcattacagcataggggtcccttttgtcagggatttatgatggcatcacacgcaggattcagagagcattaattgaaaaatacatatgattggctgggcgtggaggcttatgcctgtaatcccagcactttgggaggctgaggtgggtggatcacctgaggtcgggagttcgagaccagtctgaccaacatggagaaaccctttctctactaaaaatacaaaattagccgggcgtggtggcacatgcctgtaatcccagctactagggaggctgaggcaggagaattgcttgaacctgggaggcggaggttgcagcgagccgagattgtgccactgcactccagcctggacaataagagcgaaactccatctcaaaaaaaaaaaaataaaaaaatacatatgattgtgcttttttttttttttttttttcctgagactgaatcttgctctgtcacccaggctggagtgcagtggcacggtctcggctcactgcaacctctgcctcttgggttgaagtgattctcctgtctcagcctcccaagtagctgggattacagatgtgtgccaccacacccggctaatttttgtattttttggtagagatggggttttaccatgttggtcaggctgttctcaaactcctgacctcgtgatccgcctgcctcggcctcccaaagtgctggtattacaggcgtgagccaccacgctgggcctgattgtgcttttgtagtgttactgtcacatatatgaaaataagttctttctatcagaaaggctttatccttaacatcagccttaatcacatcaacatttagcagtgcttggattgagttattttctgctgtataggatgatccatctctaggaccgagcacagaactctgttttcacttagcttttttgtttgtttgtttgagatggaatctcactctgtcacccaggctggagtgcagtggcacaatctcagctaactgcaacctctgccttccaggttcaaacaattctcatgcctcagcctcccaagtagctgagattacaggcatgtgcgaccaggcctggttaattttttgtatttttagtagagacggggttttgctatgttggccaggctggtctcgaactcctggcctcaagtgattcggctgcctcggcctccaaagtgctgggattacagtgttctcacttagcattttattcattcattcaataagataaatgcaataagtatttattgactattcctttttttcctaagcattattgtaggtaatagcagtaaacaaatagatacaacttcctgtcttcgtggaactaacactttagtaggaggaaacagaaataaaaaggataaatataaaaatgtgtagtttccttgaagatggcgtcctctctgttcactcatttgctccacaaatatatattatatatccctgccaaggactaggcactctgccttactcagaggtaaagatatggaaagagaaatgatcacaaaactagagtgtggcattactcagggtttgtgtgaagtactgttaactgcaggaaatccttatgctctttggaattaatgttctagaattttgtcttttccacttcaatcaaatgattattcaggccaggcacggtggctcacgcctgtaatcccagcactttgggaggccgaggcgggcggatcatgaggtcaggagatcaagaccatcctggccaacacggtgaaaccccgtctctactaaaaatacaaaaattatatttttgtattacaggcgtggtggtacatgcctgtaatcccagctactcagtaggctaagacaggagaattgcttgaaccagggagtcggaggttgcagtgaaccgagatcacgccacagcactccagcctgggcaacagagcgagactctgtctcaaaaaaaaaaaaaaaatgcttattcagtctctgctctatttaaggcattgtcctaagctttatgaggggtcgaacaagaattcataattcacaggaggtggtacagtcatgagtcacttaacgacagggatatgttctgagaaatgtaccactggataatttcttcattgtgcaaacatcatcgagtgtgcttacacaaacctagatggggtagcttactacacacctaagctagatggtacaacctattgctcttgggctacaaaccttatagcatgttactgtacaaaatattgtaggcaattatgacataatgctagatatgtatgtatctgaacatatctagacatagaaaagttacagtaaaaatataaaggataaaaagtagggccaggcacagtggctcacacctggaatcctggcactttgagaggctgaagcgggcagatcacgaggtcaggagttcgagaccagcctggctaatatgatgaaacccccgtctctactgaaaatacaaaaaattagctgggcatggtggcgggtgcctgtagtcccagctacttgggaggctgaggcaggagaatggcgtgaacccgggaagcggagcttgcagtgagccgacaagacgccactgcactccagcctgggcgacagagcaagactccgtctcaaaaaacaacaacaacaacaaaaaaaaacacaaacacattgtacagctatacaacattttctttccttatatctgcaagattttttccatttctaatttttttttgtaactttctaaacttttttgttgttgttaaaaactgagacacaaacacatatgttaccttaggtttacacaggtcaggatcatcaagacgtcattgggcaataggaattttcagctccattataatcttaagggaacacagacatatgcagtccgcgggctgaaacgttgattgtaaatacagaacctttagagtggttcttggcatattgtaagcatttgaatgttaactgttcttactacttatctgcctgtgtccctgtcaatgaagtgaaccctggtcctctcctttcccctctgctctgtcttcttcagtggggtagggagaaatcctgcctgcaccaagtcacacagtgggtgtgtcctgaaagaattcttttcatcatcttggaatgctgtccttgggattcagctgacttccctcaatcgggactcatacatcaagaggtcaggagtataattatctcagctactgtgaagccacagaaaagcacttgctgagtctggatgtaaatttattgtgaaatttaacaaagaaaaagtcacctccttctttccctttcttctcttcaactcaaattgcattttaaaaggtcttcgtttaggataaatagatgtcatttatctaccattaaagggcctatccttcttggtttgggacatgtaaataccttcctgaagcacatgagatgccttggctatttacacccttttctgggggcaagcatgctttcgttcttttctttgacaattaaaaataaaataaaacagctagaaagaaaagtataagaaattgtggtgagccataattttgattatcaggaatttctcactcagttgataaaggggtcaaccaatcttcactgtgtgtttatcataatttattacccatgatggtttatccctctaaatatggttcatctgtgatatttacaataattttatgcagatgtaggttactttttgcatataaactacaaaagatggtgaactttctcttttcaagaagaaattcaggaggtagttttaggggacttagtagagaggctggtaaaccctattttatgatttttaaaaaataaaaatttgaatgtagttttaaaaaatatgtttaaagcagaatattttggttctgtttctaactagctgtatgatcctgggcaagttaattaacacatttggttcttttttgtaaaagaagtgtgctagttttccaatatctaggatttcttccaatgataaagttcagtgattatataaaataaaaagactaatcaattgaagctacacagtgtttttaaccttgtgtatgtataatcatcatacattgaaagccttttacattgaaagccataattgaaagccttttaaaaaaagttatttaaaaaaattcatgtgcttgagttctgtctactaacattgtgatttagtttgtctagggcttggccttgggaagtgttttttttttttttttttttttgagatggagtctctctctgtgacccaggctggagtgcagtggcacgatctgggctcactgcaacctccgccttgcaggttcaagcgattctcctgcctcagcctcccgagtagctgggactacaggtgcccgccaccacgcctggctaattgttgtatttttggtagagacagggtttcaccatattggccaggctggccttgaactcatgacctagtgatctgcctgccttggcctcctgaagtgctgggattacaggtgtgagccactgtgcctggctgggaagtgtgttttttaatcaaagttcctcagagactcttctgatgtacagtaagaattgagagtgactaatttgctatcagtgattcttaaatggagagaacatgagtcccagagaatttaggaaacctctgggatttttccagagtaaactgtgtatttgcacaaattttgaaactgtaacttaaagatgtgcatgccctcctataattaataaatcttgggttaagagtctctgatccaggaatcccttccaggattctgtttttatgaacttctactaatcaaatttattatgtcaagtaggataggattataatgaccactatggccactgatgtgtctggtagaaaattccattgagagccagagacacagacatttatgttgaaactaggaaataatggaaataggggatttttgtgttttttttttggctttggccttgtttactgagatttgacctttccgataggtttcttgacatctttggaatgcaaaattggggatactaatatttgccaccaggtaatatttatttaatgatgtgagaacccagggtgttagttgactgtaactgtgattattaacaggaaaatgcgatcagaaataatggcacctttgttatcactgtgattttttttttccaatggcactgaaggaaaagtgatatttgttatcaaatcaggcagggaatttacaaatgataacgagttagagaggctgcattctttctagtatctcactctacttgtcacaagtatctttctcttatggaaagataaaaacacttgatttgggccataaattcactctgtcttctatcaccagggccctaggaatccttgaacaatcttgacctcttcctattcttctttgattgaaaggatgcttattatgtggtgatagctttaggagggcaaaggaaaaacagcaaatatatcagtacaatttcctaagaaaggaagcttctgtggccttttggagggcagaaatgcatactttttattgtgatggtgttgtggtggtggtgatgatgatggtgatggtgagggtggcggtgatggaggtgatggcagtggtgatgatggcatggtggtggtggtgatgatgaatggtgatagtgatgatggtgatggtgagggtgagggtggcggtgatggaggtgatggcagtggtgatgatggcgtggtggtggtggtgatgatgaatggtgatagtgatgatggtgatggtgatggtgagggtggcggtgatggaggtgatggcagtggtgatgatggcgtggtggtggtggtgatgatgaatggtgatagtgatgatggtgatggtgatggtgagggtgacggtgatggaggtgttggcagtggtgatgatggtgtggtggtggtggtgatgatgaatggtgatagtgatgatggtgatggtgattttcctccctccacccaacaacttacacaagagctttgtggatagacctaagtgttaattggtttggctaagagtaagcattaaaagcaaacactcccaattccccaatttttcaatgttagattctaatggatttcttctgtttgcagttgattatccttgccttgattacaagtcaatgttctagcagagtgaagtcattactggccttaattttcacagcctggcacggttggagactgcagtgatagaaatggagtggctaaaaagaatttaactttttttattttgaaagtgctgtgggaccctctcagctatagaatacttgacagaccagatatttccgtgtatatacacagcctagcttttgaaatagcagaattggatatacaaattactatctcactatccatagtggaaagtgttctttctgtaggttgggagcaagtctggcgattggtttaggggcgggtccagtgggctgggtcctgcttgtcttcagtcccaagcttcctgttgtactgtatttgacctgaaactagctgctgatatgacatcatcttgggtgttgctggcacattttttttttcttttctcagtagatgtacacttaattatttttccttttcaaaacataatataggatgggtgcacagtggctcatgcctgtaatcctagcactttgggaggccacctctggaaaattgcttgagcccaggagtttgagaccagcctgggcaatatggtcaaaccctgcctctacaaaaataaaaaataataaaaatagccagatgtggtggcacatacctatagtctcagctactaggaggctgaggtggaaggatctcttgagcctgctgtgagccgtgattatgccactgcagtccagcgtgggccacagagcaagaccctgtctcaaaaaatccgccccccccaaaaccacacaaaggagttttggcttgctttgcataccctataggtatgtctggctctttctgatgagtgaggtattgtcctcctgttttcctccttccaaagaagtatctgttgacataatatgcttttcaatcatcattattatagagcagtctgagaaacctttagggcaagtcaggaaacccccggcttccagagcaacttttcaacccctgaaagacaggcctaaccagacagcagcagttcatgtttctgtatttgtagagatttcgctagtgataatcaaagacctcacagaagagtgaaacattttatttagaattgtatgttaggtgaagtgagcaactctccaggtgtcattttccatccgtgcacatcagtcctgacacgccagtggtatagtgcgggagctctttgcttaatgcagaaatgaagtcaaattgctcaggtcagcctcagctatttggggctctcagactctgcttttttcccccatttcctggctcctcagtatcttttacaaccctctgctatgagaggtttctgctaagagggctactacttttcattttattgattgattgattgagatggagtcttgctctgttgcccaggctggagtgcagtggtgcgatcttagctcactgcaacctctgcctcctgggttcaagtgattctcctgcctcagactcccaagtagctgggattacaggtgcccaccaccacgcctgggtaattgttgtacttttagtagagatgggatttccccatgttggccaggctggtcttgaactcctgacctcaagtggtctgtctgactcggtactttacttttttttttttttgagaaagagccttactctgttgcccaggctggagtgcagtggtgtgatctcaggtcactgcaacctccatctcctgagttcaagcaattctccctgcctcagcctcttgagtagctggaattagaagcacttgccaccatgcctggctaatttttgtatttttagcagagacagggtttcgccatgttggccaggctggtctcgaactcctgacctcaggtgatgcacccgcctcggcctcccaaagtgctggaattacaggcatgagccaccgcgcccggcctcgtacttttcattttagatgcttggtagcattggtttttctggattctggcagtggtcaaatatttttctagagccctggctaggtgcctgtcataccttattttgtctgctgagcagctaaaatttggcggaatcctcctgtactttcccgctcttcacctcaatcctcctgccaggagttttacacacttgggtgtccaactctaatccaaagcaaggaaactatttgcttggatcttgtaattcctgccgtctttgttagttctaactcttctgttgccttctcacagatatcaaaaagcaatagaatttgtccttgccatatttactttttaactaatgtactgtattttacctttgcaccacccactctaagaagacttggtagcctatttgtggcatgcagatatattcacagaaaaacataggggaaggaagaggatgtgagtaggaaacaggagagaattgcatgtggttttgatgagaacttcacctgagaagagcctgctatctttgggctctgtttcatcagttgttggaatccttttcaggccggagcgggcaggaggcaggcctgtttctcatcctcccttccagaagtgaagttaaacgttgatggcagagcattgcatgagagccattgcatggctttcatgatgatcgctttagaacagttgtggacaaactttctgaaataagggaagctatgcatagttaaactttaagtcaatttccaatcagtgctccttgccagtgaagcatttcttataagatgacaagaatggtaagaatatgttttctatgtttgatttcttttatccccaggaacttcaacaactcttataaatcactgattcctatacctttaccttcagtctctttggtctcctaaaatccatgttgctgtttccaaaatttaatactgctttaagtctccatctagctgcctaggaggtatatcacattaaacatgaatgtgttcagagagaatctgttatttttactcaactttttaatcttgtcttctctacctttaaactgctgtctaagtgggaggatgggatccacccttgactcttcctcacagctaattggatcacagagtcttttttattgtatctaaatatccctagaatttgcccttcctatttctgtggctattgttttaaagttcagtccctttttattacttgctagagaactgcaacggatgctgccaataggcaagattttttttttttttttttttttttttgagacagaatcttgctctgtcacccaggctggagtgcagtggtgcgatttcggctaactgcaacatctgcctcccagattcaagctgttcttgtgcctcagcttcccgagtagctgggattacaggcacatgccatcatgcctggctaatttttgtatttttagtaaagatggggtttcaccatgttggccaggctggtcttgaacccctgacctgaagtgatccacctgcctcgacctcccaaggtgctgagattacaggcatgagccactgtgaccagcctaggcaggatttttgaggaaatttctgattacatctttcccctgcctcaaatcctccagggtatcttaagacccttcctaaactgtcttttctaagtccttctcccattttacctctcctcattctgtttaaggtgccctagttcaagtgttaagaaatcatgctgtttgattccgtatgaatggattcatccttctcttggctcctcctcttgtcacactccctcccggacactgtcctgctcactcagaagcctagctcaaagtcttctttgtgaagcatttgtcaatatacttctgtctgtggaccctttgttataaaatatcatattagattgtaattgttgtttatatggctgtcttccccactgaactgggtatttctcaagagcaatgaccgtgtaatgtctggcacctgatagacagtcaatatttgttgaatgaatgtcagttgaggatagaggctatgggtgttacacccttcttttttttttttaatgcagatcatggtgacaatgcataccttatgtatatcaataatgctcccacaatttagtttttagcatattttccttttacctttaaaataactacattgctacctgttggagatgagagtggaattttaaattagaaaatttggaaacactgatacaatacacacttaaaacattaaaataaaccataaccaacccctctttcattggacacatttaaaaggatatctctaccctgacctatgcccttattaagtcaactcttatatttcttgagattagaaagtcacctgtatgtctcaagtgtctaaaagttgttcatatctcagaaatggagagccttttaatcatagaatgtctaaacttatctaagggtaggaggaagctagacaaactagattagatcaaggcttttcaaatctcagcattgagttaattaggttttatagcgttgaattcttaaatgaatattgctgtttgtattagttcatttttacactgctgtaaagatactacctgagactgggtaatttataaagagaagacatttaattgactcacagttctgcatggctggggaggcctcaggaaatgcagtcatggcggaaggagaaggggaagcaagatacaagttacatggtagcaggagagagatatatctataacacacctatatatgtatacatatacatgtacacgtatacacacgtatacatatatatacatagagagagtgagagagagtgtgtgagtgtatgaggaagtgccacactttaaagccatcagcttttgtgagaactcactatcacgagaacagcgtgggggaaactgtccccctacccccgtgatccaatcacctccccccacgcccctccctcgacattgggtgggtgggattacagtttgagatgagatttgggtggggacacagagccaaaccatatcattgttattaacaaattgcaagatgattaacagaaaaacaggggaaagggaccctattaaaaattgtagttttaagtgacttataagcaactagttaaggaatagtcatttatttagtatgagattacagttgtagaatatggctcaaagggttccttaatgctccacaccaatattggcagcaccacagcgggcacaaactcagcctagcttctgatttccaaatgacttcagtagttccatagacttaattctctcctgatttttaatacacaatggacttaattacatataattttcacagtttcaaatataatacatataaatgaaactactttagaagtttacctattgattttcaatttctaaatatttggagactttcctattattgacttctaatttaattgaattataacctgagaacatgcattgtatgatcacaatcttttaaaattagttgaggtgtttatttttttttctcaaatgactcaacctatgatttctcttggtgtatgttccatttactctggaaaagaatatgtattttgctggtggtgttgggtggaatgttcaactagattcaattggttaacatgacattcagtgcttggctatccttgttggtcttctgtcaactagttctatctcttactgagaatagagtcttgaagcctacaattataactgcagatttatctattcttttcttttctttttttttttgagacggagtctcactgtgtcaccctggctggagtgcagtggtatgatctcggctcactgcaaccgctgcctcccaggttcaggtgattcttgtgcctcagactctcaagtagctgggattacagacacgtgccaccacgctcggctaatttttttgtattttagtagagatggggattcaccatgttggccaggtttgtctcaaactcctgacctcaggtgatccacctgttttggcctcccaaagtgcggggagtatagatgtgaagcatcactcccagtcagatttatctattcttaaaaaaatttttttaatcagttttatttgacgtattttaagctctgttgttaggtgcatatacatatataattgttgtatcttcttggtgaatcagttattttattatcatgttgtatctctttgttttttgtttattttgagacagagtcctgctgtgttgcccaggctggagtgcagtggcttgaatctcagctcactgcaacctccacctccttggttcaagctattctcttgccacagcctcctgagtagctggaattacaggcgcccaccaccatgcctggctaatctttttgtatttttagtagagatggagtttcgccatgttggccaggctggtcttgaactcctgacctcaggtgacccacccaccttggcctcccaaagtgcagggattacaggcgtgaaccatcatggccggccgagattctgtgaactttttacctaatttcccctgatggtaacatcttacacaatagagtataatatcacaaccaggaaattaacattgatataactcatggatattattcagatttcctcagttttacatacactgtgtgtgtgtatgtatttaaatgtgattttatcacacatgtagttttgtgtatctaaaaccaaggtcaaaatacagcacaattctattaccacaggcatttctcatgttgcccttttataaccacagtcattcccctgcctccagtccctgccctctagcaaccactaatctgttcttcaattgtgtaattttgccatttcaagaatgttatataaatggagtcacacagcatgtaacttgttgggattggccttttttcactcagtataattccatagtgattgatccaacttgttgtgtatatcagttttattgctgagtagtatcccaatgtttagctttaaagggaacttcctaaatgttttccagagtggctatatcattttatattccaccagcagtgtacaagcaatacagtttttctgcacttttaccggaattaggttttgtcactcttatgtgttaaccatcctgataggtatgttgtaacatctcattgtggtgtaatttgcatttctttgatggctaatgatgttgaacatttttgctggccgggtggctcgcatctgtaatcccagcactttgggaggctgaggcaggcagatcacaaagtcaggagttcgagaccagcctggccaacatagtgaaaccccgtgtctactaaaaatacaaaaaattagctgggcgtggtggtaggcacctgtaatcccagctacttgggaggctgaggcaggagaattgcttgaacctgggaggcagaggttgcagtgagccaagatcatgccattgcactccagcccgggcaacagtgcttgactccatctcaaaaaaaaaaaaaaaaaaaaaaaaattttgcatgtacttatttgccatctgcgtatcctctttggtgaaatgtctgttcatgtcttttgccttttttctgatatcgtttgcttttctagatttctaatttttgtttgccttatactttttgtagtttacttttaacctacctatataaatatatttgaagtcaatttcttataaatagactatattgagtcatagtttttagtccaatatgacaatctctgacttttaattgtgttttagaccatgtgcatttattgtaattattgatacatttggatttagatctaccatttcattatttcttgtttgtttctctttttttttttttttttttttttgagatagcatgtcgccttgtcacccaggctgacagtgcggtagcatgatcagggcttactgcagccttgacctcctgggctcaagcaatccttctacctcaacctcccgagtagctggaactacaggcgtgtaccaccatacttggctaacttttaatcttttgtagagatggagtctccctatttgccctggctggtctcaagctcctgggctcaagcggcctcccaaagtattgggattatagacgtgagccaccacatctggcttgtttctcttttttattgttgttttctttttttacttctgacttttttttatatttgagcatttttagtatggcctgttaatttattatgattttgacgatatctctttgtatagcttttttagtggttgctccatggattacaaaatacatatttaactgtttaacatctacttatagttagtattttattactttcttggggatgtaatacacttaccatcttataagttcctttccactccctcttttacatctttattgtctatgtgtaacatctgcatacattgaaaatctcattaggtactttttgcttttgactatcaaacacaatgtaaagagttgaagagtaatatattttattcagatactcatcatttctgtcactcttcctttgttcctgttactcatgtttccttctattgtcattttccttctgtctgaagaacttcctttagtaattcttttagagcaagtttgctgactatacagtgtgaaagtttcccttaatccacaaatgcctttattttatcattattcctgatagatgctttcactggatacaaaatctaggatgacagttcattactttattttattattattattattattattattattattttgagacggaatcttgctctctctcccaggctggagtgcagtggcgcgatcttggctcactgcaagctccgtctcccgggttcaggccattctcttgcctcagcctccagagtagctaggactacaggcacctgccaccacgcccggctaattttttaatatttttagtagagatggagtttcaccttgttagccaggatggtctccatctcctgcccacttcggcctcccagagtgctgggattacaggtgtgagccaccgcacctggccaacagttcattattttagattgacaagtatttactttaaaagatgacagttctttaaaagttttttgctacttccttctggtcttgatagtttatgttaaagatccataatcattctaatcattgttttctaatcaatgttactttgatgtaatgtatctgtcattctactctgctttgaagatcattttctgtcttgagttttttaaaatattgtggtaattttaccattttaaccattttacaatgtgtaattcagtggtgttaattacattcacaatgttgtgtaactatcagcattctctggttttagaatattttcatcacccaaaacagaatgtccttagtttttagcagtttatcttagcatgaatttgtttgaatttacgctatttaggatttgcatagattcttgaaactgtaggtttatcttcgcaatacctggcaaattttccactcctacttcttttttttttttttttttttttttaagacagagttttgccctgtcacccaggctggagtgcagtggcgcaatctcgacccacttcaacctccgcctcccgggttcaagcaattttcctgcctcagcctcccgagtagctgggattacaggcatgcgccaccacacccagctaattttgtgggtttttctttttttttttttgagatggagtctcgctctgtcacccaggctggagtgcagtggtgcgatctctgctcactgcaacctccgcctcccaggttcaagcgattctactgcctcagcctctgaagtagctgggattacaggcatgcgccactatgcccagctaatgtttgtgtttttagtagagatggggtttcaccatattggccagactggtctcgaactcctgacctcaggtgcttcacctgcctcagcttcccagactgctgggattgcaggtgtgagctactgcacccggcctcttacttctttaaacataattctagcacgcattattgcccatctcctttagggacttcaaggacctgaatgttagaccttcagttattcagtcatatatttctgaagttctgctcatataattcttaacctgtttcttcctgttattcagagtaggtaatgtctattgatttatcttcaagtccaataaccttttcccctgtcatctccactctgcttttgagttcatccagtgaatttaaaattttgattttcatttccagttctaagatttccattcatttcttttttgtattttctatttcattgctaagactttattttaacatttgtttcaagagtgtttatgattgctcattcaaacataaaagaagtgctctatcatatagtagctgccttaaagtctttttcacataacttcagcatctgtattatgttgcattgatatgtgtatctttttctgtgtgagttgaaattttcatggttgttggtatgagttgaaattctcatggttcttggtatgttgagtaattttggagtctctcctagatattttgatgattatgttatgagtctctgggttgtgtttaatcccatggaaatttttttttttttttttctctaagcaggcaattgatctggttaggttcaggctccaagttccaacctaacttcagggggttggatactcaagggagtatcagtttacttttcaaagtccttgaagtactcttcggttctagtctgtgagtgtgccaccttgtggtcagtctgtgacctgtgcagtgcgtctatctgttagttccattctctgagcctttggtatgctaattacaattgatgcaaacatttaagggttggtgatgatccctggaattcatgagcaactctatggtgtcactttcctgaactactcctctgtattctccttggaactttttagctccttagggctccccctttcagtcttttaggagctactgtgaacttccttatttgggactttctctgggcccaagcaagagaaggatggtgagagttaaaaaagcaatagaggtcggcctcatcacacctccactaaatggagagaaaggttcccctccctcagttttccttcttgctgaccgctttactggtcattgccctcactgtcctggaattgcctggaagcaacctcatgaatgacagacacaaaagagcagaaacaacagagaacaaagtcaaggatttcacaccgtccatgagtgttaggagccctcttgtttgtccatgagccataactagagggcttctggagcattctccttcactgcagcagtgctcatttctaggtttccagcttgattaagttcaggcctgaggctactaggagaaaataaatggtaaacccactagtagtttgattgcaactttgattccagtggtcttccatgatttccctgatgctattcactttctagaattttttccagtagttgctttatatctgttcaggttgtatgcttctgttcagtgggagaaatgagtgaagtgtttttatgccatttcacccagaaccagaagtctgacctaatccatattgattttgtacataggaggtggccgctgttcctttccacgttaaagcagtcgtgcatgtaaattctggggactatagtcacttctacattgtacatgagtcctgtgaggctttaggtagtctgaattatcatgtaatataattaggttatatgtatatggaattatgatgggaatctaggtaaggagacaaaaaattaagacggcatatgaggccaggtaaggtggctgatgcctgtaatcccagcactttgggagaccaaagcaggagggttgtttgagtccaggagtttgagaccagcctgggcaacatagtgagatactgtgtctacaaaaaaatacaaaacttagcctggcgtggtggtgcacacctgtagtcccagtcccagctactctggaggccaagatgggaagatgcagtgggtcatgattacaccactgtattgcagccttggtgaaagagggagaccttgtcttaaaaaaaaagaaaagaaaaagaaggcatacaatatgtatgtatagatttgcgtgcacacacataatgatacttttgataagcttaattaataacaggctaagcctccagtgattatattattgtcctcaaggagcatccctctacttaatatgtcattactattctaaaggataaacatatctaattcaagagaatattaatctttgtcaaatgtttgatataaaaacattaattttcctgtatcatcattctccatatttttggcaattaagagagaaagctcataatgatggtcaaaaaatagctttaaaaagttggtggtagagttagaagactatgttttgtacactaggatttagcctttttccaaaagagaccagaagaagagattctgccatttcctgactgagtcatgggtcactcgaagaaactgaacctatttatctattaatatttcaagcagggtaggagtcaatacagggaattaggttgtaactgttaaaaggactagagcagcaaatgaatggtggaggtgtcggtgtttcctagaccagtaactgcaggaaactattacttctaatgccagagtatgtcttcgtcgccccaccacggcctactcagtcactacaggagaccagcgcctagagcttgtgttacaagactctgtacaaatctgctgctgctattgctgccagagtcaaagacaaatggattctgccatcttccagttttgtataagtgcctttgaaagaacctaaacctagaaccttgctggccaaggaatctgagaaatatagtttccagacttagaacccctgtgatcgtgttagatcttagagaaaaataaggatggctctaattaacataagtattcattgacatctttgtatttggtttacataatattgtgtgctgtctgatagtgaagactctaagctgcttgaaggtaggaataggtctcatatacttttataatcccacaaagcgtagcacagtgccttatgcttgtgcagttttcttctacataattatttcatataactgtaacccaaacactaagcatgccttcaaatgaaagatcaatcttctttatcactggtcagttccagagccatcaattaaagaatctgaggccttcttctcattagtccctgaggcaaaagtcaaggaaacttaagactgtattccgtaggattcctgagctaggtcatcagtatattacatttttctacttaaagaatagtattagatttcttacaagatgagggctttggaggcataagtatatgcaggtacgtcaattaatagttgcccaagtgaggccgggaacggtggctcacgcctgtaatcccagcactttgggaggccgaggcgggcggatcacgaggtcaggagttcgagaccagcctggccaatatgatgacaccccatctctactaaaaatacaaaaattagccgggcgtgatggcacacgcctgtagtgccagctactctggaggctgaggcagaagaatctcttgaacccaggaggcagaggttgcagtgagctgagatcatgccactgcactccagcctgggtgatagagtgagactccgtctcaaaacagaaaaagtaaaaaaaaagttgcccaagtgatttcacacttactgtttagagaactgttttgtggtggtgtggtgcattctgtgcttggtgaaacagaggagaaatttctgactcaccctcccagatgtagtggaaaaaaaaaagatcaaaacattctgtaatattaagtaataataataacttcttattttttctagtctaacaaatgatgaaatttttttttgagatggagtttcactcttgttgcccaggctggagttcaatggtgcgagctcagctcactgcaacctccgcctcctgggttcaaggaattctcctgtctcagcctcccgagtagctgggattagaggcatgcaccaccacccccggctaattttgtatttttagtagagatggggtttctccatgttggtcaggctggtcttgaactcccgacctcaggtgatcgcccgccttggcttcccaaagtgctgggattataggtgtgagccaccatgtccagccatgaagacaattttttaagagaagcaaaaaaaaaaaaaaaaaaaaagttacataaaacccagttacttgaatactgtactgaatgattttggcatatttccaactggctcactttcagtcattccttgtcttttttttgtgtgtggggggatggagttttgctgtgttgcccaggctggagtgcaatggcgcgatctcagctcactgcaacctccaccttccaggttcaagttattctcctgcctcagcctcccaagtagccaggattaccggcgcccaccactacgcctggctagtttttgtatttttactagagacgaggttttacttattggccaggctggtctggaactcaagttatccactgcctcagcctaccaaagtgctgggattacaggcgtgagccaccgtgcccccacctgttctttgtcttttgtgagtgtttttgcatagatcattgggtcatgagtatacttctttctctttttctttttttttttgagatggagtttttgctctgttccccagtctgcagtgcaatggcgtgattttggctcactgcaacctccgcctcccaggttgtagcaatttcctgcctcagcctcctgagtagctgtgattacaggcacctgccaccatgctggactaatttttctatttttagtagagatggagtttcaccatgttggcctggctggtctcgaactcctgatgacctcaggtgatccacccgcctgggcctcccaaagttctaggattacagatgttagccactgtacctggccatgagtatactttttattgctaggtaatattttgtaatattttactaattaggtccgccatagtttacatttccttatcgttgaacactcctcatttgccattacaaataatgctgcctgacatattgtgcctaaaatttttcaggcttttgatcatttccttaagctgaagctttaggaccagacctttttgggttaagtaaattaaggatttatttttctttatatttcaaataattttttaaaattaaagtataacacacatgtggaaagtacacaaatcatacgtataaagctcagctcaatgaatatttataaattctttcacataggcagcatttgattaattgccagcacctcggaaactattgtcatgccttctcttggattagttttgccaaatttataactttatataaatgaaatattactgcatatatgtttttgagttgggcggtttattttcccctcaacatcatgtttgaaaggttcaaagatgttactatcactattttgttatatgaatatactttatccaccctaccatttttgtttgtttgtttgttttgagactgagttttgctcgtatagcccaggctggagtgcaatagcacaatctcggctcactgcaacctccgcctcctggtttcaagcgattcttctgcctcagcctcctgagtagctgagattacaggcacccgccaccacccctggctaatgattgtatttttagtagaaacggggtttcaccatgttggccagtctggtctcgaactcctgacctcaggcgatccacctgctttggcctcccaaagtgctgggattacaggcatgagccaccacaccctgcccatgcattcggttttaataggaatcaccaaacagatcgtgaaactagttgtacgtttttatactactactaaaattgcatgaaattgggtctctctctgtgacccaggctgaagtgcaggggcgtgatcatatctcactgcagcctcaacctcaagtgatcctctctccttagccttcagagtagctaggactactggcacacaccaccatgcctggctaatttttaaattttttgtagaaagatggggtcttgctatgttgcctaggctgatcttgaactcttggcctcaaccattactactccctcggcctctcagagtgctggggttatagtcatgagccactgtgtctggccttatcgtaattttaatttgcatttccttctaatgactaatgaagttgacagccttttcttatgcttagtagacatttggatatcctctttttttacatttatttattttttatgggcagataatagatgtacatattttcaaggtaaatgtgataatttgatacattcatataataaaatcagggtggatatccttttgaaggacttattcaagtttcttacccatttttaaatggattatgtttttcttcttggcatctaagagttcttttttttttttttttgagtcggagtcttgctctatcacccaggctggagtgcagtggcgtgatctcggctcactgcaagctctgcctcccaggttcatgccattcttctgcctcagcctccctagcagctgggactacggtgcccgccacccgcccggctaatttttttgtatttttagtagagacgggttttcaccgtgttagtcaggatggtctcgatctcctgacctcgtgatccgcccgccttggcatcccaaagtgctgggattacaggcgtgagccacagcgcccggtcggcatctaagagttctttgtatactttggaaatgagccctttgagggttatgtgagttacaaatatctttgcccactctctgctttgtcttttggctctcataatggtggctattatgaatagaagatattaatattcatttagtcaaattcatcttttcatttatgatttatgtcatttgtgttctgatcaagaagttgttttttttttttaatcaccaaattatggagacattctcctacattattttctggaagttttattgttttgtctttcacatgtagatctagattccacccagaattaacttttatttatgctgtgaggtaaagggccacttttcttttatttccaaattactatggaaattaagtcagccatttgtttaaaataccatcttttcccaaatgccctgcagggctgccttcatcttaagtcaagttcccatgtatgcgggctcctttttaacatcttagggtagagcacagatccctatttctgagtggcttctccatgggctgggtatctccatcacctctgctcccctctgactgggctccacaccctgcttggcttcacagccttttatttattgcatgattttagttggaacaccggtaggtacctctcagaccaaaactgtgcagtgttaccatttctacctgatgttttatgaattaggcatgtgagttatgtctccatatgtcgaaaaagactaacatgatgggcttcctcagcatttccaaaaagcttgcatgctgggattttcttttcattattcactgtgcttatattgactcacaaataatttcaagccttctttttagctgttagttctttcttcctcctcctaaactttcatcagagctgtgcaaaaatagagagatggattaatttagtagatttttgtcttcccattacctctttttactgtttgtttggcacagggagttcacaatcaataaaatcatcaaaagtaaaagagctggtgagtaaaaggagcagaagatttgactaatccacaaagtaactgacctcttcttaaatcatttggagccagatttgagagtggattttgagtgctaaggggggtttattttaggaaattgactttaaaatatccattttcccttgctatatttgtatcatctaattttgcttttggaatccttcagatggcctctctcaccagcaagcattagtgtttcctttcttctcatatcctgagatgaacttgcagaaaacaacgcttcatcaaaaaaccgtcttgagtctactgcatttaaaaaataattaggaacaataaaaagaaagaaggataaacattgcacataatgcttcaacaggaagcattaacatcttttaactctgcgctagtcagcatgtgtgcatgcatatttttgctaaaggttaactaaattgtttagtcatttctaatgggtggacatccgtctgctgtacccagctgattaatgtgctagatttctggagagaatggctttaattacttatgatgaaccgagagtggctaatattgtgaaagaaaattgctgtacgaagttcttgacaacccagggagttaacaaatatcaatctatacaagaaaaaagagctcttgattctttgaaatgcagtggaacttagttctataactactattggtataacactagcaatttacacagccatttttccttttattttcttccaaaccatgcagcaaatgttatgaagacaggcatattatgttttaaaaagaagaaagcagagactcagggatttcaaggacttgggcccaaaggcattcaactagaaagctggtaataataacagcgacagtttattgagtcttagtgtttctgagaacttttctaagtactttacacatattaaatttttaaatcttcacattagtcctgtgaggaaggtactattgttatgtctgtattacccatggggatactgacgcacaaagaagtcaagtaatgtatttaagattctagtaagtgcagagcccaggtgcatgcagtgcctgggctctgccacccatgcagtgctgactagggcttccacccatggattttttttttttttttttttttttgagacagagtttcgctcttgttgcccaggctggagtgcaatggcatgatctcggctcaccacaacctccgcctctcgggttcaagcaattctcctgcctcagcctcccgagtagctgggattacaggcatgcgccaccacgcctggctaattttgtatttttagtagagatgagatttctccatgttggtcaggctggtctcaaactcctgacctcaggtgatctgcctgcctcggcctcccaaagtgctgggattacaggcatgagccaccgcgcctggcccttccacctgtgtttttggcttcaggtgtgggactcttgctgcttttcaacagtgccacacaataatatagctaatgaggatgtctgcggattgaggtagcctatgcttcagtcatgggtcctcaagtgctgtgtttctgctcagtgaataacagtggtggggattgaaagattccttgagttaatttgaattcaaatccagttctattccccaccccgctttgtttccgctctaccagtgcagtattttttgttgttgttgttgagacgcagtctcactctgtcgcccaggctggagtgcagtggctcaatcttggctcactgcaacctctgcctcccagcttcaagcagttctcctgcctgtagcgcccgccaccaggcccagctaatttttgtatttttagtagagatgggttttcaccatgttggccaggctggtcttgacctcctgaccttgtgattcacccgcctcggcctcccaaagtgctgggattacaggtgtgagccaacgcacctggccaatttttttttttttggagacagagtctcacttagtcacccaggctggaatgcaatggtgcgatctccactcactgcagcctccacttcccgggttcaagcaattctcatgcctcagcctcctgagtagctgggattacaggtgcctgccaccatgcccatctaatttttgtatttttagtagagatggggttttaccatcttggccaggctggtcttgaactcctgaccttgtgatccacctgcctcagcctcccaaagtgctgggattataggtgtgagccactgtgcccggcgtcttcctgattataaaaaggactttagcatgccttaactctccattaaacagcctcctcatcttgtttttgttgcctggaattttaatggcccacccacctcctttttttttgagacagggtcttgctctgtcacctaggctagaatgcactggcacaatcatggctcactcagccttgacctcctgggctcaggtgatcctcccacctcagcccctcaagtagctgggactacaggtgcatgcctccacacccagctaatttttgtattttatgtaaagacagagtttcgccatgttggccaggctggtctcgaaatgctgggctcaagcagtctgcccacctcagcctctaagtgctgggattacaggcataagccactgtacccagccaactttcccctttttaacataaaaagttggttattaatttttaaatcaatcaaatgacatctggtattttactgatttatttgcttctggtttcttatatcccataactgttctttggcttcaccttttagtttattgaaatacatcctttaatatttacttttgttttcagtttaccatcatttttcttaggtctttttttctttttcctggaagaaaaattataaaattgttatataatatttgatacatatgaaggtgcacaaatacacacacatgaacatacacctacaaactgtaggtatgttatgaaccataatagtaagtgaattcaccatagacatttccaatagagttcactctacatgtataaaaacctcctacttccttcccagaggtaaccactagtctgaatatagtgtttctcattcttttgccttcaaaaacatacatactaggttttcaaaaataggtttcaataggttttttttttttttgagacagagtcttgctctgtcacccaggctggagtgccgtggcacaatctcggctcactgcaacctccgcctcccagattcaagcaattctcctgcctcagcctcctgagtagctgggattacaggcacgtgccaccgtgcctggctaattttcgtatttttttttttagtagagacggggtttcaccatgttggtcaggctggtctcaacctcctaaccttgtgatccacccgcctcagcctcccaaagtgctgggattacaggtgtgagccaccacgcccggcttcagtaggtttttaaaataactgtaataggtttaagatttgcttatgtttaacttcataaaaaatactgtcaccttgtgacttgccctttattcagaatcatgtttctaagacttagtgttaccggtagcagcagtttttctactacagctgtggataatattacatcatttgcatatactacaatatatttactcattctcccataagtagacttttggtcatttagatttttcctatcagtagcagtgtcattatgaacactgttgtttgtgtatgccaactgatgtgcttcacgagtttctctaaggcatgcaccctggagtgaagctgcttggtgtaaattatacccacgggcccatcaggtatcaaactccaggcaccattggctcatagctctggattccagcagcctgtggcttagctcctcctgccagttggcctttgtggtctgtttctggtccatgatgaggtttataatttttgtcccttgggatttcccttttaccctttgcaataggtttggaacaacagggtctgccacttgtgaactcaaggcatattcatgaaatgaagtcaccatcatttacttcttcaaatatttagtggtcagaacagaggccgtttctggaattataaggttgaattcttcatacgatgatgtagctagattttttacaacttggtttgtgtgtaaggaagcaggttcttttccctgagtgtaatgtatatcagcacttttcagtgagggtgattttttttttttacccaggggacatttgtcaatgcctagagacatttttggttgtcatgaatggggtaggtgaaggtaaaactagcatctagtgggtagaggctatagatacagctaaacattctacaggacattgaacagggcagccccccacaacaaagaattattgagtcctatattcatagtattagggtaaaaccacaaccaaaaccctacaatgtataggacagcattgcacaaaaaagaattattgggtccaacatttcaatagcgctagggcaccctgatgtatgtgaagatgatcagtcattgtgttctgaacgtatgattctaacactaaaatttgggccaggcgtggtggcgcatgcatgtcattccagcactttaggaggctgaggcaggaggattacttgagcccaggagtttgagaccggcctgagcaacatgataaaactgtttctacaaaagataaaagaaatcagctgggcgtggtgacatgtgcctgtagtctcagctactcgggaggctgaggtgggaggatcacttgagccctggaagtcaagcctgcagtgagctgtgaccatgccattgcactccagcctgggcaacagagtgagaccctgtctcaaaataaattcatatttaatagagtcacaacattttttgctttttcccccatgccatgtctttggaagtgtgtgtttggaatgcccaggtaatacagctagtgaattacttgcctaatttagatcaaagtatacaattagtgtgaaaagaaagatgaattatcaagaagtaacgcaggctatatgaaaaatagcagggtttaatttctatttctgtctgtcagtggaattctgtaaacgctagtggacattcttcctgtcctagcacgacttctcttcccagccatctcaagctttgatcaggaaggagaagggaggcattcctacacgcaccagaacagtgcagtggggagttggtctgtggatttcgtggaattttagaaaaaaaaacaaaaagcaacaaaaaaaaaaaccagagcacatctcccactacttactgggcccggctcagcaatagcattacccagtaaatatggatgaatggatgatcaagagtttccgcagtctggtttgcttcccttcctgttccaggtctttctttgtccatgaactgctgaaacctgagtgggggcttccacaaagggagagaaagggggatggagaaggagggaaaggcagataacagccgaatgtaatcagcattttattactgtcctcaggaagtaggaataggaaaaaagaagtaggttggagcaaggaaagttaattatgtgaggttatttgacaggaaattactaaatacaaacagacagaagaaacacattttaaagcaggataggaaatctcaagttactccactctgtgcattcaaaacccccaaagcaaattctgaaaatagcagtttaaacaaaagctatcttatctgataaaagtatttcaaacacaaagggaaatttatatattgggcaggcaatcttaaaataaaccgattttgttgatagcactgcaaatgtaattgtgggaaacccccttctgatgtctgaatttatcttgtagatgttttgaatttggcatttcagttctataaaggtatatgtgtgtgtgtatttcaccttggaaaattatatatatgtgaaataaaatgaaaagtttattatgtttgtgttttttttcagtattacaaaattttgggggagttaggtattattaatagttccagaagactgttacatcagtacagccagagaactgaggtgttctctaaaatctttatttctggaggtcatatattttaaatgttttaattgatgtatttgattaacataatttttttttattgcttttcagccattggcaaaattcgtagaatctttgtaaattatccaaacatatttggtgttgttttaaagactaagtgattaaggagtaggaccttttcctaccctgaatgatttctggttctttaatggcctatgctaaatagtcagtgttgcagacatagaaaggagggtcagaagtggctgttcagtaatctgacccttttaattaaggttgtcatcctaagaaaaaagacccaaataacaaaaaacaccaacaaaatacatacatatatgcataaaggggcacacacacacacacacccatatttatatgtagcttttccaaagaaaaaaggaagaaactttattttctagatcttgatagtaggattctctaaggattttttaaaatagttgagatattgaagagtcatatcatagaaattgggtggctgtaaaattgcacagtctgtggataaagttacacattccatgttagttcaaagaaaaagcaatattttgaaaacataaatggagctcaaagtctgcattccttttaaaaggccaacacctgtggaaggaatgcaggttgttcccacttgaccttcaactgtggagctgggctaggtacttcagatgttatggtggtcaagtaggaacctctctctgcagcagtgtctcctgggacagcacctgtcctgtctgttgtcaggaagccaacatatggcgacagctaggaataatcagagagtagatcctaacccttgctttgaggagcttgctttgtataccacgaagtctcacagtgatggatgagtgggtgtagataatgtgcaataagccataacctctctaagcaatcaggcttacattttgcaagtcctgggaaaacctgggcagacagtattagcacactcagactgagtcctctgtgtgtagtagttgaagataaagacatcattgatgttccagacagattctcatcatgcataaataattccttaggacggaattaccatagttgccttgagtggcacttcccctcctttaggccactcacattagttcagcagtttattgtggcgtctgaagaatcaaatgcacaattcaacctcaagaagaaaattacaaatagcatattctttttgaaccgtgaatgtattcgtccacacaatatttgatgggaaagagatctggctcatttttgcttttttcattaattctttgtttattcagtcaatatttcttaattccttgatatattccaggagctgtggtggaggcagagaatgcaatgtgaaaagcaatgcattagcaggcaaggttgctacttcttagaactaatagtttactgtcatatggtcatgcctcctctatgccctagctttgtgatcttgggcaagtgacaattcctctgtacctcaatttctttggatacattagagtgttttttcccccaggtggcccttaagatcttgttcagtgctagtctttttcggatatatactttagttgttaaattttttttttttttttttgagacggagtcttgctctgttgcccaggctggagtgcagtggcgtgatcttggctcactgtaacctccacctcccaggtttaagcgattcttctgcctcagcctcccgagtagctgggactacaggtgcccgctaccacgcccggctaagttttgtatttttagtagagacggtttcaccatgttggccaggatggtctcgatctcctgaccttgtgatgcccccgcctcggcctcccaaagtgctgggattaaaggcatgagccaccgtgcccggccagttgttaaatatttttatctccatatctcgcttggtgttctagtgagtgactgaatatggtggaactgggtagatcagcttagatgtttatatgcaggttagaatcattgctttgatttctaactgaactagttaccttacttgagtctataccacctgggtatctccagcctgtttgactggcttacatacatatgccgtttcctaagactcaagctcactttaaagagaaagcatgcatttccttctattgatgctggaaacttttcaagcagttctgaggcatggtcttcaagacacaaaagatcattgttacatgtgctcctttgctgagacactagcccatggcaattgagttgtttttagctcaacttcagtgctagcagacaaaactatgcttaagacaggattattgaaacctggaccttccacaatttaataatattggtaatgttgatgaattcaactcctgcttatatcatctgtttttgtaaataaagttttgttggaacacagccaggtccagccttttctgtactgtctatggctgcttttgagctgtaagtgtgtgactgagcagctgaaacagagactgtacggcccacaaaactgaaagtatttgccatcctgcccttaacagaaacatttgctgacacctcaattataggataagcaaagcccccaaccctagaatttaaggtgtgtggaaccataacacacacacacacacacacacacacacacacacacacgtatttttttttttcaggaaacagcttatttgccttttttttgcaaaatgcttctgagaaattagccttgttaatgtgtaacttttttgatgccatgctattgagatagcagcattggatactaactacatacctcacagattttactcttttgaaggagtttcagtttccgtgggctggattcgtaagtgaactgatctgatgagaactctaagttattgctaaggcattttttattctgttaaatatgatcctgtggagcctgaggtcctagctttctttacacttgagctgtgaggagagatgtgacaacatttcagagacatgtaagctcttggagacatatttataaccttcctccacctttgttctgtgtttatagtggacagaggtttagggctggtaggttgtgcctgcaggagtgctgaacttgaacttagagaaagctggggtcagtcaaagaaagtctaaggtcagaggaaatgaaggttaatgaggccgggttcctgccctctaggggcttacatgctattgggagtgactgattcttttcctaaaagagtgataaatgccctcaataagacatgcacgtggaatatgagaacatggtgtggaggaggagagtggagatggggccattcacacggggagccacagccaaggcttacatgagcttatgtgcaatgtcatagaactacaaaagctgagaacaagcgagtgtcagggtggcaagtggacaacatggagggaacatggggcatttggcctttggcattttctcaggggctcagaattggtttgcacggatgggtcagtttcactttaaagggtttaaaggtgaggaatagagctactcagtaaatgtttacaacaaccaaatacattaagggggagataaataggttttaggaccaagcagggctacttttatgggttcaaaggacctatgatgaccagtcctagcacataataatttctaaataaacattggttgatttaatacataagctctttggtatttgaaatgaactactgaaaaattggcatttttgacatgaggcttcatgtttgcagccaaatgactggaaattctgtttctccacatgtatcgaccatatgctagatactgcgctaaggtcgggggaatggaggtgaacagggctcatttcctgccctttggggacttacatgctgttgggaatgactgatactttcctaaaaaggtgataaatgccccgaataaagcatgtacatggaacacaagcacatggtgtggagggacgcttatttggaggaggagagtagggacaaggccttcagaaaggactcctggaggaggagaccgccttatcctgctctgccttttggtgctattgcctgaatgtgtccctccaaaagtcatgtgttggaacctaatacccaatgtggtagtacggtattaagaggtggggcctttgggggaaatgataaggtcacaggagttttggcctcatgctcttacaaaagaggctgaagggagctgccttgcatcttgtgagatgctgccatgtgagaacgcaacaaggaggcccatctgtgaagtggagagccagccctgacctgacgctgaatctgttggctccttgatcttggacttcccagcctcaggaagtgcgataaatcaatttcttattaatttaattaattttattcactttattgtatttagagacagggtcttattctgtcactcaggctggagtgcagtgatcgtggctcactgtggccttgacctcctggggtaaagtgatcctcccacctcagtctcctgagtagctggggccacaggcacatgccaccacacctggctaactttttaattttttcatagacatcaggtctcactgtgttgcatgggtttgtcttgaattcctgggcccaaacaatgctctgcctcggcctccaaagtgctgggattacaggtatgagccaccatgcctggccaatttctattatgtataaagtattcagtctagttattttgtgatagcagcaggaatgggctaagacactagggatgtccttttccttagaaagggaggtatatgggaagcctgcgtacaggcctctgaggatggaccttgggacagaagctcagacaagggatgttggggaagcctttgcccaccatagtctgactttacctgctgacagtctatccctaagctcagtcctttctgaaagagaagagagcccaactgtgtaagacaagcagcttccattctaagagcaagacagtgtaagttctgtggaattgtgaaaagcgaatgcagccccgtcggcagtcaaccagacagaccactgaagctggggtgcagcccacaacccctccttcctcagaacctggcccagctttccatgatgggttctgttcctttctttcatagaatccttccctttttcccaagagattttataattaatagagatgaagaaaggcaggaaatctgtgatagagtacaaacttccacacaggccagattaaacacacacacacgcacatacacacacagcagcccacaaagtaactcagtctggtgggaagagatcaaagggcagccatatgactgggctggcaaagggctcctttcccaggcagtccacatcctgccccttagtagatgagacaagtcaaaggaggaagtgtgcagtacagtgagtgagtgcagttctcagggatatggtcttagttcaagggctccaggagtgtgctgtgagcatgggaatgataagctcacatctgcttgtattcataaacagctccaggaggtgcggttttaaattaccaccctaccactgctaaacctcctctgtaatcctataaagatgtcaggtacagatagaccttggaagggcagagccctatctgacaaccctgtatcaaatagctggagagcctgaggattgggttgcaacaggaataccctaatcttgatttcattgtttttcctctccctaaaagggtgggattggatttggaggtgggaggagaatctgcaatggagttaccgacaccatgtaaggaaaaccttggaggctgctattcccatttggagggatcagcaaaaaggccagcagacaagcctgccactattcgtaatccttcttgcttctgctggcgaatccttccaaggcaggcaggcaggcagcagcagctggggtggagggactgctgtcctgatgaaggggagctgagtgctggctttgctgtgctctggaattattacctgtaagtgcaagcagccaggtgactgcagctgtgatggggggtgtggagaccccgcccatgccagctgtcagagccccaaacagccaggacagcgcacgggatttatgcttcctctccggcctttcaatgcttctgtagatatacttagcaattacaatgctggtttgggaatttccctcggatgagacaggacttgtttccaaaataacacctttcaaagcatgcagagacttttagaaattagataattgtgtgatatttataaagtgaattacgttgtgctaacaaagtctgggcagatggttctgatgctgaagtaaataacaccttatgattcattaaggttgggaaaaaaaggatttttaaaaagttgctactttacagctgagtctttgcaagaaacttagacaactcaccaagtaggcaatacattttcaaggtaaaatgttaatgtctgggtgtgcgtggcatggttaagttgtcctgtttcactcataacacttagtgagcatttaaaatatgcttatccctggatgcagagagacacaaagatgatactttattgctcttgtcctccatggattctcagtctagtgagggagacagatgtataaacagataattgcaatacagtgagctaagtgctaacagaaggatagaagaaatgccataatggtgggagggatatcaatttacagtgtgaatggagaagagagaacagcctcacagaggagttacatttgagcagtatgtgaaggaagaggaaggattttgaaaggagagaaggatgttgcctctttgtggctcctcattcaccagcatcttcataccccagggcctttgcacattcgtattcacctttggttcctcttttttaccagctccttcttacctagggccctctgcctggaaaacttctttcatctctcttacctggttcaatcccttagaagttacatcccatgttaactctttcagggaggtcggacttctctaagtcaactctattataaacgttcactcatcaagtatctcatctttagagcagttatcccagctgcacttttacattattggcatgactatttgaatgatatctgtttttcccactaggcagagcctgtctctttttatttgactttgtttcttgactaaataaacgttcgttgaatgaattagacgaagggcgttccaggtgtgaaaacacatggtatgttcagagaacagcaagtattatgttggatcttggtgtatgtgaattaggggaggccgaagattaagccatttaaggaactttgaagatctaaacttctgtttatatactagctcagctaatatttttaagtattaagaggcatttcaaagatctgcctcttcgttattatattatcagtatcagatagtttaagtcaaagatgaagtgttaaaaatgttttttaaagttttttttggcatatggttttggggctcaaatatatgtactttaaaaatgtgattcaagtataacatacatatagaaaaacgcacagcacataattgtacgactggatggattatcacaaagcaaacatatgtgtaactctcatgcaagtcaaggaattgggatacttcctagagcctgaattgtgaaattcagcacgtgtactgcatcagaaatggaagcggatgagctagaagattctctgccagcctctaagaaagtttaagctttggctgggtgcggtggctcacgcctgtaattccagcaccttgggaggccgaggtgggtggatcaactgaggtccggagtttgagaccagcctgaccaacatggagaaactccatcactactaaaaatacaaagttagccaggcgtggtggtgcatgcctgtaatcccagctacttgggaggctgaggcaggagaatcgcttgaacccaggaggtggaggttgcggtgagctgagatcgtgccattgcactccagcctgggaaacaagagtgaaactccatctcaaaacaacaacaacagcaacaacaacaaaaaacccaccaaaaaacaaacagcaacaaccaaaaaaaaaaaaaaaaacaaggacagtttaaactttctgaggaatagaggagagggattctcatataaggtagcccccagttgcttccagactcactcatgagcttaagaaagtggtgtgagagaaatgcaaacctcactagcccctcatccatccccaggcagggctggagcctgaagggtggagggtgtgctgtgttgcagagagacacaagggggaattttttcagaggaacattgaatcctttctctgtcctcaccaggaacactgcctcattggtgtggagcctgggggctgagatcttgtcatcccagtattgtgcaggggacattgacgacttaaccagcttctaagcaactttggggttgcatataagacaatggtgctgagtataagaatgtaagacttgggactgaacgcctgctctgtcacctattagctgggtgtcctttagtcacttttagttaatttctctgtgtctcactttccttattcattacatgcggataataatgtacctcatgtggtggttaggatttaatgcattcgtggatgtaaagtacttacaatatgacctagcagagagtaagcactcggtaaaaaagaaaagctctctagttgaaaaaaccttgtttttgccttataggaatgtggtcgtccctaatgggctaccacagtaatgaggacttttgagagagagactttttggtataataaaataatttcctactgaaatggactgtgggactttgcttgtaaatgactccgccctaatgtatctgccgtatagtatttacaagtttgggatttcatgctattaatagaacaaaccataacatttttccttatttaaaatccagtttctccattttctcgtagcatgtgagcaggataggtagaagaaaaccaccagatttccctcaatatactattttaaaatacttatcaggtccagattacagtggcttttgctgtaatctcagtgcttcaggaggcgaacacaggaggatcgcttgaggccaggagttccagaccgcatggacaatatagtgagagccccatctctacaaaaaattaaaaaattagccagtcatggtggcacatgtctgtagccctggctacttaggaggctaacgcaggaggatcgcttgagcccaagagtttgaggccacagtaagctgattgtactacggcattcagcctgggctacaaagaccctgtctctgtaaacaaacaaacagaccaaaaaaaaaaaaacaacaaaaacccttattgtgtagttttaattgtagcactgaaatttgagggaattatttaaaaatagatcttgacttgctactctttgaattggttgttgtggcattgttttgctagctgttaaactccataaatagtttatacatgattacaacttgatcacatttgtcctataatttcaaggcttctatgattttctgactctaggcaccattaagcctcttcccatggtgatgaccaagactgggggtatgtgtgtatgtataaggattgatggttcacagttctaagtccccactctgtgataggtggtgcacagaacatctcagtacctgtgctgtctgtacttgatccttggcaatgtcgctttttttttttcccctgtcccccaggctggaatgcagtggtgtgatcagctcactgcagccttgaactcctgggctcaagcagtcttcctgcctcagcctcccaagtagctgggattacaagtgcgtgccactatacccagctaattaattttttttttttttttaagaaatagagcctgtctcattttgcccaggctggtcttgagctcctaggctcaagtgatcttcctgcctcagctttccaaagcactggggttctaggtgtgagccactgcacttgcccaagctcactttttaaacaagataggagagtcaatattgtaactttgatagaggacaaaggatgtataaaaggaacaactgcctttgtaaatgatgccaagaacaggatatgattttatagaccaggactttgtatataaaagtgacagagtcatggatatggatgggatgcatctcaggaaaaaacaggaagcatgcatgttggaagggaatgtcactttaatcctcaaggttataagcgcacatttgtgtatatttcgtggggaagggaggctgtgagaaaactgcaagagtgggaaggtaacaagaatgatctctggacagccgccataggacatgtacaaaactgctagaagaaatgtcaaggggaaagagatgaggtcactgcaacctctgcctcctgggttcaagcaattctcctgcctcagcctcccaagtagctgggattacaggcatgcaccaccacacccagctaattttgtatttttagtagagacggggtttcaccatgttggtcaggctggtctcgaactcctgacctcaggtgatccacccacctcggcctcccaaagtgctgggattacaggcgtgagccacctcacccggtctgtgactcagatatttaagccaaatgcagggcttggcttttagaaagggaatttgaaattaatatagagaggtaaatttaattgcttagaaagcactgataccgaggtactccttcttggtaatgaaagagcctatagaagggtacacacatgtatgtatatatatatgtacaaatgtatgtaagtacctatttttctaccatatcagataccatgtacagagatttcaatttattatttaggtctattctgaaaacaatcctgagtatttaatattattagccccacttcagagataaggaaactgagaccaggaaagctaagtatcttggcaacgtgcttaacaccatatagacatctaacagtggtaatgtggattagacctaaggctgtgtaactttaaaccccagattctgtctgttctcttacagtgactctcatttatgaggaggaatgcacctacattaaaaatacaacaacaggctgggcgcggtggctcacacctataatcccagcactttgggaggatgaggcgggcgggtcatgaggtcaggagatcgagaccatcctggttaaaacggtgaaaccccgctctactaaaaatataaaaaaattagccggggtggtggcgggcgcctgtagtctcagctactcgggaggctgaggcaggagaatggcgtgaacccgggaggcggagcttgcagtgagcagagatcgcgccactgcactccagccagggcgacggagcaagactccatctcaaaaaaacaacaacaacaacaacataaatctgaagggagaagcactgagaacagcatttggggaggaataaaagggcaagagaaagaagtgatattatagtagtcatgtcccagaaaaccaagtcagatggagtggttgttgtctgatgttttttttaaagcttgaattacaaacttaacatagtaaaatgagactaaggaggtgagacctccaatgtccagaccattgcaatgaatctcttttcttgctaaaaacagcatgtagtaaaacctggacttgctattcaaacagttttatctcccgaagtttaagtagataacccagaaagtagagcacaaagtttaattttaacaaagaaaatttagaactggttgggaagtggcaggaacctgggcaaaagtagcattatttcaaaaatcagaatgaaaggaaagaagagtaggcataggatgatgtagacctcagatgccgaatgactaagagattttctattgagtaccatttctcatcgggtgtagctttgccttcagtgctcttttgagaagtcttttgagaccacgtccaaactgcataggtaaagttagtttctatgggtgtttgaataaaaaaatggctttatgtgagctaattctgttctaagccattagaagtgagattcaacctaaagaacctaaagaatacatttgagggccaggtgcggtgggtcacgcctgtaatccctgcactttgagaggccgagatgggtggatcacctgaggtcaggagttcgagaccagcctggccaacatgataaaaccccgctctactaaaaatacaaaaaattagccggatgtggtggcaggcgcctgtaatcccagctacttgggaggctgaggcaggagaattgcttgaacctgggaggcggaggttgcagggcgccgagatcgtgccactgcactccagcctgggcgacagagcgagactccgtctcaaaaaaaaaaaaaaaaaaaaaaaaatatatatatatatatatatatatatatatgaaatatattgagctttttagctgaaatgttgaggtattttttttttctttatcacaagccagagctttcccatccgatgcttatgtcattcatttttttttgatactgggtctcactctgttgcccaggctgaagtgtagtagtgtgatcatatctcactgccacctaaaactcctgggctcaagcagttctccctgctcagcctcttgagtagctgggactacagcatgtggcaacatgcccagctaactttttaattttttgtagagatggagtcttgctatgttacttaggctggcctcgaactcctgggctccagcaatccttccatgttggcctcccaaagtgctaggtttataggtgtgagccactgtgccccagccatgtggctcattctcaaacacttgaatgaggaattttccatttgtctctattaaaccccattgtgtgagttggggcttattgttcccttctgtcaagatttgattcagtggttctgacgtgcacagtacggtgctaagtggtgtagatagatcatcaatgcctgagtctcagggaggttgtggtgtagagatgagattaaaaaaccaacaagcaaaataaatgaccataatgggcgttctaggagtcagagaggactagaatacattcagttgtgtgtaatcaagaaagatagccaggcagcttttgtactgggaagatgatgggtgtgagctatcttcctgcccgaaaaattaacacagtgcctggtttatcatagacaaaaacaggtacaaaataagtgaaaaatatatgttaagggaacttaaaatgggtccttttttttttttttttttttttttttttgagacggagtcttgctccgtcgcccaggctggagtacagtggcgtaatcttggctcactacaacctctgcctcccgggttcaagcgattcttctgcctcagcctcctgagtagctgggattacatgcgcccaccaccatgcccagctaatttttgtatttttagtagagacagcgtttcaccatgttgatcaggatggtctcaatctcctgaccttgtgatccgcctgcctcggcctcccaaagtgctgggattacaggcgtgagccactgcgcctggcctaaaatgtgtcttgagggaaggacagagattttatggtttggaatgcagagtattctgaggaaacatgtaggtaaatatggagcttcaaatcctaaagaatttttcaataaaagtgagttatttagtttttatggtatattggagcatatttttgaatcttaaatattagttaacatattaacatttccacattttctgtgtttattttctattaaatgccattcaagttatttttattttacttgtttttttttgagacggagtctcgctctgtcacccagactggagtgcagtggcctgatctcagctcactgcaagctccgcctcctgggttcacgccattctcctgcctcagcctcccgagtagctgggactacaggcacccgccaccacgcccagcaatttagctgtctcaaaaagaataaaaaaaaaaaataaaaggacccattttaagttcccttaacatttatttttcacgtttttttttttttgagatggagtctcgctctgtcgccaggctggaatgcagtggcgtgatctcagctcactgcaacctccacctcccgggttcaagcgagtctcctgcctcagcctcccaagtagctgggactacaggtgcatgccaccacgcccacctaatttttgtatttttagtggagacggggtttcaacatgttggccaggatggtctcgatctcttgacctcatcatctgcccggctcagtctcccaaagtgctgggattacaggtgtgagccaccacacctggctatttttcacttattttgtacagtgcattaaagatatcattttgtatttttagtagagacgaggtttcaccatgttagccaggatagtctagatctcctgaccttgtgatctgcctgcctcagcctcccaaagtgctgggattacaggcatgagccaccacgcccggcccattcaagttatttaagcaaatattgaacaggacagagtaagtagaaacttaaaggtattctttagtcttcagatctataatttgactttgtcacatctacttaattaaaaacactcattgcgggaagaatggtacaacaagctttcatctgggattatttttcttctgcctaaaaggtcgtttttgaatttcttcagttcaggtattctggtgatacaatccctctgactttatttaaaggactctatcttgcctttatttttaagaagtattttcactgggcatagaattcttggaaattattttctttcagtgcattaaagatatcatttctgatatcaaaccttctggctaccatgtttccattgagagtcttatatttgccatttgaaaactctcttcccataagcaccgccatccctgacagctttaaaaaatgttctcttttccagtagttttgaaatttcatttgtctttgaactataatgttctaggtatagatttccttctatttaccttactcaatatttgtagcacttcttttacttgcggcttgaagaaatttattttggaaaattctctcctattatccctttagtattgcttttacctaattctcttctcttttctgggattctaattaaatgtgtatgaaactatgttccacgttactttctgtttttctctccatgctttaatctggatattttcttacatattattcatttttcttttatctctttagctgtatacgatatgctgctggacccatcttttgaatattttcctaccagtagttatatttcaaattatagagtgctccttttgattcattttacatggaatcctttagttttgctgtctgatttattaaacatataaatcacagtttatacttaaatctccttctgttaactacaatatcttacttccctatgggtctgtttctgttgtttcttttctcttgctttttggttaattcttatttttgtaagcaaaattcttattttataaaataagcatcttatttttataagcgtgaatgctgggcattgtgtattaaaatatagagacaattttacctgtgtgtgatgtggatttccttttcttctggggctgggcggacagggtaaggatggatcaccttgatctgtgcagggattaaactgttctgaagatgggctttagtctttgtgagggctgcttctggtttatgcttacttctttgggttagcactttggaatcacagctgaaagtgggggttgcaggacctttttcccttagcaggctatgaactctgatttttgcctgtcctgctctcggaagctgaaataaacctgttcaacttagttttccactgtctgcaatagagtcagcaagtgggttaaagagaagtcaaatgtcaggctcccttctctccacagtcatgacctttcaaatcattgtaccttgatagtcctctaataccttcaagcagaggctgttttaacgatttattttcctggttattttagctcgctgttgggaaggttggtctgatctaatctagcccattatattgaagtagaagttgaagtacttctttaaggcactctaatcctacatgttttgataccttgatgctatgttcaataatttcaaatgccaagttgctgttaacctgtgccatcttgaactcttgtttatcagaagtttttgatcaagctactgaaaattttgtatagccataacgaaaacacctcaatgttatgtcatatgtttgcatttaaagatagtttacaaattttactcatattattgcatttaatctttacaacagtcatgtgatgtcaaatatcatgattaagttctccatggagacttatctgtaattttagtgaataaagaaaatctgtattaatttacctctagttaagtgaatattctggaaaatgggaatgaaaagaagggggtatttgagagcaatttaacaggttaatattgagattaacccgtttgtggaatgcagagtggtgatcattttgcttgggtaaacgacgaggatggttattcttcctttaagtaaaaggagattctattaagaggagaattaaattttggcaggttaataatgaatggataaaattagtactgaattgtgctcccagaagggagaattactgtgggctaaaaagagctttgtggtggagttgagattattattggacgttttgaggaggagaggaaatgagaaggaggcagggcaatcttaggggagaatctaaaattagaaaccactccccctcctccttcctcccctcctccttcctcccctcctccttcttcccctcctccttcttcccctcctccttcttcccctcctccttcttcccctcctccttcttcccctcctccttcttcccctcctccttcttctcctcctccttcctctcctcctctccccccaccacccctttcattaagggcttacaaagtaccaggcactgtgctatgtttgtgcatacatccttatttaattttcaaccctataagatagttaatctaatggtccctattttatttattatttatttatttttgtgagacagagtctcactctgttgcccatgctggagtgcagtggcatgatctcggctcactgcagcctccaccgcccaggctcaagtgattttactccctcagcctctggagtatctgggattacagacgtgtgccatcacgcctggctaatttttgtatttttagtagagacggcgtttcaccgtgttggccaggctggtcttgaattcctgacctcaggtgatccacctgccttagcctcccagagtgctgggattacaggtgtgagccaccacgcccagccagccagtggtccctattttatagccttgtccatttgtcaggcaatgaaaccactgccttaaaatggagccaaccgctgaagcataactttgataatgagattgttgtcaattataggggtccctgaactgagtccaagtgagtgcattcagattttcacctgaagacaactggccatgcaaagtgcaattttcagaagatggtgtagacagtagagtgcccgataggtgggatgctggttgggaggtggagaacgtagagcacagggcacggttgggggccacctctgcagtacacagtacataaggaagtccccctgctggagcggaaccagcaggaagagaaaagatggggctgatgtgagatttcaaagccagaaaagtcaggacttagtgactgtgaagatgtgaaaggtgacggagaggaatgttataaagagggtttcaagcctgggacagaagttctccaaactgttgtttcctgcctctgtccttcctgcattcctaccctcctaactcaacaggtgagtaggtgagcgtctctgtccacgactcctttcagttgctactctcagccaagtctggcctgcagctcccctcaaacatcctcctgccctagaatgttctcagcgattccctcctgtttttactttctgttaagtgtgtatttccaatttagtattgtgatttcctcctttttccctttcccttttttcctttttcttccactcccaaccttcctctttttcattaatttttttttaatttaaaatgttttgaacatataaactcagtactacattgagctttttgggtgcagggaccgtgatttctgtagacttctatttctgtgatccagtactatgtctaacatgtattacatgctgaacatatgaatgaataaatgggaaatcctggggagtgtaccagaaataggtataaagacataaagttcatagcaatatagaagtagaaaccgactatcattgattttattgtcaagaggtgttcttcctttttctcttacaaaaatccatatggatttcagtatatttcatctctgactactccatagaataacagttaactccacaaataatatattttgagacaataataaccaagaagaacaaaatcaacagaacacgctataccataatatttttgatgggttcttcttacagctgattttaccccttctagtccaaatttttgcttgataaaggtcctgctggataaagattctgataagctacaaaatgcccaaatgttggacagtagaagggagggaaagagggaaaacactttgcagaatggttcatttgcttcatggagttgaatatcatcgagtcctagggaaagcctgctgtttttggaaagtggacaaaaagagggattgcatagagcttggaatttaagagagaaactgtggaacaaagatgtaacgacattcattaatttagatctagattgagaatttttatattaggaaaaaaatgccaataaaaacaatttgccgcctcatctgaaatccagcattatgtgcttagaaattactgcctctgatcattagccggcaggcgggccttccccagaggtctgtcttgtggtagggaaatcaaacagccatgctggcagcagttttatccttttctggaaggagattcgcactctcggctttgtgtgtagttatctgactatctcttctaatgctggagtgttagcatgtgcttagtaatttttaagctcctgggaccagactggaattgatttcatctgcaatttgtctagtgacaagcacaatgctgaagaaaaataaatattcactataatttttattagttcatgacccatcataaatcaaagctgtgaaaagagtttaagtagcttttcccaatccctgggattcatagctctctcagttatcacttgaacaaaggtgatagctggacaccagtgataccctgggatggtgagcttaagggaatttagcttttcccttcctgcaagctttaaaatgtgatgtcgttaggagactagggagggtagacttttcagtttaaatctccccttttccctttggtaggactccgaattttagatttcatggatgaataagtaaccttagtgagtgatttgagactagagtacataaaaatgtgtcaatagttcaggatgactgatagctcccttgtaaccaaagccacctgcaattttttatagtcatgcagcataagccatcttgaacagataatcaattctattgcacaaacagtcacttctgttcaccaaggaggcccactttttctctcttcaagcagggctatgaaaaaaataacctatataatccaaatgatcaaaacttctgaaatactggggcacttgtaaagctaggcttctcttccacctctccataccttgcccgtctctttcttttttagtgaaagaacagtggactcacttatgcagctgtaacaaagatcagagagacctgtactgccatgtgcccatgcacacatgcaactacacacacacacccttttagaagagcgtatttcagtccaagtatcgtttcttgcccagcctttgtcagaattttgatctctggaggattaggagaatatttatttatttattttccttacataaaatatcaagtggcattgcggcagcagcattaccacagcagaaattcattcttcttcagctacttcctgcatctcattgagttaaaaagagtgaggatgtgattttgaaatctgaatttgtaaagggtgtgaggtcttcactgaaaatatgattgtgaattaaaggcttttgattaaagtagacttacagataaacacttcatctatttttcctcattcattaaaataccattatactgtatagtctggtgctggattttatattcattttttcaatagggtgaacacagtatcatcatagttgccattagattattcaatggtatttatatgcaaactaggtcattcattcattttacaaatatagtttgagctttgaacaggtaacaggcactgatttttaggtgctggaactggggctacagtattaagccagacaattaagtccctactttaggagctgacatttgaagatgtaggttaacagttagggtctaatgattaaagatctaaaattctcttagtagcagctgggtctctaacaaataatgattatggaggaaccactaaacctcagaatttagtaaagacaaaaacattggtagtaaatgattctggcttgttagttataaaatattattttcagatctagattttggcctaaatcgtgattattgttgcttaaacttgggcacttttgcactagagatcaatgtcaaatccaatgagtcataacctttctggtgtctgaaagaaagcttggaagccatatagagctcacgtgttttagagtaaagtcaatttggggatatgtttgattttcatgtcatctgtcccctaaaaggacccttaaaggttggcccaatgactgggccaaccactacccccttctcagtttgagtcactgttttcgggtatcatggtggcctaaatagcagttcttaaagtttggttcataaacccccggggttccttttcagtggatctgcagtgttgatgtattttcgtaacaatactaagttgttatttgttttttccattctttttctttcacaagtatacagtgaagttttccactgtatattcagaacccctgtataactcagcaagtcgctatttcctaaacaaccgatgatcgatgttacaaaatgatatattggtaaaagatccattcaaaatgctagataaattaatgggttttaatatatcagagtatgtaaagttcactgataggtgttccgattcctatacaaacttccagttgttgagtttgggtgtagtatcaaagaaagaatatccacaattatctgaaaggctatttcatcaatcctgcatttgccaactaggcatttgtgtgggaatgggttttctacacacatcaaccaaacatgatgccacaacagattggatgcaactatcttcagttatgctgggcattaaaaaaacgcaaagtaaaacagtaccactcttctcactaaatgttttaggaaaatctaattatcccttataaaaaaatatatattatttatgttaacagtaatgggttataaattcttttttggagacggagtctctctctgactcccaggctggagtgcagtggtgcaatgttggctcactgcaacctctgccttccaggttctagcgattctcccacctcagcctcctgagtagctgggattacaggcatgcaccactactcctggctaatttttgtatttttagtagagaagggatttctctgtgttggccaggctggtcttgacctgctgatctcaagtgatccacccgcttcggcctcccaaattgctgggattacaggcatgagccactgtgcctggcccatatattcttttttaaggagtaacaaatattaaacatttatcagttttaatttgtatcatgataaatgttataaattatatcatgagatatgatgtacatgaactaaagcactttgaagtcctcaacaacttatttatttatttttttttgagatggggtcctgctatgttgccctggctgatctcagactactaggctcaagcgatcctctcgtctcagcctcctgtagctgggactacaggcatgcgccactgtgccctgcctcagaattttttaagattcataaggttatcctgagattaaccaatttaagaaccgccggtctaaagcaatgtgttagtaaatccatcttccaggaagctgaagcgtagagaaatttgcgctagttacattccctggggtctaggatctgctcccagttctcattttgaagcagggtttcgggaagtataagtcaggtctccttaatggctcggggcttcctgttctgtgtgcagtgacagaggataaagacaaaaaggctgtagtccataaagtccatttttaatttccaatcttatatgccccaaagtcatgaaatcctctaggataatttctgagtttcaaaccacagctactgaagatggagcattttacaagggctgcatgacatttattcttcttggaagtgcagcttgcagctccgcatgctaaaaggaaatcaaaactgcttatctgaaacatcttttatcatccatttggaaacgaagaattcagcctgctctgcttccacccctgtaggaagctacaccaagctgacttctcagtctggacttgttctcaaggtcacctatgtaattttttttcaaagcttcagtgtccttagtattctcagagataatagcaccaaacccatcagtcatttccttgtcctcaattttctttttggcttcctgcaattttaatcccaagtccttgcaattcctttctgtagaggcttaagtggccccatttatgaccaatttacagctaatatttgattcattcttttaaaataagccaaacagtcctctgctctacaggccttgtagctttggacttaataaaatcaaaggcctgatagtggggtaaactgatatgctttttatgattttcgaagaaaaattaagagatccttagaaattggaaggaggtagatatttgttaatttcagaatctagtgctgttgttaataaagggaaagaaatagctctttcttctgtattgcacattgaaccaatttttataaagcggggagagggaggggtgaggaggatagatgagtaaagaaatcagaaatttttctggggcctgcttacttgtaacctcctttggatgccttatctctggccccttctgtaagctgatccagctcatgtcagcatgacacatgaaccatgcaaagcttctttttaaagagattttaattcctgcttgacaggctaggctgaagcccatgagtgacaatagatttttttttctcttaaaacagagtgaaagccacagtgcacctggtatttcattgaacaccaggttgtgtgtgtgtgtgtgtgtgtataatatttctgggaaggaaaaaaacagtttaaaaacctaagtaataaaatgttcagtttgccaggagttatgctttaagaaaagatatccaccgtttttggcctgcctgaagactgtttatgcccttaaatctgttttaaatcttttaagagttttatcactttcccccttcttgtaaaagtagctcattgctttatttttttattctagtctgaaattgcatctttaattatctcctgtgtggtaaagtatcaaactctcacatttcatgtgatgaatttcatctcttatacccaagaagtttgggggaactgactatatccaatatcttgggggagaatagctagaaactgggaccatccttaagcattgtatgaggcccaatgcagaaagacaaggaagtactttaggagttgcctaaatgttctcttgcaaatataaaatgagctttattttatttatgactgcctgagtgagttcggacagctataacaaagtaccctagagtgtgttgcttataaacaagagaaatttatttctgattgttttggaagctgaaagtctgagatcagggtgccagcatggttgcattctgatgagtgccctcttcgtggctgcagattgtcaacttcttgtatcctcacatggcagaaagtgagtgagagctttctgggtctcttttataagggcactaattccattcatgaggactccaccctcatgccctgatcacttcccaaaggccccacctcctaataccatcacaccaggggataggatttcaacataggaattttgggggccagagcattccatccatactaatgaccatagcacatttgaaatagctctcactttccactggtattgcgcattgcgaactactcaaaggactgaaggtgatagggatgactccgataatggaggtagtgatggtggtagcatgatgaaggtggtggtaataggggcgtcttcctttatcaaatggggcactggactttgtgtgaatcacttcccatacttttttctcatttaatttgcacaccagctctgagaacttaggtgtcattgtctccattttacagatgagagatagaggcttagagaagttcagtgacctactccctcccaaagccatccagcccagtaatggtggagcaggattagaatttatactgatgacaaagcccagcctcataacccccactccagaggtgcttgtcttcctcaggtataggcagggtagggatttaattcctctttcagggaaaactaagaccccaaaagcttgaatgatgcttagtgatacgcttaatgtgaatgaacttggagccagagtggaaagcatcttaccatgctggttcaaccagcttctgaacagaagctgtctatgtacgtcaaagggaaaggagccacttgtaattgtatagcacacctcaggagtagtgttttcacaagtactgtcttgatcttcccagtgcttatgaggtaggtaggtcttattgtgtccattttgcatttcttcttacctatactctgttgctggatgctaattatgatgacttggagaaattacagaatactaaagtaaggaacagtttctggttatatgaactatttttatagttaagcatttgagtgtttttattaatgttctcatggaagatactgtttcttctagtgatttgaagtaagcttgctacattcatgtttagacatttttcttatgggtgcttgtgacattacgtacttctcagtggtcatattttaaaattgtatgttataatcaggcacggtggctcatgtttatcatcccagcactttgggtggctgaggtgggaagattgtctgaggccaggagtttgagaccagcgcgggcaacatagtgagaccccctatctctccagaaaaaaaattctttttttttttctttttaaattagctgggcatggtggcatgtgcctgtggtcccagctacttgggaggctgaggagggaggactgtttgatcccagcagttccaagatgcagtgagctatgattgtgccactgcattctagcctgggtgacagagtgagaccctgtctggaaaaaaaattgtgttttacttttgcaaaacattttcaaaagtaacattgcataatgatctggaaagtcagaaactccagggttggattgtgctttgctactgattaattccgggaccttgagcaagacctgtgacctttctgggccccactttccccatcttcactataatggggatgggtgttcagtaaggattcactagaatgtctttgatctgttttgaaagagccacacatggttcttaaagcttttgttacccaataatatatacatcaaaaaatttttgtagtaaagatgtgaacaattgtgtgtcctatacacattgaaagatgacaagccattggaagactgctttaaactctggtatctgctatggccagggagtgagctgttgtgttgataatttagcctgattatattttgttcataaatagattaccaattcttaaaaagttggtattgccggccctccttccttccttcttcctttctaccttccgtttgtcaaaaagccattaggcaggtctcagcaaggagacctatcagggcaaataagtaaatatactgaagataatgggagccagacttcttactgttggagaatagttacagatataaaaaaggggagagccagaatgaaccctgtattgtggataggaatttaaggtttcattgtgaacgtgtggattttgatatgtagaaatttcatagatatagaaatttcagtgtagaaataatataaacgttaaagtgtatgcatgtctatgaataaatgcacatacacacatacacacacacacacacacacacacacacaccccccacacacacccatttcctaactctgttcactgaaagggccaggatgtagtgacagcccagtaaatatgagcacacctgctacccagattgtagtttctaaattccagtttttgcttaaagcaactatgggtctttgaaaaaaatgtctggttctagagctgggaaagaaaaggtacaagatgagccctgaatgtcttgtgacagaagatatagaaactctgaaagaataatgggagacgccacaaggacacagcagtcagcttcaagggattctcactaaacccatgtgaaacctggaacaatttgagcaccagaatgacaatgatagttacagattacatcccactaaacaagaaatacatgaatctacacttgcataaataaataaatgcataaaaatgtggggagaggagaaagttcttccttaaaatagaacgctgtgtgatatacagaaggaattctggaattggagagattaccatggcagtcatcatagtaataattaatccaggtaagaaacatcaacggatgctaacaataatgaatacaagttggatgaggatcagaatctttatataatcataaagtatctgtccacaaatccttgtgcattttaaggggcaacacaggagctttactggagaaacttggaagacacaaccttactcaagtgatcaaagttctcatcagcagtgatgggacacacagtgttctatgtcacttgatgggatgcaatgagaagaacacagcatctcttccaaacaatgcaatcttcagatcttttcatgagaaaatatctctaatcctagttcaggggcgttttacaaaataattcacctgctgccttccataatataaaggttgtgaaggtcaaggatactattccagatcaaaggagatggaagagcgatgacaactaaatagaaagtgtgatcctgaaatggatcctttgactagaaagagcattactgggaaagttggcctaactcgaattggggtctcccagtgaaggatacatgagagttctttgaacagcttgtgcaacatttctgtaagcttgaaattcttttgacacaaaaagtaagacataatttgtacaggaaggcttagcttttagttttaattttacaaagttaaaaggaatagtttctgaattcttttttattttggatttttgtaagaatcctatggggtataattattaaattagacttttagttctggatttctgtggtggttgtgcagagaagaatattgttttatgagatagggacttttctggatgtgtgatatcatttgtgtaattacggaaattcattcagatttgactgggaaagcagttggaaacttggagtgtcttaaggccattgttagatatttatgaggcattttagattaatgggattatgagttggtgttctggagtcatgcttcctgagctcaaatcctgcctccaccacttaccagtgtgtggctttgagcaagtgaactaacctctctgtttcttacatcatctataaaatgtaggtaaccatagcacctatctcatgtggctattgtgcagaccatctgattaataccggtagagtgctgagaagagtactggcttagagtaaatgctatgtcgttattattatcatcattatatattattgctgctgctgctgttactgttacaatatggatataatttgtgtagcacagggaggggaacatcacacactggggcctgtcagggagttgggggaaaggggagggagagcattagaacaaatatctaatgcatgcagggcttaaaacctagatgacagcccaggtgcagtggctcatgcctgtaattccagcactttgggaggcgggtggatcacggggtcaggcgttcgagaccagcttggccaacatagtgaaatgccatctctactaaagttacaaaaaattaaccgggcgtggtggtgggcgcctgtaatcccagctattcgggaggctgaggcaagagaattgcttgaacctgggaggcagaggttgcagtgagccgagaccgcaccactgcacttcagcccaggtgacagtgcgagactctgtctcaaaacaaaaaacaaaaaacaaaaaaaccctagatgacgggttgataggtgcagcaaaccaccatagcacatgtatacctatgtgacaaacctgcatgttcagcacatgtatcccagaacttaaagtaaaatttaaaaaaaagaaaaaataaataaaaaggacatttccaaagcaaagaaaaaaaaattgtgtagcaaaggctagagaaactggctaagagaaatttcctatggcaatttgttggaagtttgattctttctcacgctctgatgatagaaaggccgtaatgccattgattttggatactaacactgtgtactgatcctttaagatgctttcttatttgcaaagccagcttccacgcccaagcacaccttagagtttctttaccctttatacaggcaaaggcacacattttaaacgttcaagaagaacagcagaaacaagacaggatcaaagcaaaatacaaagaaaacaagattggagaatcagagaatcaagatccaaggaaaaatgtttactttggcagaaatacctagaaaatatagtgactgcaggccttgtttcaagttcacatattgaatctcaacatgtttacttatttgcaagtgtaagtaaatgtatgcagcacactgagttagcaaacatgggatatccctgaaggagggagatgtacagctcatcagtgttgtccacagtgcacccagcatcctaccacttgctccgggctctccagcctgttccttttcctgaaagggcttccagtcaagctcatgctatattattatatataagacctagggaatattgagcattatgcatttttatttctttatgctttgctttgtttctaaaagggttcaaatgaacaaatcgaattgtctgttatcctaagaaatgctaaattgtccagaatagacctgcattaacaaagtgtaaagtgaaacaagagaccagttggcagagagagaaaagagagagatttcgactaaagcctagaagaataggtaatgaatgactactcagaaagaaggtaacagattggtgatggaggaggtcaggggtttcacagtgtatgcttcttttttacaactaaaagcacatttctggtcatctagcccaaaagcctaagtttttaggcacaggagagtttcagatatgtcgtgaacacatagcccattgcttggtcctctgtctcaaatacccaggttgtctacccttgattcagtctcttgtcactatctcaccctgactatagtattttgaattttagatgacatttacatatttttgagaagcactagcaatcaaatgggaataaaccatataggattcctcataccatctaagttttaaaactttttcctagagtatatggacctatgtcaagacagtgtgttaaggttgttctgtgattaagaactcagaacctagagccagaatccttgggtataaattgtgactgtcatttactagctgtgttccattttcttcatccgcaaaatgacatcaatgataagaaacaaatatgggccaggcacggtgtctcatttttgtaatcccagaactttggcaggctaaggcgggcagatcacttgaggtcaggagttcaagaccagcctgaccaacatgacaaaaccctatctctactaaaaatataaaaattaattaggcatggtggtgcgcacctgtagtcccagctactcaggaggctgagacaggagaatcgcttgaacctgggagaaggaggttgcagtgagctgagatcacaccactgtactccagcctgggccacagagcgagacttcatctcaaaaacaaaacaaaaaaaagagacaaatgtagttacatacagcaacataggaagctttcaaaaaatgttaactagtatgtatttgcctaatgagtagaaataaaaaacttcagtactatttggagacttggtatgtttacatgattcagtaataactacacagcacctttccttcatacaaagttctaataaattattgctttttctgtaggtaaaatctactggtggagtcactccattattcttatctgtggagatctagatcttgatttgaaagtttctgagaaaatcttcagctcagacttgagggtcaactttaccagctgaaggtaaaagctaattttattcatttaagtgtgaattgctcattactgaagcatagaaaataaagatcattaacatgtcttaactagaacatatcaaatagaatcctggtttcttgatgttgaaaaaattatgaaatactaatagaaacagagaaaaatggccaggcgcggtggctcacacctgtaattccagcactttgggaggcccaggcgggcagatcacctgaggtcaggagttcgagaccagcctggccaacatggtgaaaccctgtctctactaaaaaatacaaaaattagctgggcgtggtggtaggcgccttaatcccagctacttgggaggcagaggcagaagaatcgtttgaacccgggaggcggaggttgcagtgagccaagatcgagccattgcactcaagcctggggtgacaagggcgagacttctttcaaaaaaaaaacaaaaaacaaaaaacaacaaaaaaacccagaaaaataagatacaatgaataaggagaaaagctcgtttcctcttgtggttatggaaagctttataataagcatcttcaaatccatttttattttattttatttttggagacagggtctcactctgatactcaggctgcagtgcaagtggcatgatcctagctcaccacggccttaaactcctaggctcaagtgaccctctcacctcagcctctcaaagagctgggatggcaggaacatgccaccacatcgagctaagttttttcattttttaaaatagagacagggttctcagcatgttgcctaggctggtctcaaactcctgcctcagcctcccaaattgctgggattacaggtgtgaaccaccgcacctggcctcatatccattttttatatctacagtacccagttgttgaaataatcttaacatctaaggaaaacaaataaactaagaaacagtctactgcaggactggagcagttggggaacggaataggagagtaccaaaaaagatgcaaatgttcctataaaaaccaggaggcagtaagcctgctgcctggagccaggagactggacagtggagaaaatctcttctcagatgctcctattcatttgatggctaagtaaattattttgtagtgttaaacatggacgttgttgttgtttttaaatggtgggaaccttccaataactggcttattttctcatcggtctgtgtctcctattcttcagaggttgttcttaacgtcctccattcacctcaaatttcctacccctccaggttgccagttactgccagtcagaaaagaagctttagatgtcaactccctcaaattttgcctccaggcctgcacaattaacctgtactcacattcagtgctttgtcactagtgaagggcaaaccacatcccagtcccactttgttccttattctcctgctctggaaccacctcctcctccctgctcctgaaccacctccttcttcctgctctgaaactgctgaaacgcacctccttcatctggctttggaaccacctccttcttcctgttctgcagcctgcctccttcttcctgctctggaacctgccttctcctccttcctgctctgaaactgccaaaacctacctccgtgttcctgctctggaaccacctcccttttcttgttctggaacctgccttctccttcatcttgcactgggatttgccgcctccttcctgctctggaaccagcctcctccttcctgctctggaacccacctcctcctccctgctctggaatctgccttctcctccttcctgcactggggtctgcctgctctttcctgctctggaaactgccttctccttcatcttgcactgggatctgcctcctccttcctgctctggaaactgcctcctcctcctccttcctgcactggggtctgcctcctccttcctgctctggaacctgccttctccttcatcttgcactgggatctgccttcccttcctgctctggaacctgccttctctttcatgttgcactggggtctggctcctccttcctgctctggaaactgccttctccttcatcttgccctgaaatctgtctccttcttcctgctctggaacctgctactccttcttcctgctctgaaactgctgaaactcgcctctgtattcctgttctagagccacctacttcttcccgagctggaacctgcctcttccttctggcactgggatctgactcctccttcctgctctgaaaactgcctcctccttcttcctgccctggaacctgcctcctccttcctgagctgggaactgccttcttcctcctgctctgaaactgccaaaatccaccttcacatttctgctctggaaccaactccctcttcttgctctggaacctgcctcctcttttctgctctggaacctgtcttctccttcctgctctaggatctacctcctcctccttcctgcactgggatctgcttgctccttcctgctttggaaactgcttcctccttcctgctctggaacctgcctcctctttcttgttctggaacccacctcctctttactactttgggatctgcctcctccttcctgctttggaacctgcctcctccttcctgtgctggaacctacctcctccttcctgctctggatcccacctcctcctttctgctttgggacctgccgcctccttcctactctgggatctgccttctccttcctgctctggaacctgcctcctctttgctactctgggatctgccttctcctttctgttctggaacctgcctcctccttcctgcactggaacctgcctcctccttcctgatctgggatcttcctcccgcttcctgctctgagacctacctcctcttcctgctctggaacctgtgtcttccttcttgtgctggagcccacctcagtttctcctttctccttatcagctatcatttttgtcacttcccccttctttttcttccttttgatgcctttgttcaatattttcacatattcactattattttttctcttttttaattaagattattcatatgccacacaatgtatcattttcacatgtagaattcagtggtttttagtatattcacaaaattgcatgactcttcatgatctaaaattccatgatctaatttcagaattttgtcatcacctcagtgagaaaccccatacccattagtaggtgctccccattttcctcttcttcttagtccctggaaaccactaatctactttctgtatctaaggatttgcctgttttgggcattttatgtaaatggaatcatacaatttgtaaccttttgtatctgacttttttcacttagtataaattttcaaggtttgtccatgttcatacatgtggtagcatgaattgccatttcattctcttttatgactgaataatactccattttggaatgcagcatattttgttcattgattcatcagttgagagacatttgaattgtttctactttttgactgtttagaataatgctgctatgaacattcatgtccaagtttttgtgtggatgtatgttttcggtcctcttggttatatatttaggagtgacatttctgggtcatagggtaattctatgcctaacattctgaggaactgccaaactgtcttccaaagtggctgtgcccttttaccttctcaccagcaatgtacgaggtttccaattcctctatatccttcccattactgattattgtcagtcttttaaaatatagccatcctagtggatgcaaagtggttacttatttcctagtctctcttggacatcacttcctttggggaattgttctgaacaccctgaaatcctttctcttcaggctgtgttaaatgtccctgtattagtccattttcacactgttgataaagacatacctgagactgggtaatttataaagaaaaagaggtttgatggactcacagttccatatggctggggaggcctcacaatcatggtggaaggcgaaaggcacttcttacatggcggtgtcaagagagaatgagagaaccaaacaaaaggggtttccctgtataaaaaaccatcaggtcttctgagacttactaccatgagaacagtatgggggaaactgtcccaatggttcaattatctcccaccggctctctctcataacacatgggaattgtgggaactacaattcaagatgaggtttgggtaggaacacagccaaaccatattaatcccccctgtatatttctcaggcaccctgtccttgtagcatccatcatcacactgaattatcattgtctattaactttatctcctccattagagtatgaacctgttagatagagtaccaaaatattcctgtggtatttcctaggttaacacaatgcctgacacagttatttagtctcatctttttgtcaggagtggtatggtgggagacttatagactagacttcatagcattattacctaagcccctaaatacaagaatgaaaatattcattagtattgtttgttagttgatatctagttagaaggagaagacaggattttttagcctatgtgtttgactttttatttttattttattttattttgtgatggagtttcgtgtttgttgctcaggctggagtgcaatggtgcaatctcggctcaccgcaacctctgcctcccaggttcaagcgattctcctgcctcagcctcccaagtagctgggattacaagcatgtgccaccatgcccggccaattttgtatttttggtagagatggggtttctccatgttggtcaggctggtctcaaactcccgacctcaggtgatctgcctgccttggcctcccaaagtgctgggattacaggcatgagccaccgcacccacccgtgtttgactttttatgaagttattttttctttactgttgtactaatacagtactgtcctttaattcaccaagaagttggaaggaaagaaatagggatgctataaaatatcaccatagggggaaaatgcctgggtgattttaaaagtataaatcaattagccatttttactttgattttttaaaagcttgactgattgagaactgtttcttttaaaaaagaaaataccagttccatagattagactttaaagatttcacatgcagatagaagtcaagaacggtaaagtttatggatcttcaaaaatgatgtgtttcactgtaagtatcaaaaatctgagattcatttacatcagggttgaacagatagggatcagtgccgggtaacaaaagctggaagtggaattaaacataattaaagactttaaatataagtttgaattaaaaagtacatccggcttgaaggctgactcatactaaattatagtgccctatgcgtaagtacagattaaaaggcatatttaattagttcttttaagaatttctccccacaaacctattggtttttataatcaacatttagataatgttgtttcttttttttttcctgatgccagaaagatttgttttagcattttagatttttcttaattgaaatgaagttatgcttggactagatagccattctcttatttgacagtgttttcagtgtattcttggaaattctatccagcttcttttctatggtttttatatgcttctggaacaacgaggaaataggggagggaaagaaagagagaaacaaatgtaagttggacccagatcagtgagatagtatcaaatggggccaaaatgaatttggcagatgctcttctcatgtttcccactggagcatgcacatattgttacttggaataccacttgcatttctttcattcttgtaagatttttcttcagcttcagtaacaaactttaactttaaataggagccaggaaggaatattgagaatttttaaaaaatgtgtaaatgtacttagaaaggatattttgccatgaaggtttggttggtaaaggatataatagatgccttttaagcgtaggaatgaaagtgtggagggccagagatagtggaaggtgtgtcgtgtttagagatctgagtttgaatcctcattttgccacttaatagtggcatgactttggcaaagtaaactttaagagtctatctttccttatttataaaatgagaagatccatttttactctatagtgctgatagtaagtgaatttagtgacagatagaaaacattcaatgaatgattgctgtttcaaaattgtcatatttactaaaaaaaagtaattcttaggataaaaaagtaaattttcttatcaaatgttcttttaatgtcaggtaggcatttcagtttcatgatgttcattgtagatattactggtagctgtatttccttggttcctgtatgtcagcgtggtagacaaagacaaaaatgagaaaaccttgaatgtgggagcacacgaatttatatagatgaaattgtacagtaccatgtacttcattaatatgcacttaatgaaagtttattaaaattgaatgagagttgaaggtattcaatatcattttatttcttgcagtatttaggttactgcagacaactgagaattagctttttttttttttgtgagactgagtctcgctctgttgcccaggctggagtgcagcagcgcgatctcagctcactgcaagctccgcctcccgggttcacaccattctcctgcctcagcctccccagtagctgggactacaggcgcccgccaacacgcccagctaattttttgtatttttagtagagacggggtctcaccgtgttagccaggatggtctcaatctcctgacctcgtgatccgcctgcctcgacctcccaaagtgctgggattacaggcgtgagccaccgcgcctggccaagaattagctttttttttttttttttaaatatatgtatccaaaggagaaagatgctgtataactttccaaaatgtctgttcccttacttacaaaagatacttttaagtttaaaggaatcttaggctgcaaggaggtgcaaaacttacagagttttcatgtacccttcacccagcttccccatgatactactatctttaatatccacagtaccattattaaaaccaggaaattgacattggtaatttaccccttcaatgcttaacccattttagcgtttttaagtggaggaaattctttttgatgtcttgcttaatcaattttcacctacatatactttttgagtgtcagtatgctgaacagaaagatattttgaaatcagaaacccttaggctcaaatcttggctctgcctcttattgctatgcaacacaggggagctttcttagcgtcgatgatggtctgtttcttcatttgtaaaaggtgctatcacttaccttgcagagttggcataaggattagcaattgtgtattgtcaagagccttttcaataaatgatggcttttggaataactgttctcttgctatgttttcatcaaaaattgaaaagagctggccattatctttaacatagcatgtgtactttgtggacacctatcatttcaggaccactaactggtaaatatgctaaaacaacttcatggttcctgtagccccctgcttgttttgctccctggtcacccactttatctgcacctttttttctggcctatagaccaaaagccactcctctctgtgtatagattatatttcttctgccttttgttatatgaattctaggaaatgtagttctttttagttttttgtttgttttcttttatataacctcttccaacttagttctgttttacaagcagttgatgatagccctaggtagatgcctgcttcaaactcaggctgatacggctggctcttgagtatccctgtacaaacgctgcccttcagggaacatcgtgtccagggctgctgcctccctccgtttgcagacctggtgctctgcgtctaaaactggtcactccttctcatctctccacttgagcacagccgcaaaggtagaaacagagttctgcaccccactttttgctgcacctcagttagcccaggaacatctacccctatttagctcagaagtgtgtagtcctgtttaaatacttaaaatttgctatgttctgtattggccaagaaatgttttctggtaagagcttctggtaggaagaggacctaaagctgccctcacaagacgatatttggttcatttgaaatagaaagttttgtttgcttttaatttttatttactgaactgaaaattggaaacagcccattgacttttctatcttatacagcatctcctcctacacatatttagtttcctgctcccttgaaatctgggcgacctactcctgttttcaagttttttctattttattattttggtccttagcatttctgccttttttgtatcttccaactttccatttcaaaagagaaggatcatatttttatatatttacatcccgtttgaatgtgtttaaggaacgcttagaaatgttcctttatgttttaaaatatcccttctgctaaagcaagtagcatatcatttcctgctttagttgcggcctcagtctgacaggccagggctaagtaagggtgaaaagttcaccgtccggaagtgctgttgaggtcagaatcacgtgatgaggagccgacccagactcccggtaattccctgagaatgtgaatctttgggagaaggagcacaagagagagctttttctcaagtcggctgcctgtgctcgggctcttgcttacaattcttagttttatggcactattcttcttcttcttcaaggaactcactgtaatgcctttattattgtctacatcagtgttttaaaaagtaaagttgtaacgcattgctaggttatgcaatcaattgtgtggacagagatcagccttaaaaaataaaaaaggaaacaggaaatgtaaacagagtgcattatatggaataagaatatgtgtattttgtaaaactcttgtttgatacatagatccgtacacatagacacacacaatctcataggtctctattgatttgcgtatgggtacacgctggcaggcgtacattctccttcatcctcattcctagtcatttgaaaactcagtcattcaaaatgcatgcccttgccagtggatgtgttcttataaatttcacatagtttcatatttggaatttattgtaactgcattttaatttatgtgaatatgagttatatatcttattttgtttctttgtattttctccactcagtattctattttaaggtccatggatattgctatgtgtacatctaatccattgcatccaaatgcccatagttgttgaagtgcgtctagaatacattttacttctgttctctcccagggatggacccctatattgtctccatctcacctcaccatgaacacaactactgtgaaaagcctcagatacatcccttactggaaagtaccaaggggaatttatttgggttctagcctaatagtagacttgctgagccagagggcataggtacccagctcagatactgtatacagtataatttcaaaaagtatactgattacctccggaatgattcaccagtcaaagcacccaccagcagtatgaatgcttattcccacattcccaccagtacttagcattattaagctttctaattttccctatttctgtctagtgagtgtaaaatgatatattttttgttttgttttgtttttatctgattattgttggatttgattatgtcttcatgtgcttgattttcttggatttttctcatctgtaaattccccttcaaattcattgcacatttatctactggaaattttttacttttcctattgatttataggcattcgttgtatagtccagatagtccctggctggctttagacattacatgtattctcctagcctgtcacgtttctgttaacttttgtctcttatactttttattgaacagaagtctttaattttgatgtaatttagtttatcagcattttactctgggggctttgcaaaatattccctcttcttctaatacaaaaattatctattcatatcagttttatagttttatcttccacatttaggtctttaatctatctgaagtccatatatgtatgtggtagcaggtagcaatccattaatttttcatatggtgattctgtttatttaagctggtgttgcccttccgctctctgatatgctccattggtttttctgttctttaactaaagtttatgctgttttgttactatggcttggtaatatattttactatctggtagagtaagtcctacttattgttcttctttttcatagtggatttaggtatctgtgaacttttcttttctatgtgatttttttttttttttttttttttttgagactgagtctcactcttttgcccaggctggagtgcagtggtgcgatcttggctcactgcaaccttcgcctccctggttcaagtaattctcctgcctcagcttcccgagtagctgggactacaggcgcgcaccactatgcctggctaatttttgtatttttagtagagacggggtttcgctgtattggctgggctgttcttgaagtcctgacctcaagtaatctgcctgtcttggcctcccaaagtgctggggttacaggcgtgagctaccgtgtctggccatatataaattttgaaataaatacaatcgaatcagttcctcaactacaactgaattttgatttgaatgttattgaatttataaatgaaaattgaagaactaacatatttttggtaagttattccatctaggagcttttactgtctctccatttatctcagcatctttcatgtaccttattagagttcaatgattctccatagaggtacaggtgttctttctgatacttgaagccaatcaaagatgaagacaaataatatacacaatccataaaatgattttaaaataaaaattgagggtttagccgttgttaaagtagtaatatcctttgattgcagatatttatgttagaagagatcttaaagataatgtcagataatgttagaatccctgattctaaaacctgaaatctgaaatgctccaaaacctgaaactctttaaatgctgacctaaagttcaaaggaaatgatcgttggagcatttcggattttggatttttacattagggatgcttaaccggtaatgcaaatattctgaaatctaaaaatatcccaaatctggaacacttctgttcccaagcatttcagataaggggtactcaacctgtataaataagaaaactagtcatcagtgagggactagtttttttttttattattatcttataaggaatgattcgctcaagattacagagttagacagtgagagaactgtctaactctgcctttctttctcttggtagagttaatgttaaggtttgcttatgcttccagacaaatcagattcttttttcagtgatgatcacacaaagaatgattgacctgccagagccataagacagaaagggggaaaaaaatctcttgagcagctttttgttttctcattaataatggcgtgagttagtattttggttcatttttcagcaattatgtcctgcattctggctgtggttgatagtgactttaaaaaaatagatatggtggtacttgcacaaaataattgtcacacattagcatgttaatgaagtgttagggtgctaagaatggctagcacactaaaacaggagagaaaagatccatcctcactgctgcatcagccagactacacaatctgaatggaaggcacggctcagattgactggcagggcattctgtattattgacatgcattttcttcctctccccacatgcatgttgaaacttggtttttgctgtctttaacccatctaattttcctccaaataagttggtttggggacagaaatgagtgctttttctttttttcagacagacagcagaactcatcagggaataattacaagactaattcctctgttttaatgacatcaattgaataacattaaaaaatcaaagcccatatgatttcatagcattttaactctgagcatttgaatctaaataacatgtcattttgttgtatgtctgtgtagtagggccattaacttaaaactaaattcaccgtgtgtatgtgtgtgtgtgtgtgtgtgtgtgtgtgtgtgtgtttgtgtgcctgcctgtctgtctatttctggagctagtcatgttgatggtggcagagagaattcttgcatgtttcctgaaggttggagaaagattagtatgcttttgaagccaacatggatactactatcccttacaggaaaacacagaaatgctgctgatcgaccatatggccgaggtactcctgatccacatcttaagggccagcctttcttctgaatttcagtttcatatttttacccacctgtcgggacttctttacccagctgttccctgtctacctagatcccatcaggtcaacacattaaaacccaagttcagtgtctttcgctaaagcccagaccccctttagagctctccattcctctaagtgttagcaacacactcaggtttataggctaatccctcaccatgtctagtccaccaggtcctgtttgcgaatgccctatagcatcacacaggcttatacatttcttctgctcttgctcctgtcccttaatgcagggctcatcatctacccagcaggcctgggctcctgctctctgtctttttatccagccattttccaagcttctggcccaaagcttacctggactctggtgtgaccatttgttaactgttcaccttgggcagcttatttagcttttatgaacctatttgtgttcttctatcaagtataaacagtaataacttgacggcttgtttggaggatgacggatataatgaatgccaagtgccacacacagtgcctggcatgtaattggtgctcatattgtatcaccctccatagtaatttctttgaacgctgatttctttcttttccagaaatacaagctccttcttgctgtttgtccctagaactccttttcccctctgctcagctttcaccttcttgatgacacaatccaaaatagcctttcccagctctgtccccgtactctccagcatcacgtttatagtcttgcctttttaaatctctttatctctgacattatctttcatttgtttgcctgatttttaaagtaatctgtccttttccccacttgtgcactagaatgtaagctctgcaaaagcaagggatgtgtctgtcttctttgcagctgtagcccaggatggaggagtcagccttagatatctttttaagacttatgagtcagaactcaggcttcatacacagaggcgccaagcccttaagccattcggggtacacagtggctgcagcaggaagtggaagagatgaatcttctaaaactgaagatacagctgtgtaggagatgagaacctacctacctaccttgattgacccttgccttttatacttagaagaatcatcatcattataaggaaagacctgaataacttaatatacaatctaagttttctttttgctggatcagatagagatagactttcttatgatatgttcttatggccttcccattcttggcctaggcttttctttagctaggctctgatccctgctgaagcctcaacctgccttgtccattaccaggaccttaatccctgtttataatcctgcttaccggccttttaatcctttgagattgaccacagattcaaaccttgctaaaggcttggcctcctggcccctacttctccctagcctacttctctgggctgtgccttcctccctgtctgtgtaaccctaagaaggtctgcaccgtcactttgccacttttttctctgattcggtggacaaagagtaagcatttgctttgtatactatgtacgccctttcatttccagtgtagcgtatttaaccagagtgaaatagcacatggatccagcccaccatgtaggttaaaactgtggtctccataccttcagcacctctcctttcaccctaccttcaaattttcctgccactgactcttcctcagcgaccactgtgtatatattgctgcctgctgagaaatgttcaatgcttcctcagccactgaaggataagcttgaacttcttagcttgacattcaagccttgcccagtctgaattgtacttagttgcccatcatggttcctacatgaagacttgccctgcttcacccagacccacaagacgcatcttctagcttatgccacagctacatctctgcctggaatgaccctcctgctcccccgtgtatattcaagcctgacttgcaatttagttcacaattcaagttctggttgctccagggagtttctccaactgtgaccaccccttcctctcgaactcttctcttttctcctatcccctttacttggtgggtggctctttcttcttccactgccactcatctccagatgagtagattgggcctcttcatttggcttgaaagtcccttaaagatggaattttgttttcttcctctttaaattttcattgttttaaatattgcagctgttgtcagttattgctgaagatgatcatgatattgccatttttcggggtattatcttttatgcattgcactagatgttttatatgtattatctcattaattgtccaattatcctatgacattatacatgtattttacaagagaaaatgaaaatttattttattctgctaatagttggggaaggctggtttcaaaggtctgttggattttaaagcttgtactctttccaccattcactgatgatggcccaaagtagtatgcatttaaaatttgggaatagatagcaggaaaggagaatgaggtttctaatgtgatctgaatactactctggaacccgttaccagagaaagggtaataaagatggggaccaacacacacacactcacaaacacacacaattctttatgtaaagctggttttaatttttgttttcccatgagaagatgaatgggcaggaattcaatcaaatcagcaaatggaaaacattgacaaatagataagaaaatatcgttgataatatctgaaatatactttagccaggggttttcaagattctctttaaacctttttccttagaaagctttacaagtaagaaaactatttttgacttctttattttacactttcttaggaatcagcttgtttagtggaaagaacctattggttttaaagcacatcaaatgtggttttagatttatattgaatacaagaagaaagggatataagtgtaatttctaaaaaaattgcttggtaactgaagcaataaaatcacaaattttgaatttgtctttaacatctaacaggtttctcgtgtatatatatgtgtgtgtgtgtgtgtgtgtgtgtgtgtgtgtgtatccttctatattctttgtgtgtgtgtgtgctttttacaaaagtttatattcttctatgtgttcatccaaattattgatctgggtcattcacttataaacttaataagaacaggtgatgcttgtcatgcatgtttttgtgcatacacattacagttttttataatttaattattgctatcatcagtttaaaagccccaggaaacagacattgggatcacagaaccactgaacccaaagtatatcttgatgtcaacttttgatgcaagattttaagacaggaaaagcactggaatagaattttcagaaaattaaggcaagcaattttaccatcccgggacctaggttccaaaaaaacaaaattagaggattagactagatggtctttaagtaagtttccttcagattaaaattctttagtctatgcctttatgtctgcttcttgcctcattaatctctcctgcaaaagaaaccttatgtctgacaacatctgaggaaataaagatagcatgtttgtaagaattggaaagactgttgaaagaagtggttatttccttcttactgtgttaatgacagcagtgtcttgaatatcagggaatgaatgcatcaaaggctctcactagtcctgtggtaaagaagttaaaaaaaaccctgagtaataggattttatctgtccatctatgatcaagagtggttttaaaatggggtggtgtgggaggctgaggcaggagaatctcttgaacccaggagtcggaggttgcagtgagccgagatggtgccattgcactccagcctgggcaacaacggcatcaacagaaaaaaagcggggggggtgggggggggatggtgattgccccagagtttttataactcacaataaccaaaaatgatgttattattataatgtgactagtaaagcacatgactagtaaagcatgcatttattatatgcttgctttatgcagggcattctatccaggatttacttaacattaagtcagtattacagtatattcccatttttcagatgagaaaactgaggtttagcgagattgacttcctcacagttgtacacagagagagagttgtaggaccacaattcaattgtccatttgatcatgaatcctaggttctttatgttgtgtccgtttatatcaataccatattttctgcctgaaatattatttacaggttcaagatctagcactctgtttttgtcattagctatggatagtatgggtgctgaaactcactaccagatcttttctggtgttatgacttaattaaatgttgaataataatgaaggcacacttctataagaagtgtgaaaacactgtttacacctgacaaaatcaactcactgttatgtctatcaaggtacaagaatgcaaattgtaaagtgttagacaaagtccttttctatcatcttctcattcttaaaattaggggaaaacaataccaatagagtgaaatgaatattttttcaagtgtacttttccttcctaaaatactcatggaacagcctgattcccatgttttttttttctttcaataatgtgttgcctttttaaaaagagcctaattatatgcaaaatattccagtatgtggaaaatcaaatgacacattgctttaaaacacagacatctttagattactgccccctgctactgtcttggtgatgttgagagcccattgcatgtttggtctgttataatttaattgtaattccagtttcaaaattattcttccattccagattttaaaatggttgtgaagcaggatccaagtggtgattttttttgtgttttttttttgttctctactaatttagcctcctagagccattctgtccaatatggtggtcgctgaagatctatggctatttaaatttaaagtaaaatagattgacaatagataaaactaaaaatttaattcctctgtcacaatagccctgttcaaatgtttagtagctccatgttgctcgggacagccaggctggaaagcctaggtatagagtatttccatcactgcagaaagttctattggacagtgatgatctagggtcattgtaatgatctgcttttgatcatctgttaatttgggttaaaacagtatgaattgggttattgccataaaagggaggcagatctgatagctggaagaggttctggcatgtgtagtgtgctttggaaactctgggagagctacgtattatgggtttgctttagcgtatgtaacagtgttggccactgcaactttacctggtttcagaatctgtattctaaatagctaacattttattacatacactgactgtgccactcactggttttgattgttgtttctctggtgagtggaccaggtaaagagcagccacaaattcaaactaatttagaaagaaatcctaaggcagagagtcttaagttacagaactacttgtttaagttcgttttgtagtctggagactgtcctacagaaattcacccttgaaggccgcagggagttcagcaagcctgtctggtggctgtctgtctaagttccttgaggcaaaaaaaagagacaatggatccttgtttttttgacagctttattgaatgtattcagtcctaagttctgaataatttgcttaactagagatatattgcacagtgagtaaaattttcttggtatgaaatttaatcctcatagtatcttcagaataattttaacacttgccagatctctttgtctactacccagttctgggtaaatgtccaaatgcctttacttgttgaaaagaactctactctgcattgctgatttgttattcctggtaacagccagaagtacagaaaatatacgtgtttaaaaaaaagtaaggaagatgattggttttaatgtttctcttgatcttgctcccttcaagcatataataatttaccagttttctctcccaattcttacgtttctctttcattgatagacaaatagaacagtgtttgaaagatcatttacagattgcacagttagctcaatggtaataaaaaatgactggataagtctcaccaccaagggcttacatgaagttgaatgtgaacttggagaacaattttatgttcagccagctctggttgttctttaaaatcttttatgattatacatttcttcatttaaaattgtttgctgtaagttttaataggaagtgttttcttcattaagatgttctgattctgtccccctttttgtaaccagactccacgcatattataagcatgaacaaacagtcactgcacaggcaccagtgagccccttcctttaacagatctatttataaacgctgaagcaggagcgagtgggtgggttcatgtctcctgtgatataatcttgccttcctgtgtttgggagcttacaaaggatgacagctgtttatcatccttccacatttctatccaatctaaacctggttgggctaaaatgtagaaagcctctgtactcaatcaagagtgcatgcccaagagcctccatagcagatgggcttcacaacattgactatcctgaaagttttctctccttaaatgataaccttacttactgcagttgccatccttgaaactggctcttctgagagtggcaaattatttaggttgcattagttttgtaggtttggttttgaacaagccgaagaatttgattagtataatcatctctattcatctctttttgcaaatgatttatcaagacttgaacagcaactgagcaactcttcttgaaaaaacgggaggataatgtttattttgcagtatggtggtcttttaaaattcgtttttttttgcttggcagctccgaacagaagacaaatataaaatgggagatgctaggtttctaagtagcagttgtcccatggttaagctgaagtgctttcttaacataagggtttataggagtgaatgaaggcgggcaaggaaaatattgactctatcctattacaataacactgatgaagttctagatacttctctatatgctattaaagtaacactgatgaagttctagatacttctcattctgtggcaaaggaagctgtcagtatacatgcaaaaaaaagaaaaaaagaaggttatgcaaagtttgggttttctttgttcttagtccttgcttgggattttgaggaaaatggaatgtatttctattttctatttcacttgattttctcatctttcatatttggccagctactttctgagaacatattgtacacatgttctgatgctgtttgaaggccctgtgagagacaagagttgattgaaagctctcagttctcctgaagtgggtggccaaagagctgaaactgaacagctgctgtacacccattgaacttttgtcatttataaattattttccatgccatctggagcaagaatggtgccatggtttagagaagctctttgtggggtacatttcatatccagtgcttatatagcttgcttattaccacattcaactgaagttttaaaatctttatttgcttggaggcttaaggatgtgaataaatatgagtgatttctttaaatgttatatgaaaaacaccacctccacctctaccaacgtttttccctccctctctcctttccagtgactacatcctgcctgctttcagctccagtggaaaatgcattaatcccagagtctccgtgaggtttcctgtttgatgacataatcagaaaatcctcctcacattgcccttggggttgctgtctggatgttatgttgtcttggtgggtgtaactcagccatcaaaaaaatcagcacaggccataaactcaggacctgaaatgcattaatataatgttaaacgaaataacgctgtgggtatgtctgcagcactggtagggaatttcattaaactgcagattctccctggcatcagatgcattggctggtgactccggtacatatggcatgagctgctgcaatgccactagcaggaggtatttgaactgctccagtgtaagctgttagactacatctcgtggaaaaataacacacacccttgactaccagagtttggtagtgttgatttaagtagttcttcccttccattcccctctggggcagcctgtttacctaataacgttttgcctttggtgttgatcacaggaagctgcaaaaaagaaaactagtgggaagagtcagaaatagaagatgaggatacactttaaaatgagaaaagcaaaagatggcatctgacatgtagagtgggttttaaaagttttaaagataagatattgtgaggcagaaacttcagtagctgtgaatatagttggaaagaagaaaccttgatataaaagtagaaccaagagtaggatatttagataccaaagggcacgtacaattttacaagtttagaagatattggcataggaaattgagcatatgcttaaatatggatttcctttgctatttggagaattttttatattttttttattgttttggtaggctgccataaccctccatttggttgtcttggatggaatatctcttgccttggatcttggaaatccaagcttgattggcacttggtcaggatgagaacaaggaatgggcctcttaggatgttttacaagttctagaagttacctccatgatcctccctcctgttgttgtaccaaactctttcttgcatgtgtcttcctgggggtggagagaggtggtgagggagctggtgggagaagcaggcaagatacagcttgatagagcttcactggagagaagttaaagaggaaggagaggtctaagctctagccagttgaaagcctggggtgatgtcaccattcctacctccttatatcagaaatattcttgggttttccataatgtattccaagcagcgggacacctttcacagatgcttctcctgtgttaggggaatctggactaatataacactaggagggagaaaattgtgtttctttatcgctactgtgaacgttgttgttttttaaaatttacagctgactactgaataaactctaaaacttggagttctggatttcaggttctgtgatctgttttcttgtatagctctgtgatggttacgtgaccaagctgtgagcatttactctcaaaacagcttcatttaaaccatcctatgccttgtactagaataatgctaccccagagcgggaagggctctgaaagatcacatctaatgggtgaacctctttacccaggtgtgttgtgacaagagtgggggagactatgatcctttttattctagatatgtagcgcaggttggttgtgttagtgaatgtaccatctcacacatcatattgagctgaatgtttcaggacatccttggggacaaaatgttacctatatggtcacactgggaatctatttgaaattattagatattgctcctcatttctgcttgtcaagatctttttgaatcctgcatctatagctattgcctgtcccaggttttggtcccaatgtgaagtcaaaaagactcgatacatgaggttaaatcctggctctactgtgttctgcctttgttacatcaaatgaataatttaactgcagtaagtttcagttttcttatctgtaaaatggaaaatagaatgttctgcctcccctgttgaatagttgtgaaggtgaagaataatagtgcatatagagatgtttgaaaaaataaagcaccacacaaatactagtttttattaagcgacctgaaaatatgataaatactctttctttggcttcatccaggtcatttgtttaaaaaaaaaatgatgaagcaaagggaccaaggataaaaccctgcctctagggaccttccagagagtggcagtgatgggatgttgacagcctttggttcatgtgtttattagtctaataaactgccctagcattctgcccatattttcacatcttgtcctttaagttgtcctgggagcccttgtcagattccttactcaagttcaaatacattatgtccacagtgtttccctgatctgccaggctaccagccttgtcagagaaggaagtgaggtttgtcttgtccctattgaacccacactgtccgccaggactggtgctttcttttctgagtagttacaaaccattcttttaacactctgccaagaatcttgtccaggatcaacagtaaacgcactggtggtgtgcagtattgggattctctcttcctttttgtttttctttcttgtcttcttcaaagtgggaactcatttcccccatctccagtcttctggcaccagttctgtttctccatcagtatttccaggaaggggaattgaagagcagttaacttttgcctgagtccaggttgcagtcacactgacatttggtggctcatctcatttttgctgaggttgtggtaaatgcttagcagcagtgggatgtgtttactgctctaaattcataatagttaaaatccatgtaatgggaagaccttagaaatatattcctacctaatatgaatgcattttaaaatccagtattgtttttagttcccttatgaaaacaaaaccaacaatttaaaaagctagatttttttgtactgaagagcccaagaaagcccattaaatacaatttttagtttgcctggttaatatgggcatgaaaaaaataatataatttaaaataatatatccttaaggttttattctaaacaataatactaataaaaattgctatttagtgaagagctattgtattctatgctgtatatcagacattttacatttattaccttatgtagtacaattactctgcaagggtaagggtttgcacattttggatatgagaaaactgaggctcagacagctttagtacagtgcttaataagtgccaaactggaatttgaatttagatcacctgactgcagagcctcagattttccattatagcacagtgtagctttaaatgatgttttccatttgactttaaaatttttaacttatttagcattatgataaccatgctgagtgacctttaacttgggccatgtcagtgggaattgcttaaataaagctgtgttttattaataagtagagtgatgattgaattggactgctttaaaaatttctaaattaaaaaaaattaccaatgaaaaaagagctgcttttatcaattggtggtcttaagtggagattttgctttatttatctgtttttttacaaatccattaatggtccttttctttaacaccccatcaatcaactcagactctcccattgataagcatacctcactgaaagaaatcaattctcctttgtcattttgacaggaattaactaaaaaggtgggttaatccagaagcaacaggaaaatacctgcaggctacgactaaaacctaattttgtaaaatcaaaattgtcataatatttcacagttggccaggcacggtggctcatgcctgtaatcccagcactttgagaggctgaggcaggtggatccgttgaggtcaggagctcgagatgagcctggccaacatggcgaaaccctgtctccatgaaaaatacaaaaattagccaggcgtggtggtgtgcacctgtaatcccagccactcggaaagctgaggcagaagaatcgcttgagcctgggaggtggaggttgcagatctgagatcacgccattgcactccagcctgggagacagagcgacactctgtctcaaaaaaaaaaaaaaaaaaaaaaaaagaaagaagaaaaaagaatattttacagttcatgataacaaagggctttgtctcttttccatagtaaagataaatttgccatatgaatgtgagagtttaacactacttttgtcttttcattgtggcattcacatcccattgcccgatgctatagaaaggctcaagatagtgtaagctctgtttcccaaggcttggtttggaatttaaaccattttaatagggaactgtataagaaaatctcgtgtaatgcctgaaaaatgtacagtttcagatctggtgcatgaggctgtttgctggctctgacacaggatttttgtaagagtgacccataagaatctttggaaaggagaattttcattaacacagggtgttcaaagctgtgtttgaaccagtaggagcccaacagctctacacacacagtgttctaacagtgcattgtcagagggtaataaacccaagagctgcatctataaagtcttattttgaaagctgattgctaacacgtgaacacttaccatgattatggccaaaattagagcttgttgtttttataatacttacagaaattcatttttaaagaactttaaaaattaaacattaatatcctctctacttagctgtgtgatacagagtgttcaggaaaatttatgtctcttgtagttcatgtttatccctaggctgaaaaactttaaaccatttttagccccttccttcgaggatattgcctagctttttgatttatgtaacttagattatgtaggtcaattcgttgactagaaactcatctaaataaggtttacttctgaatcttggtgtttaaatagctttgggggaaaatgtgcttaactaaatgttttttttcttaaagtaaggcagtaaccattgagtgtttgttttttcattaactttttttttaaattttaagttatgctttttagaaatatcaaagtcgttttttatgtttgtttcttcggtagtatatttggaaacctttggaaaataggtttatgttttgttgtttatagccattataatataaaccttgaggctggataatctttctggatatttcttttctttttttttaaattttactttaagttctgggacacatgtgcagaatgtggaggtttgttacataggtatatgtgtactatggtggtttgccgcacctatcgacctgtcctccaagtttcttcccctcgccccccaaccctggatatttctttttttcttttctttttttttttttttttgagacggagtctcgctctgttgcccaggctggagtgcagtgagtggcgcgatctcggctcactgcaagctccgcctctcaggttcacgccattctcccgagtagctgggactacaggtgcccaccaccacgcccggctaatttttttgtattttcagtagagacagggtttcactttgttagccaggatggtctcgatctcctgacctcgtgatctgcccgcctcggccttccaaagtgctaggattacaggcgtgagccactgcgcccagccgttatttcttaaagaagtatcaaatactagtccagtttaatttgccataagttttaaactcctttcttggtctcttgatatctcccaatactcgattcctacaggtaaagcaagtgattactatttggttttgaaatgatatgggatgtttaaaaaatggtaaaactctaaggtacgattatatgattacactattctcagtctctttgagtcaacactttgggtgaagaacaatacttgtgttcctaaaaataaatactttgtccatttccccatgaatagtaatcaaacttttacctgattaaagaaattctttttttttttttttttttttgaggtggagtctcaccctgttgcccaggttggagtgcagtggcatgatctcggctcatggcaacctctgcctcctgggttcaagcgattctcctgcctcagcctccgaagtagctgggattacagccatgcgccaccaggcctggctaattttgtatttttagtagagacagggttttaccatgttggccaggctggtcttgaacttctgacctcaggtgattcacttgccttggcctcccaaagtgctgggattacaggcgtgagccactgtgcccagccaaagaaattcttttagcaattctataagtgactgatttttttttatttttaatttttactctttttgagacaggttctcactcccttcccccaggctggagtgcagtggtatggttatggctcactgcagccttgacctcctgggctcaaacaatcttctcacttcagcctgccaagtagctggaaccacaggcatgcaccacagtgcctggctaatttttataatttttggagggatggggttttgccatgttgctcaggttggtctcgaactcccgggctcaagcaatctgcccaccttggcctcccaaagtgttggaattacaagcatgagccactgcacccagccctgatttttatttttttattatttatttattttttttttgagacagagtctcgctctgtcacccaggctggagtgcagtggtgtgatcttggctcactgcaagctctgcctcctgggttcacgctgttctcctgcctcagcctcccgagtagctgggactacaggcgcctgccaccacgcccggctaattttttctattttttagtagagatggggtttcaccatgttagccaagatggtctggatctcctgacctcgtgatctgcccgcctcagtcccccaaagtgctgggattacaggcgtgagccaccgagcctggccttttttaaatttttaaataagagacagattgtcactatgttctccaggctggagtttagtggctattcacaggtgtgatcataatgcactatagccttgaactcctggactcctaggctcaagcaatcctgtctcagcttcctatctgggagtacaggtgtgcaccacagtgcccagctttgagattttgaataaactcagtggggaatgtagttatgctaaattaggctgttattactttattattttaattccaaatgcaagataatatgccgagctgttaaacaggtttctataatttaaaagggactgagatcacacgaagtatttgctctggccatagtgaaattaaattagaagttaataacaaagccatcaagaaaattccccacctttgaaaattaaacagcacacttctaaataactcataggtcaaagaagaaatcagaagtacgattagaataggttttgcagtgatgatgatatatacccaaatatatcaaaatctggaagagatgcagcccaaacactgcttagaaggaattttatttgctttaaatggttctgttaggaaattaaaaagtacgattttgaatgtatacaaacatagttggtaaaactatcaagaaatgccagacaaaaatcagaagagtggttgcccttgaggaaggaagggatgtgatttgggagaaacccacagaggggctgcaaatgttcaatttctttagctgatgcattatattggtgtccattacaggctgagttatatccctctataatttatatgttgaagtctcaaccctcagaacctcagaatgtgactattattagacatatggcctataaagaggtgattacattaaaatgaggccattggggtaagccctcatctaatcatatgaggatgaagaaaagacatcagggatgcttgtgcccaggaggaccaccatgtcaagaggcagtaagagggtggccgtctacagggcaaggagaaagacttcaggagaaactcaccctgctggcactgtgatcttggacttccagcctccagagctgtgggacaatttctgttgtttaagtcctgcagtccgtggtcttttgttacggcagccttagtagactaatacattattcatattttaaaaagttctttatctttacacctgtcataaacatttttgtatctattcactataagtcaattgcaaatgaataataaatggataatgtcatactgagcctgaaagttgcccttttgtgtcagagcgtgctaatgacatttttcaggactccagttttaatgtttaaactatgggagtagctatgtgtaaatatttaaaatgtgacagatagtactatcacttgcagtgattttatacctcctagttgggaggttaaatgagaaaaacctcggtaaagtccttataatgtgtgcctggcataatacttgttagctgtgattattactagtactgtgtttcttatgcttatttcattgcagtttcattttcttaagaggtataggctctaaaatgaatctcatatagtagaccttgggaaaaaggtggcgagttaaatttgtagagaatatagctgtttccactggcctgaggttcaaacagtttagagtgagattgtgagcaccctcttagggacagacacatctctgttctgcctccagctccaacacagttctctgccttttgggattgggcagcagcagcaacagataatgagagacgaatttgtcattccagagctacttttgcctttaggatcacgtctgtgctttttccaggagaaggtagaaaagaaagagaagggagggtttggtggttttgagctatggagacctaactttatggaccaaaatggcacacaggctgtgcaggtttgtgtgtgtgtgtgtgtacatatatgtacgggtatactaacatcaggcatacagaaattatttgctgcgagaatgtcattaatagcacattgctgttgaatgaaggatgaaaagtgtacctgagcaccctgttattattgagcaatgagaattaagcaatttctctttaaattctctgtccctaaatacatctcattctgcttctgcttctcctctccttccttccccaatttagctctcccactctccctctttatctcttctcctccctctctctccagtccaccacagtgcctggaattctgcatttagaaatttgctctttggattaaagacactgtggccttttccaagaatttccttttaaatcacgaatattcttggaaggtaagacatggcatctccctgtgaagggttgacgcattcgattgctttggcatatggtagcttggactgagtagaggagggaggagtgtttttggagaggtatccattattggggctctgtagtcctcattctagggcatctactcctagggacttcacttatctgctagagcatcttaactttgtgtttttattttgataacaataaactgatatcaatacattctgaatcatctgaataataatttcataacaaggtcatcccatgaaacttcagcacctgtgtttatatttgtgtctgcccctaaatctttgtgtctggctaatgactgactcgtaaatgatgtatttccaccaagattaggctggatgacatcattttttgctgtgtctaatagaaagagtggcaagagaattgagctgtcctgctgcctggagtaaggaaaacagtcccagctcataagaaccttggctgtagtctcagtgccattatcacactgcaagagaacaattagttgtagcaaaacctcttctgccacattccatgaatattgttaaattgtgttggttttataacttttcttgaatttttcttatacatttatttcggttttgtagttgcctaggagttacaagcctaaggagttactcctagttgtgtttgtacaaattttgaaaacataatacaataatttaagtcaatagtgggagtaaacttttatagaccacttaggtttaagaaatgatggtcgggtgtgtagcagagcctgccaagcctgggtgagtgctgcaaggagggatcccgggaagggatgggaaaggtggaggaggtcaggatgaaagcgatggatgcttgagaatgaaaaggatggtcattttataggtggctggaatgaataaaggggagctagaaaaggatttcagaaagccctcccaaaatttaaccaacttcacaatttggcctgtagctggctatcttgttaggttattaaataattgaaggtaaacctgacatctctcttctggattacttaaaaaaatgcatttctaaagcaattcattttgaaaattggggtcagtgacctctacaaatcaaggtaaaatggtgccagaccctttttatttagccattggtcagtctgtcgcttgcacaaaaagcaaatggagtgaacaacagttagacggggaggtggaggggggacaggcaggtagtcagagagccgaccctcctgcctcatatattttggtggcgcctcatgctaatgctgagtttgtgtgcttaaatggtactgagataaaactattttttgtatcctttatagttcttcattcacaaatcctacttttagatggattcaaagatgaaccagttttacatgaaattcagggaaagggagttgtatcccctagtttcttctgcggttgacagagcgggaaaggaacttgagctaaatgaccttaaaatctgttaagagattttagtttaatggaagtataaccctccctaaatctgaataaaaatgccagaatcttttcaaagtgaacataggttggaaagttaacatattggtgattatctcaatgaaatattactacatagaaataatgacagcatgaactaaagcatgggatgttatgatttctgggcccttgggcacgttagtagacagttgtcagtcttcactgaacattggtaatagttgcttgtaaactctgaccttaagtgaaactatatataacaaaaccagttttaccataggctaatggatatggcatattttggtcacagaaacatcaccaaacatataaactaagacccaaagcacttctaatgttaaactttgaaataaatgtgagctatacatagacttaaagattattaaaaacaagataattcagttcagggtcacaggtggccaggaacctcatctggcaggcagctcagggtgggcaccatctctggacaggctgccatccaatcacagggtgtgctcacacacacccacacccacccacaacataggaacaatgcagacacgccaattcatctgctgtgcacagctctgggatgtgggaggaagcctgactattaggagaaaacctaccatagacgtgaggagaacatgcagactccacccagacagtggcccacatctaggaactgattttttttttcttatcatcattataacaaaacaatgttgaacatgatgatgttattccaggacctgctccaccgggcaaatgcaaaattcaggcatttttataatgagaatgtgttcatcagaccacaataaaatctcagaatctcatttccttaaggaaataatagaatcatcactagatatcattagagaagatgtaaaattacttgtttctatatatgtgtagaaatatattttattacatgtatctttacatagatgacaaatatttgatatatattttatatatatgtaccatgacttttcaatatatgctataatacaaaactattttcactttatgtatttaccatttaatccatttagtttctataccctgtggcagggaatactacaatgtgtgggaatctggtctttccatcttcagagaaggagaccaggttctcatggatggcattgacttccgcaggctgctttgaagctggatgtagtttgcagtttacactctgtcacttccactttatatcattatcagatgccaaaaaccaatccttctcgaagtacaagaggagcagagttgggggaagtaagggggaaaatgagacttgactttttttttctttttttgagatggagtctcgctctgtcacccaggctctagtgcagtggagcaatctcagctcactgcaacctctgccttccgggttcaagtgattctcctgcctcagcctcccgagtagctgggattacaggtgcacgccaccatgcctggctaatttttgtatttttagtagagacggggtttcaccatgttggccaggctggagagacttgacttttagtaagtaatgatgctgaaaattcacgtgctaaattagccaccatgaagtttagtcagcttaataaaaaggtaaaaagaaaaggtatcttagaagacatgaaagaagtatgagatccaaaagtaaaaacagagtcgtgcatgtgaggtataggaaaaaactaagaaacagagactggaaagaaagaacaaataataatcagaaatgttagcaagtaggtttgagtttcagatctttccctaagcgacaccctttaagactttgataaactaatttacagttatttgataatgaaaagaacttccgaatgtctagttatttgaagagcttttttaattataataggatagaaatgcatgctcccccctttttccataaagcattcattaacgtgttaaaggaaacgaaagaatgattaaaacctagattttccttgtgcggctttttcctttgatccagaaaagagcggaaaacgttgatgttattcattttcaaagtcacgaacatgaacaagtcattctgcattgaatgattttttcgtactgtgtacagtgctaaaatcacatgcaggtaaaatgtaaatacatgcccacgaatgaccacataacacccactcacaacttccacagatatgctgatagcagaattgtcatttagattgcctactggatttcccagagaggatgatcccttgcctaaagctgtcattttacctcctctacaggaaataagcaggatgtagggcctgttggtttttgttggtaatgacctcccacagcaaccttttctgttctcgcaatgagaaatccacacaacagcacagaataacgttaaagagagcctgatggaggtttgtgtgctagttactatttgcagccagtgttaggatctgtgttgtacttaagtcacaggaatgtaataaagttaacgtgtatccagtgctttctatgtgctaagcgatgttcaaattgcttcatgagcatcctctcattgaaatttcacagcaacacaatggagtcaataccactttgtccccatttgttagacgaggaaactgagtgtagctcagagaagaaatttgccccaagtcatatgcctcgtaagaaatggaaccaggatttgaacctggacaacttgctccaggacttttcatcagtcctctttcctgcttcacaaggacatgtgtgaaaatgctcctgaatctatgccacagagcagtcattctgattatggacataatgctccgcttttatagcatttcagccattatatattaatggtatattggctgttcttttcatctgaaaaacctaaaacttgactattgtgctagctatcctagctgaacagtttttcatgtgtcatattagcaaatatgttttgtattctatccaggtatatcatacacttactttgaagtctggaattgtgtgttgaatactctgcatctttagacatctgtagtcgtttttggtttgattttgccaatatcagatacttctaggtatgaacttattttctccataaagatggatatgccttgtagttgctatcttgtaggcaagtgtcatctgaggctttctaaaaggcagaggtccatgtggatatcctggagagggaataaaataagcctagtgtgtaaactattacaaaatatttaatacataaatatatctgaagttgtgatatctgacatacagagtagtcagtaaggaatgaaccctgtgcttgcagacggtgtggaaatttcaatgcttttttaaaggtctgagcatgtggcctactatatccatgtacattaagtcattcttaagggatttttgagatttcaatttagagatctaagttaattgtattcttcagatgctttttacaccagaccacactattttccagagaataaaaatgttctggccgggtgtggtggctcacactttgggaggccgaggcgggcagatcacctgaggttggaattcgagaccagcctggccaacatggtgaaacctcgtctcaactaaaaatacaaaaaaattagctgggcgtggtggcggacacctgtaatcccagctactcgggagactgaggcaggagaatcgcttaacccgggatgtggaggttgcggtgagccgagatcacgccattgcactccagcctgggcaacaagagcgaaactccatctcaaaaaaaaaaaagtgcctacttcttaagtgttttgagttattccagtgtccgtcggttatttaatgatgaaagcaatatatgaaataccacgcgtttcctaatccaccagcacttaggtatggagtatctgctgtattggaggaaaataccatgtattagatattgtaggaagaagctaagagcttagagcctgctctcagccagtccttgggtagctgagggaccagacatacgtacggcaaatatggacttataatactagaggggcaggtgaatcccaagcaagtaccattgtgtttggggtggcttattccagggaaagaaagaaggcattatgtcgcagagtctcataggaggtgggattttatctcaagtgttgaaggattaagttgaacaaaatgattgaaggtagaaattctagcatggggaatgtgtgaacagaacattggaatcaatatctgtttaggacatgggaaggagatgaacttgaccagagcaggggttttctctagggaaaaatggtatgaaatggtatgtaagatctgcagtacacatcagaatcatgaatgtttgttgttgaatatggttaaggataactggggtcagatttttttttttttttttttttgagacggagtcttgctctgttgcccaggctggagtgcagtggtgcgatctcagctcactgcaagctccacctcctgggttcatgccattcttctgccccagcctcctgagtagctgggactacaggtgcccgccaccacggtcagctaattttttttgtatttttagtagaggcgggggtttcaccatgttagccaggatggtcttgatctcctgacctcctgatccacctgcctcggcctcccaaagtgctgggattacaggcgtgagccaccgcgcccggccagggtcagattgttaagtcttgaatggtaagcacaggggtgtagagcagcatttcctaaactgtattctctgtagcccagttaacccacgaagtgatttgtgaaaatgcattctgtgatcacatgagtgtaggcaacatcatagtccacaaagtgtacatggacttctcacagtcttgaatttgctaatacatactatgcattcccaaggaggtagaatcatagcatgccacgtctctcacactttgaacacagactgcttcccagaatactcacgaacagctaccctgcatgctagttttctgtgtaatgctgtttgaaaagcactggcttccattgctccatgtaggatgaagcattaagaaacattttggaagaagagaacgataagaagaaagtatgattattattgttattattttttgagacgaagtctcccaggctggagtgcagtgatgcgatctcagctcactgcagcctccgcctcctgagctcaagcgattcccctgcctcagcctcccaagtatctgggattacaggcgcccaccaccacgcccggctaatttttgtattttaagtagagacggggtctcaccatggtggccaggctggttttgaacttctgaccccaaatgatccgcccatctcggcctcccaaagtgctgggattacaggcatgagccgctgcgcctggccggaagtatgatttaaggaaagttttatgttgcttaaatctgcctgcagctttttttattcctgcaggcatagatctaggccaggggtccccaacccctgggccatggacctgtaccagtctgtggcctgttaggaaccgggacgcacagcaggagatgaggggtgggcgagcattactgccagagctccgcctcctgtctgatcaaaggcggcattaatttctcatagagcaccaaccctattgtgaactgcacatgccagggatctaggttgcgcgcttcttatgataatctaactaatgcctgatgatctgaggtggaacagtttcattccaaaagcaccccctgacccccaccgccatccgtggaaaaattgtctttcatgaaactggtccctggtgccaaaaagtttgggtctgctgatctaagtagctaagattttaaaagtacagagaagtcctaaaatttcatgccttcctaaagctactgatgggaactaatttcaaagtttgttttgttgttgttttgaatgctgagcttctggctcttattgtgctcactgacgctgagtttgaaagcctctttgcagtggccaggcgcggtggctcacgcctataatcccggcacttcgggaggctgaggcggccagatcacgaggtcaggagatcgagaccaccctggccaacatggtgaaaccctgtctctactaaaaatacaaaaattagctaggcgtggtggtgcgtgcctgtaatcccagctattcgcaaggctgaggcaggagaatcacttgaacccgggagtcggaggttgcagtgagccgagattgcgccattgcactccagcctgatgacagagcaagactctgcctttaaaaaaaaaaaaattttttttttttgcttgttcatcttaggtatctgtctatattaggatgctgccccacctggatggtaattgcttttgggcattagcactgttagaggtgtgtggctggggagagagcaatgtggccacccatttcatgcaacgctctccacaccatcgtggcattgaacgaaggattcactaggagctattgtagcgatacacacgtgtttgggttgaggtgaggttcagcccctctggcagctgttgataaaggttttattgctgtttctagcaccctgctcctaaaacccctctctgacaatttggcctggtagaaccctttggacagacctggtatttgtgttctgtgttgtcagcctctggatcatcacaggatcatgggagattgactccaaaaattgtatcttcctctacccatatttgaatgagaatcatgtggaaagtatcgtatcttcaaaaaatccttgattgcttttttctctgcctttcaattgctatgtttaggagcattttctttaactctacgttttgaaataaggtggcaaataaatatgccaccttatagataaaattagacaaataagaacactggatctagagaaatattaggagaatcaataatacaattaactggattcttagttgtgaaggtcttcaattaaaatctgttcttcgcaaacacaggtcgaacgtcagggtcgtgtgtttgtgtgtgtgtgtgtgagagagagagagagagacagacaggcaggctctcgttctgtcattcagcctggagtacattggtgcaatcctggctcactgtagccttggtctcttgggctcaagcaatcctcctaccccagcctcttgagtagttggagctacaggcacacactaccatgcctggttaatttatttattgtggagatggagtctccccttgctacccagcgtggtctcaaactcctgggcttaagctatccttctgtctcagcctcccaaagttctcagatagcaggtgtgagccaccacacccagctgaaacataagtttttaatgaaagttgtcatgcttaccaaggattaagtgccaaatccctgtgtaattcttttcaacccagatttagactaaaattacagaaaatgagagaaaaattaggatagtaagtacaaaatcctgaagtgatcataataaaagcaaatctgtatttggttcaaattctaagatagataaacatgagtctttcaggagaatcgcttaaaaagaaaagttgttcaggagcagatgcttccaacttttttttaatacagctcatttcatttttcttttggtcaccctaaaatggtgaaaggtttcttcatagccaagtggaatcttttttatttaaactattctcagaaagttttctgtgtatatacatgttgctactctctttggacttgtttgtgtctggtcctcttggagatttttgaaataatcagaaacacttatgtcattgacagtgtttactatctttgaacaattgtttacttttttttttttaacaggtggcatgttggagcacgggcctgagaaacagtatagctaggaggggaattgagtgtgagacactggaatcaggctgcttggattctggtcctggctccactgtacactaaggctgcaaccttgggtgactttgtctctctgtgccttggtttctccttaagtaaaatgcagtgaataataatagtacctgctgcataagttctttgtgaagagcttagaacagtaccaggtacataataagtattaaataagtgttagccatcgttgctaaataaattagtaacaaataaatgttagctattgtttttagattgtattgtttgaaaaagtggcttctcacttttggcgggttttggaagagggagagaaaatgagccagaagggaggtgtaaatctttgtttctaatatgttcactggaacatcttcaactggaagataggatttgactgttatgtgttttcatatgtatgcagaagccatgttattcctcccctcccctgagtcaatgccaagctcctgaacactctgtttatgcagccttggaaaccttctagcttcatgttctctaccagaagcttgaaaacaaccaaagagaatatcgggtttactcaaaaccttgagtggctctttgacacagaagcttatagtatttagcgttctaggaaaccatacacgtgtatgtcagtgttgttttttatggttgtcagtggagggctaaaaatatcagaccctacatacatgttggtgacattggatttttttttgtcatggtgttaagtgattaaaatcaggttattagtgaaccataatttatttatagagtcaaattcaacagaactctatttaatgtcattactgaccatgaaattggcagtttgatattttaggatgacttttgcttgttagatgtttgtctttggaatgttttgagaactatggcccccgtataagtccgatcttgtctctgaagtatttccaagttctttggtttagaatttttcctgatggtttgccactaaaatcaaaagctgtgatgtgtgtttgagaaattccacaatcttctcagcccttagcccctgaattctttctctaaatagtttctctaaacctatatgacttcaactcccatccataatgacttctaatccatcttcactctggactgctcacatttgctctgacccctccagaaggtatctcatctgggttataataccatcctcacctcaaattgaggtgtcttcaaaagagaatccccaaactggttcttcctccttcctcctcaatggctcactggtgatatattcttattcttctgcttagtgaggtgtaatccctagctattcttcactttttcctctcctttatcctccttatccccacagtcattgaaaccttttaaattcttcagtagtactctttctcccaaccatctccctggtcaagaactcatggcttcatgcctatgttagcataacagcctcctaaccagtctgtatgatatggttatttagtcccatattcccttggtagctttctgactaaccttctaaagcctatattttatctttcactcctgattcaaaacttacagtggttctgaggaaagcccagattcctccatcagtttgtcttcatttggccctgctcctaatttgttctcagcatcttctactctgcagcaggaatttcctttttgtgtttagtgtcaaaactaccatcacaccaggcccattcttcctttatttgaatgctttagaatctccttcactctgtttccactcaggtatctctctgccatccttcaagcttcagctcaagtcttcctgttctccttcatctatacctcttcactaggagactcagaacctgcactttctttatctctcatttcttgccttgggtgaacacatgttacctgtccattttgataactccctaagggcaggtattattaatattaggtttctgtgtccctcagtatgatttatataccatagtaggtactaaataagagaatgtggagtaatcctctcccaaaacttggggaagtcaacacatacactgctctacttgggatccaatgagatggcatatgaggcagcattcatagaaggactgtgcaaatgtaaggcagtgtctttcattgctgggcacatttggggtttttgatgatgctgtcctctattccagaatagcagtatgtggtcaggacttctcatgagtttcaaagtttaattggagacaaccaaaatgtgtttccaataataggtcataaaaaataaggcttctatttgcgcatatgtttacttgtttatttacatattttcctaggtcttttatttcctcactgtgaatatatttgtttttaaatgcaacagctgactaggataaaggtgctgttttctggtcacctctgcattgccatggtctttgttattgggccaagaaccttatttatcttaacacacacaattgcttaaggatggggattatatcatcatcctttgcatcattgaattacactgtgctgccttcccacattgtcatgcgtaccaactatctaatccagaatgtcacacgctgctccctctaagccatttccatgtttcagctagtaccagccgtgaaaaatcgcaggcaagagcggggagctgcctgcattctccagtagggcaccactctacacctaagctctttggtaaaaggggatatagaatctatagctgtaagcaaaaatgagtcattttcacatctgattaacatacattttcttccccagataaacctgtatcttcattaatttttttttccttatcctttttacccaggtagttcatatcagtgaacatattggtctttttttcctctttataggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggtaagaattttttgtccctcttagaaaaattttaatgcatttactttaaagtgctggagatgtgaggtttttcttgtaagtaggtaatatgagtatagttcaaacattttgtttttaggatatcaaaattgtaggaaccttcattgggtcctttcatagtgatgaatcagaaaaaagatgaaagagtacagtacagataactttttcaaacgttcaaacatttatgacattcttctggtttcagatcccaatgctctctacgtgtcactcctggcatgacccacccacacacaaaactcaatagagccagagacaaactcattctgtctgttttaacactttttcctttgagttttgtgcttcaaagatcgttgttctcatttctctgctgtcccctgctccccagtcactcattccctattcaagcagtttgccatgccttccaaatatttctctaattcacccccatttccccattctcctatttggccctgaccatctccggccctggctggttcagtcaccttcttactgggctatctagtctatcatggacagtccctactgctcccacccttctcaggtggatctccttatgttacttttgttattgactgaagagtgtatttcaagattttcagcatttcatgccccatctttctctttgccataatcttcccacacctgtattccctgatgtctttgatttggtggtctagttctggtccagtttctgaatcagtgctgattgagacatagtacatgtaaacgttttccattctcccctcatctcttcccctatccaatgggcacttaaaattaaaatgactatcctaccagaaatttggtggcccagtaatgacctctgggttgctgtgtctttcctgttgttcccactactattcagacccactttccttccccaacatgttgtcatttggtggcttctatttatagttcttccagccaccttgtattaacctagtctaggattatacctgggtttctgttcctaaattttgactagttactaaggttaataatcttgtcttcctctaacgtggcagcttagacttcaatttattcttgagagttggagtgccttccatctgaattcttcttcttttttttttttttttaagatggggtcttgttctgttgcccaggctggagcacagtggtaaaatcatagctcactgcaggctggaactcctgggctccaacagtcctcctccttcagcctcctaagtagctgggactataggcgtgtaccaccatacctggctaatttttattttttgttgagatgaggtctcgctttgctgcccaaggtggtctcaaactcctggcctcaagctaccctcccaccttggcctcccaaagtgctgggattataggcgtgagtcactgcccttggtctgaatgattcttatcaagactggtgatggtggcatctaagaacagctgggggtgactctttgttcactgtgtgtattaatttcctctggctgctgtagcaaattaccacaaacttggcaccttaaaacaacagacatttaggttttgacagggctgagctcctgccagaggctctgggggagaatctgttccttctctcttccagcttctggaaactgctgacatcccttggcttgtggcctcatcactccaatatctgccccctccacggccacattgccttcctgtcttccatctgtagtcaaatctgcctctgcttccctcttagaagcatacatgtaatgacatttaaggcccaactagataattcaaaataatccccccatctcaagatctttaatttcatcacatctgcaaagtctttgcatagaaggtaacatttacaggtcccagagattaggacctgatatattggtggccattattctgtgtactacactgtccatctaggttgggcctgctacttctcctggaagtcccactcttgaccatttctgagtcatggttcagtgcactatgccttcctgcttctctgcctctttgtcttcctcacctctacctacagaactggccttagcaatgctgtcggtttccccaaggtctgtctcaggcccaggggccagggctacctcctgttcctgctgcttctcttcctgtacacttgcctccttctcttttattgagttgtagaaaataccaagtctcttttcaaaaatctcgtcctgtgatgcctccttcctcacaaagaccttgcaatccaggcccttccgggctgtctgcgttgtgtgacacttaactcggacatatgtagacatgccttgagatgtgggctgccatttatttatctaaaatgccccttccccttgctctatattgggtgaaatattgtacattttgcaaggtcttgtttaagtgtcaaattctctgagactttcctaagcccctccccctcctcttttccatacagaatcaattacatcttccctctgttcttccttagcactctgtttatacttgactcaaacccttcccacattgtgttatactttattttgtctctgtctctccttgctggactttgaggttcatgagaaccaggaaaaggatattattcatcttttttaattttaacctgacatggaactcacaatacatccttgatataataataatatgtgtttaattaattgattaatttgaattttaaacttttcataattcagaatatcttagaatagatgaacatttaatacttttctcccaatttccttatggacccaagagtaattattttccttagatggctatgtacagtcaagcatggcttttgtttccagtataaattaatttaaaatactgtaatttatgcattctcttctttacattttgttcagtgtgggggttattacccttacccctctagagagccaatttacttattttattttatttttgagacagaggcttgctctgtcatccaggctggagtgcagtggcttgatcacagctcactgcagacttgacctcctgcactcaagcaatcctcccacctcagcctcccgagtagctggcaccacaggtgtgtgccaccatgcttggctaatttttaaaattgttattgtttgtagagataggggtatccttgtgttgcccaggctggtctcaaactgggctcaagtggtcctcccatctcagcttcccaaagtgctaggattacaggcgtgagccactctacttggcccaatttactttaatatgagatttttctaaaccttaaaggctaccagtgtaatgttgtcacttgattgtcttcttgtagatccagacttttaagcaggaattaggaatgttatctgtgaagattgcttcttttcacttactggtgctctactgaaacaatactattttcctcccttttcctgggtgttttgtctgagtacatgtgaatgtcagagttattttccctgccttgtcactggaatctgcagccagcctccctgattgtgaatgcatccatgctgtacagctggcgtctgtttcctatttctatagccgtgagtctctcagggcttttgtagagagtacgggtgttttattacattgcatgtcttatatgtatgagaaacttaaagggctttgaggattttctttttcggtatctaatcttctaacagctctctgaggtaggtagcaggaagtgttatctccattttgcagacgttataacagaggcatagcacaacttgatgtaggccccacagcaaatcaagggctgagtggaaaaggtctccctagtctttcaacctccacttcaatgcactagttgccagacaagttaattttaatttttaaaacctccatccattttggttttgcatgaaatgttattgtcagcattcaggtggtagcagtgctccagttctagtactacctttcccatcttctgcatccttctagaatcccttcttgcttgtcacggtcacacacactcataagtgtgtctctctttttatgtgtgtatgtatatatgtaaataaagaaaataaaaatatatactctttctttaaaaagagtttctgtacaacattaggttctgcagaggggttgtttggtctggggactatatgcaaatatgagatttctgtattagcagcatatctgatactttccaactagttttttttttttcttgtcaatcaaacatactatgtagatattagctgtaggcaaggaaagatttaaaaatataaccgacatgggcaatatagtgagactctgtctctacaaaaaaaattaaaaaaattagcagggtgtggtggcacatgcctgtggtctcagctacttgggaggctgatgtgggaggattgcttaagcctgggagttggaggctgcagtgagctgtgatctcaccactgcactccagcctgggcaacagaacaagaccctgtctcaaaataaattaaaaacatatatatataacctatgacaatgggaaacataagaagtactataaaactggatatcagatactattaataagtgaaataaatgtttttactcaggtaattcctctatgtgacttatggtatcctcaaagtgagctcatactgtaactttcacataactttccgtcaaatgtgaagatttttttcttctctcaggggacagttaatgccttttggtaaatgtaaaactgtactgcgaatgtcagttcctgatcagatttgcctgagtctctaaagggaacatgacaaggggctttgtgcctgctgtgtagggtgtgtggtaaggcgtctttcttccttgtggctgaatttggaatgccccgctctttcagtaagtgccattaattacactattgctcctagagcactgaactgctcagcagggaatttctccccactttctggagtctctggggcagtttccattcattgctgtgggtggtggtgaggcacaggctctgcaccagccgcctggctggaatccgcctggagacctctttgtgatttccctgagctgggagaggggatttggagcacctggtggggggatgcagcttgccaccctcgtcttcgtcagcctctcccctccaccccctgcacttgggagcaccacccggcagcagtgtttttgtgccttgaaaccttttggagccgctggaatggaggccacccagagcttctgtgagcagctgtagctgcagatctcctattggccagagcagagaatgttcttacttatctccattgagcatgggtggccgtgatccctcaggataatgcaatttctcactgtctggaggtggaagctattgtcctgctctccagcttgttgtttgaagtctttttgtaaggcttccggcttctgctgactcacagacacacacagaaaaactcccttactggcttgctccctcccaaggcttttgaaatggctaaggagataacaaacctcccccctgcaagggggtaatagcttaaatagtaagtagaaagaactgttttgtacatgtccacaaagtctgagaaacttcatcttcctctttcactgctcactccgtttccttccttgtcccttactcccctcttcaaaagttttgggctgagccacaggcctaaatgtggtttgcatatgatttttacagaggcacaattcacatctggggactttttcagattaacaagttgaaggatgccatctttgtttcccctatggaaaattgccatttctaatgaacattttatgaagaagccttcttcacttacctctcccacttgtgataaactgtaattaaaatgtatgaagaacttgattcatggtgtatgcacctgggctctttgtggagtctctcttagcaatatgccgtgagaacagactggcagttgatggatttctaaagcagaaaatcaagcttattcacaatagaagcttatagttttaaaaaccacatggataagaggactgtagttttgcaagatttggcaatcatcgatgaacccagtagccacagtgaccgagactgaaaatgtagaaggctagctttccttcttaattacttttaaactacgttagcaaattctcagggtcagtgtgatagtgatagtttcaatgcttgattatagtgattttttttcgcataataattttcttatgttcccgtagcgtaacataggtctttttattaattaaggagaaagagaaagattgtgtagaaagcattcttatgtggtagcatgtgtgaacttcttataattagcaacatgtcctcattgcgtacttagaaaaatccagtgatataaatcctctattttgtgcagtcactatttacccaactaaatcatttaactgataacattcacacctttctccatgatattttagaataatatcaatgtacaaaaataatctctgtcctttcattgtcatcagtttatgaaaatactgccaaagagttggaaaacaaagttttctcatgttttacaacacagctcccctgggccactgggcctaatttgttcttactaattttcaaaagagactccatcctttagctccccagaaatatacaggctgtcctaaagaagccgcagcctgatacagaaactctgccaacttctaggaaatggaaggttctggaaagtagatcatttttccctctggtaggaacaatataagttttagacgtgggtgggggggtgttgtgtttgtgttagacatatatgtatacagctgctagtgcaaaaatcacaaacctttcagtttccctaaggcttgtctgcagcccttgtgccttgaatgcagattgtaataaatagaggcagtctctggctggaaatgccggacatctctgtttgagttagagctcttgttccaggcgtcaggggattaagacagagggttgttttctagcttgccctagagcccctgggcctttgcggattggcgtagttgcctttctgtgtgtgcagaatcttgcctccagcctcccacagtgtggggagagagaatagggagaagtgagggaagggaggtaaattattcaacttctgcaaaatgtcaggcactgtgctgggtactgtacatatatttcactgaaaagtaagtcttttataaatatggcaatgtagagcttcagagatgggattttggagccagaccgccgaaatcaatgattttgccaggattcaaatgataacttggccactttcgaggtataggactacttggtgcctcagtttctccatttgtaaagtggggataatatcagaactaacctcaattgtttgttgttgggattaaattgtaaagtacttagaagcgtgcctggcatgcagtgatagataagtgttacatgaaaggaatggaaaacagaagttaatccacttgcccagttcaactagcaagtagctggggcaggatttgaatctgggtctgttggcttaaaagagatgatttttgcctggggaacatggtgaaacctcatctctacaaaaaatacaaacattatccaggcatagtgatgcccccctgtagttccagcaacttgggaggctgaggtgggaggatggcttgaggctgggaggtggagcttgcagtgagctgtgattgtgccactgcactctagcctggggtaacagagtgagaacctgtctcaaaaaataaaaatagagatacgatatttttaccttaccatagcaccatactttcttttcttcctagctacatttgaggtggtaccttggagtcaattctctccattcctccccaccttacctgatcaggggtggttgctgtatcagtctagttttcccttttccttgctcttgtagagacatcgtagggccaggactcagagcttaaacatttaacatcttctgtgcaggcaggtgataatagcttctttcccccaaaccactgtggggttgaactaaccattttagttgcatggtcaattttttgggctggaataaatgatcttttgttctttcttatagttatttgatgtgttggttcttttctttactcaaaaatagaagcatctaatgagcagcctcgatgtcacacacttcctgttgtactcacccaagcagttgactctctgctgagcacattggtagcagctcatgggcgtttgaatggaggaagaaggcatcatattaaatggcttttccctgtttttggacataaaatgccatgggacagcttttttctttttcgtggcggcaggatcaagagtatagagtctggatttggagatctttgacgtgtgctttgcttcacctggcaatttctgctgggatttccagttgtaagcccatgtccctctatcctgcgatccctctaaatgtctggagttggcttgaacctgcatatcttatgccaactttcctctcttaagaaatgctgctaaagaggtagaacatatttacaaagtccttagctgtgacgatgaagaacataacatttggtctccagtaaggaaaataaaaaagggatttgattacttttgccccagtcccacctaattcacctacacatgtccagtttactttggacaggagttttcattaatgttaaaatgtatgtaaactgaagtggggtttttgactaaggacacagggtctctaaggcaagacaacactattaatagaatgtggatgtgtgtggtttatttttgttttcaaaatggaaatgtttcttcggggttttggcatgctctttgatatgttgaaagatgagaaaacatcatttgggaaactcagcacttctaccatattaggaaatttacagtgcttcagatttcacatttaatgttttaattgcctggtttggtaatagaaaaatgtcaagcttctctctttcatttggagttaccaccacgtttttttccctctttgcagtgatgggctgttgccagcttctacttactgccccagtcccagcatggactgagtatttgctctgagaaagcagttcctcacatgtcatctgaaatgagtatcaatgtggacttctgacatactggtttagccttttttgtatgatatcacatatgcagttgtttcctgtggtgcttgtaaatatcctaaatgtacaactaaaattgaattgtctttttgaaacttttaaattgtttttgaacagagggtgctattctcaacattacataaagtacagaagaagtcaaagaaaacactgctattctgatctgagagcaatctttaggaaaagcctgtacattacaagagagagacagacacacatggaaacagagaaacacacacgcagatcaaggcagagagaggcagacagaaatggagactgagaaggagagaggagggtggagttgtatattctgtgaagtgtaggccttttggaaaaatcaagacccaaaacagagttgaaatttactcttcttataaatataccttcctactgaggaaacaatgatgaaagaacttccagaagtaattttttgcggacaataaaatgtggagggaaaaatcctgtacatcatctttactgtcatacattgtcacaggatttagaggggaaatatgcttttatctggggaattagggctctattgctaagcagctgagtacaggtattttcactttccctgcacagttatctccaaacaatatttgcaaataaaatagttatttcatttttcaatatccaaatataatttttaactatatagtaagtcatacttagtatagaaaatttggaaaaatacagaaagacctccagaaaaaaataaaaataacctgcaatcatataatctagaggtaatttgaatgtatttccttttagaatgtgtttctatgtgcttatgtctatatgtattttttatataagtggaatcacactgcacatacattttagattcttcacttctctctataacaataaacatgttatttaatggttacattgtaattcttggtaggactctatcacaattcattttaccatttccctatgggttttcttcttcactaattacgttggtagtgatctatgggttaggttaagaaatgctgtaaagaggatctttgagtgtgaatagtttttctggattcctgattattttatcaagttatgtttctatataagaattattgtgtctttttaaggcctcctttgcacattgctaaatcacttcgcagaaaagttgtatgccttgaactctaacatttcagattgctcatctttcttacctgagacaatactgacccacttttaagacctccttcatctaacatgaaaaataatactttatttgttactttaactttcattctttgtgaattatttgttttattggaacttttattgttatgttttattggttgtttacttattggctgctgtaaattctctacaagcgccttttctgtatttctactgggattttaatgatgactgtatagattagtgtgacttcttatttattcaggttgttaactcttgtttgacttacttccttttttatacatacagacataaaatctaatttttatctagtgataaatgctttgtaacatcatttttctttcctttcccttatttttttttaatcttctcttaatttttctccctctgaaatgcccttgaaatttctttgcttctcagtcttatctctccacttctccacggtcttttccccagaatacttttccaagctcacttcctgccatgatcccaaccaagtcttgcttcatctggatttctccacttttccccttatgcacagttttgctttcggtgatttctattacctgcggtcaactgtggtctgaaaatactaaatggaaaatttcagaaatagacaatttgtaaggattaaattgtgtgccatcctgaataatgtgatgcaatctcatgccttcccatgccgttcctgctctggatgtgaattatccctttgccagagtagccactgtatacactgcctgtccattagtcatttggtagccatctagccatcaaatggaaaaaacatagtgcatatggcataggggttggtactatgtttctgtttcaggcatttactgggagtcttggaccatatcccccgtggataagggaagacaactatacctggcaaattccacttgcagctctgtgtgtgtgtttcccttgacatgttatcgtggattcttctttctcttttaagacagagctggtatgccacctctttcatacaaccttccttcacttcagcatgtggtgatctgtccttgctctgttttcagtgctcattttgcactttttgcacactaatttatatctttagttataccttcatgtgtgtatgttttgtcaccctgtataggctgccaggtccttgtaagcacagatgctatcgctctcatttctctgtaagccttatcctcaccttgggcaccgcccaaaaatacttaggacagtgctccatgtatgggacaactagacacttagcaatatgttgttgaccgatcactctcgtgatactttactttttccatcttatttctttttgccttctgcccctcccctccccgcttccttcttcttctttttttttttttttgacagaatttaactctttttgcccaggctggagtgcaatggcatgatcttggctcactgcgacctctgcttcctggattcaaatgattctcctgcctcagcctcatgagtagctgggattatgcatgcactaccacgcctggctaattttgtatttttagtagagacagggtttcaccatgttatctaggctggtctggaactcctgacctcaggtgatccacccaccttggcctcccaaagtgctgggattacaggcatgagccactgcacctggccttttttttttttttttttttttggagacaagttcttgttctgtcactcaggctagagtacaatggcatggtcatagcttactacagcctccatctcctcggctcaagtgatcctcccacctcagcctccttagtagctgagactacaaggcatgcatgaccacgcccagctaatttgttttcatttttagtagagatgaggttttgttatcttgcccaggctcatctcgaactcctgagctcatgtgatcctcctgccttggcctcccaaagtgctgggattacaacatgaaccactgtgtccggcctattgttggttttcttactcagtataaagaatcacttggtacactcacactggaagccatgttccctacttgctctcttccctttgaaacattatcctatgccttctttataatatgccatgttcaactaccagagaatctttttttttttttttttaaataatttcaacttttattttagattcaggaggtacatgtggaggtttgctatatgggtatattgtgtgctgctgagatttggggtatggacgatcctgccaccagatagtgaacacagtacctaataggtagttttttagtccgtgtctcctcactcctcccactcccacccccaccaccaactctagaaagtctgtggtgtctattgttctcatctttatgtccatgtatactcaatgtttagctctcacttataaatgagaacatgcagtatttggttttctgttactatgttaatttgatgatgataatggcctccagctgcatccatactgctgcaaaggatatggtttcattcctttttttatggctgcatagtattccatggtatatatgtaccatattttctttatccaatccactattgacaggctcctaggttgattccatggctttactattgtgaacagcactgagatgaccatataagtgcatgtgtctttttggtgaaatgatttatgttccttattcctttgggtctatacccagtaatgggactgctgggtcaaatggtaattctgttttaaattcttcgtgaaatcaccaaattgctgtccatagtggctgaattaatttacattctcaccatcagtgtattagtgttcctttttctctgcagcctcactagcatttcttttttgtctttttaataatagccattctgactggtataagttggtatctgatagatttgcatttctacggagaatcttgatgtcatcagaaactgttaggcagctaatttcctcattgtatatttttgttttcttggtggcttcatcaatgttatttgctgacttacacacttcttgcctctcaccttctctgccaaatctccatgctttataacccagacttacccacggtcgagttctctagacttggctcctctgattgtgtgagatcctcccacatttaggaagggggagctggtattaaatatatgtgtgaaatacttaaagaataaagtgtggaatagtgaaatatgggccctaatgcactaggagatcagaaggagacagtgggtatgagctgattgactcaaggacagctttataggtacagaggagatttattatagatataggaggatgggtaggatctagatggggcatgaggaaagagagggcacttaacaattggaatgagagtaaacaaaagccctaaaacctttattattagtaataatgcttggtagaaatgaatggggtatatacatgggaaatggtatataacaaggatgtctaggtgggcaagaggaggacatagttatttcttagaaggaagtcaatgggtgctatgcatggccaccgaccatgaatttctacagctgcttgctggatcctgctgagtggttttcctcaggactgctgctgcccctgtggcagccatgccagcttctctcttctccctcctgtttagcctcccactgggaagagctgctatgtagagacttattaaaattttctcaaagagtggcaggatgcagtggctcatgcctgtaatcctgaggtgggcggatcacctgaggtcaggagttcgagaccattgtggtcaacatgatgaaacccccatctctactaaaaatacaaaaattagccagacatggtggtgcacacctgtagtcccagctacttgggaggctgaggcaggagaatcgcttgaacccgggaggctgaggttgcactgagccaagatctttactgcactgtagcctgggcgacagagtgagactgtgtctcaaaaaaaaaaaaaattttttttttctcaaagaatttttcaaacactatctcattggatgcatgtgataatcttgggctgtgctgttacaccaatttgcaagtaggaatctgaggttctttgaggctaaggaactttcctgaagccacaaaactggtaagcagcagaactggactgtgaggctctggcccagatgtggtcggcgctctttgtggtcagccaggccacaccagaggccatttgcctgcttttctgttcattcattcatttttggtaaatcttgtctgaccatctactaagcgctgggtcccaagttaagacaaaggtaaacaaggcccttttcttgctttctgttccagttggatagggatcagaaaggcaaagccggcagttgcagtctcatgtggtaagggctgtagggagatgcccagggtgctatggctacccctaggaaggactttaagggtgaaattgtgccaggggctaaggcttcctagaggaagtgatagcagagctgaggtaccaggaaagatttaaatgttctttacagaaatctgtaacataaaaggcgaggcaagagagaggaatggtacatttggggaattaaaagtagttgaatttgcctggaatgcgaagggcaagttggggaatggtggaagatgaagctaaggacaccttagcttaaatctaccgaggccagatcgtgtgtagttgtggaaaccatggttaagagatcttcactgcccagagcacagtgaggaactgttggaaaggttgggagcctgagagtgacttgatcaaatttgcagcctagaagaattcctctggtgcagtgggaaggatgggctcactgttgcaacagttattgcagtctgttaaagtagagacattagctgatagcataaggtgcaatagcataaggtgcgatagcgtaaggtgcttttctcttcttcagtctctgcagtagcattctggaggaatccaaaggcctcttccagagcaaagctaaaaatggtggagaagggagaagcggaatttgctgtcttccatgatttggttccaaatacacaagccttgttctggttctttttaacatctgtgtgtctcaagtcaggaaaatggcttgaaaagccataatatcatcatagccctagcgttcagattaccttctttcaattagctaaccaagataaacttcgatttcatgaaagttgtgtactttatctccaagtcatgtgactaaaaaagccaactcttttaaaaacatacatgtttctacacgtttagaataattttaaagtatctatctatagcaaatataattttaaacatccataaaacaaaaatatagctcaggatcttttcattagggtctgggttctcaaagagcacgttgcaaggtaaagcaaagaaccttagagaaaatgttaagtgcttctgtcagacagagttttctcaagtggctgaatgtttggactcacagagctgctttttttctacgtaaagaaaactcttctcttgtagacccctctacatttttctcataagcaattctctttagagattacttctctaatttatccctcccttcccctccaaaaagagagatgagagattatctcaaggagctggcaggacagaatcaaaagcaggggggtgtgggtgtggaataagtcagtgcagacccaggtccttgccgtcgctggagatctctgaactttgccgcctccctctttgctgaggtccctcaggtggcctcattgtttctattaccttggtagaaagcctgtgtgaagtccctgcctgcctggcagtctcgttgccatggaaacttccattccgcacacctgattcacacatcacgcttggctaagtccagacagaggtcacagactggcatttgccctttgtttccccttcttgtgttttccaggcacttaaaaatggatatagaaagatgagagggtgggcagtgttgtgtgtaagaacgctttgttgtcaactgtagaagtgtgtgaggaaaaaaaaaaccaaaaaaaaaaaaaaaaaccaaaaaaaaaccttgtaaatggaagagcagagcaaatggcaaagtgtgcatatagttctaaccttctcgtaagaaagcaaagtttgaatcctgtaatgtgtctgaaagtgactttttttctggatttctaggtgagattggaaatgggtataatagattccagagtctgcggctccacagggagttttctgtcccctttcaccaagttgctcttacactctaggattgcaatgtgggttcaggtaaaccatccctgacagctgtatgttaagaatcaaattctctgatgttgctttctatactgcagctttacttttacataaagtgtaatactttagaaagcataaatacttttgaggaaattatccttcgttagaggtcaatacatttgctggagtaattttctgtttaccctctgattttttcttcttcctgtgtaacttctttaatatataacttagagaaaaggaccatgtaggaaggcagattattaaagttcttgcccaaccagaatttctctttcttaggttgagtcgttttcttttgattcttgtttataaggctgagatttagagattaaaaaaaaaaaaaaagactttccaagggacatgggacacggcattcagccctcctaaaacattaagttggccaggcgcggtggctcacgcctgtaatcccagcactttgggaggccgaagcgggtggatcacgaggtcaggagtttaagaccagcctggccaacatggtgaaaccccgtctctactaaaaatacaaaaattagctgggcatggtggtgtgtgcctgtaatcccagttacttggcaggctaaggcaggagaatcgcttgaacccaggaggtggaggttgcagtgagctgagatcatgccactgcactccagcctgggctacagagtagactctgtgttaaaaaaaaaaaaacgcaaacaaacaaacaaaaaaacccacattaggtttcagacattatgtgcagtgcagttatcatgtcttggcagtcgggttagctcgtgagtttctgtttgctcttacctccattgacgcttctgtttcttctcatttgtcaatattcctcctgtttagatggccttgatttacaaaatatgcccttactaccagcagtcaaccagacctgggtttcaaatctcatctaccttatgtccttggataaaattattagcctccattgtctcatctgtgaaatggcgttaataatacaaaactgctgtaaaaaaattgtaatttttacagtagattgcaagatacctgccacacaatatctattgttactattatcctgttaaatcagtttagaaataacatttatagcatgtgaaagcatatgcttgctctcagtgttactaagtttggtgttgttcttgactttggccaaggtaaggacaggttggggctaagtatatggatggtggatggaaataaattataatttttacaaaaaatagagcatgtacacacacattctccttgtctttttttcatttgtgtactcaccctcagtctattttttgaatctccctacaaattcaagtggcaaaatgaaaaggttgtacaagtattggaagataaaatattgtcatagagacatttagcgagcagtggctctgctctgtcagcatttccaggcagtcatagaggtacatgtgtgaattcccattctcatgaccccaaggccattctaatccccccattctaatcccctggctcctcacctccttccccttcctctcactgttctcacattttctcctcgtttttcctcctctcctctccttctcctccttttctccccgttttctgtttcctcctccctctccccctcctccttgtctttttcttctttctttaaaattgtggtaaaatatacctgctacagaacttaccatcttaactgtttatacgtttatggttctgtgacattacaaacttccacattttttgcaaccatcaccatactccatctcttgaacttttgatctttccagactgaaacgctgtacccattgaactctgactccccatgcctgcctcccatcacagccactggaaaccaccattctactttctgtctctatgaatttgactacttttggtgtctcgtataagtagggtcatatagtatttgttcttttgtgactggctcatttcacttagcataattagccttcaaggatcatccctgttgtagcatgtatcagaatttcattcctttttaaggctgaatcatattcaattgtatgtattaatatataccacatttttgcttatccgtttatccatcgacagacacttgtgtggctttcacatttagtatttgtgaatagtgctgctatgaacatgggtgtactcatatcccttcaagagcctgcttcaattcttttgggtacatactcaggagtggaactactggattatatggtaatcgtatttctaattttttgaggaactaccataccgttttccacaatggctgtaccattttacattccaaccaacagtgcacaagggctccagttcttccaccttttcaccaacatttattttctgatttttcgatagtagtcattcaaatgggcgtgagatggtatctcgaagttttgattgcatttccttagtgattagtgatgttgagcatcttttcatgtgcttattggccatttgtatatcttctttggagaaatatctattcagttcccttgcctgtttcttaggttgtttgttttgttgttgttgaatttttaggtgttatttgtgtattctgaatatgaatcccttatcagaaatatgatttgcaaatattttctcccattctgtgggtggcctttttactctgttgtcttttgatgtgcaaaattttaaaatttttaaatgaagtctaatttatctattcttttccttttgttgcttatgcctttggcatcatatccaagaaataactgccacattcaatgacatgaagcttttgtcccattttctcctaggagatttatagatttaggtcttatgcttaggtctttgttccattttgagttaatttttgtatatggtgttatgtaaagtctgacttcattctttcgcatgtggacatttcattttcctggcaccatttgttgaaaatgttgccccttcccattgagtggtctcggcatccttgtcaaaaatcatttgaccatatatgtgaggttttatttctgggttttctgttctgctggtgcatctctctgtctttatgctagtatcaccatgttttgatcactgtagctttgtagtaagttttgaagtcaggaagtgtgaatccttcagctttgttctttttcaagattgtttttggctattcagggtcctttgagagtccctatggattttcgaatggatttttctatttctgcaaaaattgtcattgggattttgatagagattgcattgaatctacagattgctttgggtggtatttatatcttaacggtatgaagttttctaattcatgaacatggtatgtgtttttatgtatttatgtctttttaaatttctttcagaaagtttttattgtacaagtctcttaactccttgattaattcctaagtatttcattgtttttgatgctattataaatggaaccatttttgtaatttccttttcagattgttcattgttagtatatataaatgcaacttacttttatatgttggctttgtatcctgctactttattgaatttattatctctaacaattttttgagtgcgggatcgggggatctttcggagataagatcagatcatttgcaaacagaaatagttttatttttcctttccaatttggatggcctttatttcgttttcttgcctaattgctctggctagagcttcttgtaccatgttgaatagaagtggtgaaagcaggcatccttgccttatttctgatcttagagtaaatgcttttagtctttcaccattatgatgttggctatgggttttttcatatatggattttattatattgaggtagatttctttctagtatgttgagtattttcaacatgaaagggtattgaattttgtcaagtcctttttctgaatcaaccacattgagatgatcatgtggttttagtctttcattctgttaacattatatattatatcaatttttctatgttaaaccatccttgcatttcgggactaaatctcatttggttgtggtgtataattcttttaatattctgctgaactcagatggctagtattttgttgacagtttttacatcagtgtttataagggatattggtctatagttttctttctttttctggctttgctatcacggtaatactggcctcatagaatgaattaaaaagtgttttatcagccgggtgcagtggctcatgcctgtaatcccaggactttggaaggctgaggtggatggatcacctgaggtcaggagttcaagaccagcctggccaacatggtgaaaccccatctctactaaaaatacaaaaatcagctgggcatggtggtgtgtattggtagtcccagctactgaggcaggagaatcactcgaacccaggaggcagaagctgcagtgagccaagattgcgccactgtactccagcctgggcaacagagtaagactcagtctcaaaaaacaaacaaacaaacaaaacgtgttttatcttcttcagtattttgaaagagtttgagaaagattggtgttaattctttatttttatttttattttttgagacggagtttcactcttgttgtccaggctggagtgcaatggtgcaatctcagctcattgcaacctctgcctctcaggttcaagtgattctcctgcctcagcctcccaagtagctgggattacaggcatgtgccaccatgcccagctattttttgtattttttttagtagagacagggtttcatcatgttggccaggctggtcttaaacacctgacctcaggtgatccacctgcctcagtttcccaaagtgctgggattataggtgtgagccactgcgcctggcttacttctttaaatgtttggtggaaggttgtgcatttttaaaaacagttttaaagaatatatttaatcagctgaactgagggaattgttacatttaggataaagagaagtttggaaaactgtggggtttccagattcattgttttatctccaagtgacaattcccttctgctctcccgagtctttaccacaggactgaagattcagtttggcctctgtgatgtggcctggccgacagtctgttgctctctcatcctttaggagtcctggatgattagtaagcattttctcacagcaaatgattcagaatgaaatgtagttccagatacaaaaattatttctgaaaataacctcacttctttaaaaccatttctgttatatgttgatttaaaagcatttatactgatctccagtcaactttctctttctcttggtgttccttcttcatccctctccccactctctttctctctcttgcctgcccacctgcccgcccccctcccttcctccctccctctccttccccctccttcttccttccttgcttccttccttcctccctccctccctcatggaatacccagaacaatactgtctaatagacatataatataagccacatgtgtagccatgctaaaaaaaaaaaaatgaagagaattaggtgaaattgattttaataacacactttatttaacctaatatatccaaaatattatttcaatatttaattaatataaaaattaatgagctatttaactgtatttttcatagtaagtctgtgaaatccactgttttaaacttgagatacatctcagtttggactgatcacatttcaaggactcaagagccacatgtgtctagtgaccactgtattagacagtgcagacctagtgtatttggtaccaagcacgtaaagtccagaaaagggcagccctccactttgcttcatggacaggacagatcaataaaggatgaatgatggctgtgagtacctggggaggagctgtgcatagagtattagggaagcccagaggagggggtccaaaggcagacctgtgagctggggcctccctgcaacttacttggcttgttcactaccactagatctcatttctttgaactagtcccctgtggggaggcaactgagctggagtttggcatgggccccagtccatcagacattaactttttgcctcatgtattaagagagccactggcaagttcacatttaattacaggctctgctctggccacaggtttgggagctgggattttggaatcacaacctcactgctttctgttctggtctgcctttcattcccacacacaggatggctcatctagcttcctggagattgctctccggccaggtgcacctccttgcttctttttactgcagtgcccagaggaagatgtaaagtatgactgagggaagggaaggaagaaaacatttttattttcttctttgtctagacacctcccctactcatctctgggaggcagcaccaagagctctggttgttaatggaaaggtcatcaggtggccttctgtggatccaccttgtccccaccctggccactgtgcctgacctgcttctcagggatttagagaggtagctaatgtggatggtgtggctccagcagttaggcaagtgtgtgtatatccaggctccctgcttggggaagggtggtagagagatgtttacagatatccagccaggaagtgcaagggaagaggaggagctgtttccacttaccctcctacctccttttggctttctcttctggcattgcctacggccaaaaagggatgggaatttggcaaagtaaaagtatctcattgtacttccccacccctccgtctcacctcccttctaagacttttttctacccaggtcacttaatactcaaagactgcaaattcctttcctactgctgatgtggaagaagcttggaaacatgttcctttccaggagataagtgatacggcagaaagacgggtcagatgaggccaagggattggagccagagtcttaccaaactcgcaggcagcttgtgactgcgggcatgctgtgctgatggaggaggggaggcctgggggctccatgctgtcgggattcctcccttgataaacagagtcaaggtgggtagggggaccttgtgagaggtgtccagccctttagaagattctattagcatgtgttggcttgttaaatgatctacccattgagattggtggcctggtccaaggctttgcttctgataccacttaatctcttttaatatttgaactctatactattaacatagatttctttgggaactgtatgcattttccaccacagggaatcaaatccagcatataaagatggcaagaatctcagtaattacctaaattcatgaagaagccaaagtaaaaatatttcttctcttgggaataataaaataaaataaaataaaataaaataaaataaaatagatgagagctgaatagctcttctccttaccccacactcacaaatctcctaaaactcaaaattaatgttacaatacacattagcagatagcatttttatcgataagtgttaaattaaggagttaacactgagaaattgaaactgattaagaaaatggaaaaggccacagtatttgaatgtcacatatgcatacttatattgtaccgtagatactgaaataagatcattgttactggtgcagcctgtggtcaaatgcattttttttctttttttttttttttaagacagggtctctttctgtcgcccacgttggaatgctgaagtacagcagtgcaatcatggctcactgcagccttgatctcccagctgctcaagtgatcctcccacttcagtttcttgagtagctgggactacaggcatgcaatactgtgcctggctaattttttaaatctattttttttgtagagacaggttctcagctcaggctggccatatgcattttgacaccccaaaatattttgaattattcttagtttcagtagatgagatgagtgatcatttgagttccttcaacaggtcattagaccagaccagaagcgagctgtgatgataacacaggctgtgggcaggcaggcaccatgaggcacagtgagagcaccaagactgtgggctttgggtttgaatcctggctccactactaatcagccctgtgcaagtgactcagcctctcttaacctcatttattttctgtaaaaatgggaattgtagatttatatttatggagattattaagataatctgtgtaaaatacttagtccacagtacctgacaaatattaaattctgaggaaatattaattgctattattactacttcagctctgaaaatgctgttttcttgacagtaaatggctgttttgtttatttctgccagtagcaaagtaatatattgattgtttaatgccttcttggcctctttgaaaatgtttaaaattatgtttaccttttctttatatcattgcaggttttgtgtgtgtgtgtgtgtgtgtgtgtatgtgtgtgtgtgtgtgtgtgagagtgagtgcgttttgggaggccagtaattaccctgtgcagatggagctgcccaaacagtctttcccatggcaactgaaaaaataaaaaataaaagcaaaaactttgaggttacataattgccttcaatagactaggaggagtgtagagatcatgactttttttgtgggttttggtgttcttttggtgtaaggtgttgggtgaaggtacagaggtcctactgagtaactgaacaggatgctgttgcttgctttgaagtgaataaattggtcaaaagtacaagtgggaggggaagttgaggtttaatgaaggagggccattattaatgtttccatggttttagcagtttaaaagttgggagtttaaataatgttgttagttgtggggaaaacagcccacagacattcagacatagttgaagtttagtctttcagtcttcattttaatctgaaggtagggagccgagccttctgaatcacacagcaaagggattgcttcgtaattttaacagtctgaattattgcatgctcataatggcataagatttgcatagctccaccactctcatcaaatcccaattatctgaagattgtttctcttgggaggcaaaagaatattataatttttgggtttcttttaatcttccaaaatgatttatattcatccccttaaaacctgggtgtaaccaaaggcactagggcccaaagaacaggtgttgtctttccagaacatccataaaaggatccctgtatacattctctttgcacctcttgtgtaggggttaacatggaaggcttcattatttgactggaaagtaggtttgactttcccactggagatttgatactcttagctccagaaccaagaaagagaagactattagactttccttgcccaccaccccctccccaaccctgccaaatgtatgctaagcctatatttgttttatttccaaccaatttgttggaaataaattggttatttatttccttattggtttttctctccagagacccaaaagatcatataatgccaactctatgttattgataataatctgggcataggaagaacacggagagttgaaatccacaaatcctcctaaaacccaacattcaaaaacctcttctgctcagctctttacatgtgagcaaaggaaaggagaatgagagataagatattaaatgagtacacgtggctcagggcacttggtgtcagaaactctgcgttacaatccagcctcttccagttacctggtgagcactgggaaatttttgtaactccctgagttctccctttatcatttgtcacatgatgaaagaacactttagtcttgttggttgttgtattagatgagatacgatatatgtgacgatttgtaaattttggggcactctccatgtggtgctcactactttgtgtcatctgatagagaggaggaggaagcatatataactagcagcctgagtaaatattggttatcgtttacttccaaattgccaagaatgggccgtaaaccaacaatctgccttgtttaacctccatcagctacaattgcctcaaggcccccaaattgcaattggtaagacaaaaacaataaatgcaaaatccatatttgttttcttcttccttaacttttttcattcatggtggtcaattgaggttattaacctaactgacctgcaaggataaacaaatgagtttttttttttaatcctttctgggaatcctaaataactagtttcaattgttgtaagttgtgggagctgggaatttgttttctccccagtactggactcttttacagtggcacactgggaaaccaaatttgaaactcaaaggagaaatggaacggtgacagtttcctttaacctgagctcagggctttggcaatagctctgctccaggtttctgttctatctagttctgcctggaacttagataaaggaaagctttctgtatcttccatcatccttgccttgttctaatgtagcaggagtaagtctttcctaatagtgttgcttctttttttttttttttttgagatggagtgttgctctgttgcccaggctggaatgcagtggcgcgatctcggctcactgcaacctccacctcccacgttcaagcatgtcttctgcctcagcctcctgaatagctgggattacaggtacatgccaccacacccagctaatttttgtatttttagtagatatggggtttcaccatgttggcaaaccatggctgatcaccagtaattcctgacctcgtgatccaccccccttggcctcccaaagtgctgggattacaggcgtaagccactgcacccggccgctctttttttttttttttttttgccttcactttattaaagaatgagagttttcttttacattttttctcattgctctctcagctgttttttgttgaaactagtatggaatgactattcctttccttagtgtgtgcgcccatggtgcattacacatggcacttctccctgtaggggccccactctatcacaacaaccagtgtcctcatctctcctaggccttgctcctggcccagccctgagcacatactctgcaatattcgaacccttgatcaattctgaaagcaatttattaacttccagccgtgagaaagaagtgaattagtggtcagggtaaaaattgtaggcatagtttaaaaattcattccagtgacataatgaaaaatttcatcaggagtcaagattggagatctctttttggctttgcaactgagtaaatgtggtaaagttacttgatgtctatgtacttcagattcttatttataaaattggactgaattaacatgactgaattaacacaacagcatcgtgattctgcgtctttcagtcccatacaactgtccatagtttagttgtctgattagggattataatatttgcgtcttttgtaacctaaagaatatcttatgttattcaagactgctcattttcattgacgtgctcaatacccaaagcacatagtttttcaagactgactattctcccctctcctgtgaaggagaatggtaagggccagtttcctcatgaaagcaactgaagaaactgaagtaaacgtgtcttttttttttttttttgagagggagtcttgctctgttgcccaggctggaatacagtggtatgatctcagctcactgaagcctctgcctcccactttcaagcaattctcctgcctcagcctcccgagtagctgggattacaggtgcccgccaccatgcctgactaatttttgtacttttagtagtaactgggtttcatcatgttggccaggctggtctcgaactcctgacctcaggtgatccgcccacctcggcctcccaaagtgctggtattacaggtgtgaaccaccacacctggtcaagacatgtctttttatcatgtctttcatccgatctttggaaaggagactctgtaacaaacaaacaaaaaaatcttctaagctgagttcaagaatagatgttgcttttggactcacttcttttggaagctttaaaaatgggatcatgagatcagaatgtatgtaggtattctctgaagacagaattgtatttgtccttctaatacccatctctcaaacttagcaagtgtttagttgcttctctttaacataagcctctgttggtagtttgtgtattcttttcagaagaaatgtaggaaaaaatatctaggggcttatgaaagccaacaaaactatagttagaaggtagatgtgttcccttagaaagatttatatggaaacttgttttctagaaagatgaacaaacaatgagccagactgtccttgttcttgttttaaaataaacatatttgtagacctgtaactggctcctgatgagcaatacatgaagccatttaaggcatgaagctttgcattggtatggaaccaactgaataaaacttgtttataaccttgtatacctttccaacataaacaccatttctggagttaatcatttttatactgctttatacctaacatcatgtgacagctttttcttttacattttttctgacctggattgctagctaggcatttgtattttttgatggtgatgttctaggttatccttttacatgccaaattggcataagccagaatattatattttatacttgtcaaaggacggcacatattattactatgtcataactagggctcactgtttttttttttttttttaaaaactgcttcaactttccacctatgtagaaacaagtatactttttaagtgaatgcttggattgaggaaccaggaagtgttttttactcatcagtattgcctcccacctgaaatagttcatttccttagaggatattgtggagtttagttatccatgaatctgtttttatggattgtattgaagaagatgaggagtaccatgcatttttttctgagagtaaaattgtaactatcagtatgattatagtttacttttttggtgcatttagtgggtttcattaaaactgatcttggattttcacagtatgggagagtgggtttttttttgtgggagatgatgtctgcatacaggagattgtattataaatatgatgtatcctggaaattttggaaagttggaaagagtgacttgacaactcttacattgaacaatgtatctgaatctattaatcaaacagatcactatctgaccagaaacccctgtaagagggaaaaagtcttcagttcttttcctaaattttatccgtctatacagataatatttctgttcctgtttgacatgttattttcctcataaacagttttaatggttccgtgcgtctacaggctaaaaagcagaggcccggtgatctcatctctactagttgactccaatctgtcttttcaataatggcctccacacccagtcctttgtcagatgtgtactctgagaggaggcattctatgaaggggaggggagacactagatttagaaaactctgggttcaaattccggtgcttcatttattagcaatgtgaattttgtcaaatcacatcatgcctctgaaacctaggctcttaaagggtaaaatgtgtataaatatattgacttttgttttcatctgtgataccatgtgatatcttttagggtcaggaatgtagttctatttcttgaactaattatggtggctaatttgaatttgcagcgtgtaaacaggctatttggaattcaagcatttctccctttccttgtcatctatttagatggtgaattcttcttttcctattatttattatcgaaacactttgaccacaaggatactttttttttttttttgagacggctcgttctgttgcccaggctggagtgcagtggtgcgatcttggctcactgcaagctctacctcctgggttcaagtgattttcctgcctcagcctcccgagtagctgggtctacaggcgcttgccaccacgcctggctaatttttgtatttttagtagagtcagggtttcaccgtgttgtcaggatgttctctatctcctgaccttgtgatctgcctgccttggcctcccaaagtgctggaattacaggcgtgagccactgtgtctggcccataaggatacttttaaatatttgggatacaaataagctattttaaatttaacaaataaaaagggctacacacaaatttttgagattggtgtccattctttaattttaataagttgttcaggtatgaagaggagagagaacataaaattggatttttattggattacttttatgctcaatataatgttttttggtcttatctaatcctgtagaaatatctaggaggatgtataatccagtgttcatagacattgctcaccatctgtttccaaagtgaaaaatcagcattcatatcgtacctttatttccctttgtgtgctaagtccaaactcaggcaaagaggtcactatttgttctctttacagcaaacttgatcctaacattgcatattccataatctgtcatctttgtatagttttgtggtaatgatctactcttactcggcctcttcacatacttattatgatagattttcttgatttaccaaatagagaacttatccattagaaatgtttgattggctttttcagaaacaagaagttgtttcgcttttttagtattttttttttccccttagacccaatctaatctaggtgggagagaaagtaaagagagtctcttggaaaactgaagagagtcacagcaagcccacagagttacacaggaatcaggaggaataaaaatgtaaaggtaacatggatgaaccatctattaggtgctttcgtacatactgtctcattttaggtttaccaatagcattaggtatagtgaagatgattgacatggtttggctgtgtcctcacccaaatcttatcttgaattgtagctcccataattcccttgtgtggtgggaaggacccactgggaaataattgaatcatggaggtgatttcccacatattgttctcatggtagtgaataagtctcacgagatctgatggttttataaggggtttcccctttcccttggctctcattctctctttgcctactgccatgtaagacatcctttgctcttccttcatcttctgccatgattgtgaggcctccccagccatgtggaactgtgaatccattaaacttctttctgttataaattacccagtcttgggtatgtctttattagcagtgtgagaatggactaattacaatgattgtgataatgactattgccattggacagataaggaagctggctcagagtggcaagtcacctgggcccaaacatcttgctaataagcagcatagcacattccttgattactctgttatatgtggctctaaaaggtttttttttgtgtgtgcattcatatggatgtcagcaaaaccaatttaagtgtagttaacggaattattatttctcatgccttctatgatttcttgtctgattggaacataatactccaggatcaggtttgttatacttccttctacgacatgtgccccaaatggcagtgagtttatggcagagattggctcaggagaagtattttctcatcttctggaatgtcctactaatgaaataacttaaaagacaaggacatatgaaggtgattctgtaatattaactctaaccattattaaattcttaatgcatgccacatatgcttctatttgcttacctgcattgatttttcactcttcataataccgttgtgaggaaggcacctttttgtttttttttttttcatttaaagatgaagaggttaaggcacaagaagattcataacttgccaaggtcccaaagctggtgtgggttccagtccaggtcctctgactccacagccactctccagtgctgctttggagcctgacacattagtaactggtggctccctaagagccttgactttggctttagttgacttagaaaatatttttatgtgtgtgtatttacttccaagcctctcatattttctcattaattataagtagtccacaattttcaagactgtagttgtaaaatataactcaaggcatagcgagaaagtagattttagtcatttggaatggttaggaccagctctctgtgtacctttccaggaatttaatgtttcagctgagcatagtgaccctaaatgtttggagaaagtgagagattttgtgtctatatacataggtgtccctgtgtcatctttttctttagcttgaagcactcaggatggaaaaacaaatcttgggaaagatgaaagagtagaactaaaggaaataccacataagttacaaaggactagagttttatggctgtaatttataatgtccactatccttgtgaaaattacatgggatagtttatctttttctatttgggaagatatattttttatatttaaaaatatcttgtctttagagttcttttaagtgtaatgattggagggctgagatatacaaactagattattttcattctggtctttttcttctagtatttggggtaatttaaatgcttcttcgttcactcacatgcttattcaacagatatttattgaatgcctactatataccagaccctctgctagaccctgaggataaaaggtagataggatgctgaatctgtcctccaagcatttggattctggtggtagaaactgttgtgtacccagttagccacggcagtttgagaagtgctacactagcagaatgagaagttctgtaaggccacagaggagggagggagtaattcctcctgtggttatgaacagaaatttgagctaagtcttttaaaggatgaataataaggttgggtaggccaagtgggcagggagggcccaagagacaaggtgctcaaatgcctagaatatgaaaaggacagagtaactatcattatctcacagctaggaacactgatccctgtaactagcttggcttacctgagaaggaaatgccaccaactctgagggtttccccccgccagtcttcatttattattgtgtaaaattagaggatgacagcagtggtggtggtggtggtggcggctgctgctgctgctgctttgtcttcttccttttcctgattagcttgatagatttgggttagatataggcattttccacatcaggctgtagttctttattttttcaacttttatttgatttttttttcttttttcttttttttttttttttttgagacagagtcttgctctgttgcccaggctggagtgcattggtgtgatctcggctcactgcaacctctgcctcccgggttcaagtgattctcctgcttcagcctcccaagtagctgggattacaggcatgcactaccatgcgcggctgatttttatatttttagtagagatggggtttcatcatgttggctaggctggtctccaactccagacctcagatgatccacctgccttggcctcctcccaaagtgctgggattacaggcgtgagccactgtgcctagcttcaaaaacttttatttgaaatatgggggtacatgtgcagatttgttgcatgggaatattgtgtgatgctgaggtttgaagtacagatcccatcacccaggtagtgagcatagtagccaataggtagtctaacttgtcccatccgtatccaggctttaaccatactgagagagtgggaaaaaaactgagctgcctactatgacccagtggaatggaaagttttctaccattttggttctatgtcattttcatattacttttttaaggaaattcaatttttctgccattctactagactgtatctctttgatcactacctatgtgtccaaatcactgcttctcccaactttttttgtgggccatcatccatgagcatggtacatccatgtggtgacttcctctgtttgtttaaatttgctcatttagagttttatattaggacagtaaaacactcatgtctaaataatttataagtcctgggaaactcgtaaaaatggcctgacatgatgttttgtgcctataagaaatcttgcagatggctaagagaagaatgaagatgttttgacttactgtctcttcaattacattataaaaaattcagcggacttgtccatgatcattaggaaaatgaatgattttcctattataaattacaagtgccacaaactacataaggactgtaattgacaggtatcaactggtagcgtttatttacattctccaaggcaacccacagaaatgtagtgctcaccatatttattcagaaaaatatgtttttaagtaaataaaacttccttgacacttgttactatagttaggcaacttaattccaattgttaactttctttagtaaatgatagatgaaacatgattttgtaagataaaagaacatggtgccaaaacattatatgagcatgatgccaaaaatacacacacacacacacacacacacacacacacacacacaactgaatacattgttcatagtgttttctaattcagggaaactggaagatgatttgaaagtattatgttcaactttgtatttattccaggaaaatttacataaggagaaaatacattaatcttggcatgtaataagaacctacattttgttatataattcattttgtgatttacatttctataatttattcaataagcctaataaatgttaggtaatgaatgaatttagtttcatgagtaaaaaatagtacatgaatgatctgtcattgtacaaaactgctgaattatgaatatggtttttgtgagtattttcttcccttcctccttgtcccatccctatgtcctttcttcttaaccctaacctcctacaaccagaggatagcacgttgagggaagaaatcgtcagaagttttaatataattatattcaggatgagagttctgttcaacacaacatcattggttaatttagtaatttctagaatgctgcccagacttgaaaatactttcagtactcattgctgaatattgctgttctctgcatgtttttcttctgggattgaactggacaggattttggctttttaacacattccagtgggtataagtatattggctagcaaagattcccttaattgacctggttttaataaaaaatcatccagtcctcctgccactaatttttctcttctttgaaaccacagattaataacctggtgttatctctatcaccgaggtgagaaattctgccaaaagtggtttacaaaaacagctttggggttggatctggagagtggctatgattttaccaaaactagatccctgtttttcttttaaattacatatggacagtttcatcaattaagttaccaaattcatattttatattctgttcacatatcaggaagcatttagcccaaacaaagtctgttcacataaaaatttctttttggatattttcttctactctgaggacacatgcctgcctttccccagtatgttctctcctgctcccagtaccttgagtatagtgagcattccataaagagtcagtgaatgaatccctttttcattgtgtctccattatgtagagtggaaatctgtgctggaacaatagctggtagatgatctgcaccagggaggcctgggctagacttcaaaagctgtttccccatcccggcaaggcaaaacatgttctttataggctgggaggtcacagctctatccccgttcaagactgcacctccttttttctctcttccttcccaggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggtgagcaagctcatcagtctggaggctagcgccactggaaagagtcccgggcggttctgtttatttggcaagttcgggccatgacctgagcttacactaaattacctcagagcaaattattttttaccaagccacgtaaatgttaggtcgtctccctagagcttttgggctgaagacagatgactacatcaaaggctgctcttgagtttccaggtgtggctgggggaattgtctgtcttctttcaggaaagggttaatttctaactcttcccctttcccttcctcaggtgaattattttgtttcatgccaatttaagtgttacctagagaccttttacgtagagccaattaattaatttatttatttttatttttattttttgagacggagcctccctctgtcgcccaggctggaatgcggtggcgcaatctcggctcactgcaagctccgcctcctgggttcatgccattctcctgcctcagcctcccgagtagctgggactacaggcgcccgccaccacgcctggctaatttttttgtatttttagtagagatggggtttcaccgtggtctcgatctcctgacctcgtgatctgcccgcctcggccccccaaagtgctgggattacaggcgtgagccaccgtgccgggccaaatagagccaatttaattgaacatagagtcctctggttttggtatgagtgggtgtgcctctgtgcctgtcttcataagaggaggccaaggctgtgtttcttctttataaatacaaatttcacattacggtcttgtgtggatatattctgaagcatcctcctaggtaaattgaattggactatggtgaatttttttttttttttttttggcagggggaaggattttaataattaaatcactggttgaaggcttgtgcaaagtttggtgctatattaggatttaccagggttccactgtgattctaagttcattttaaatttctgccccctgccttcctttccatttatgttaagtgttattaccatgtggagagaaggtattttaataacagaattttacttaaaaatgcttccagccaggcatggtggctcatgcctgtaatcccagcactgaggcaggaggatggcttgagcccaggagtttgagaccaggctgaccaccatggtaaaaccctgtctctacaaaaaatacagaaattagccaggcatggtggcatgtacctgtagtctcagctactcaggaggctgaggtgagagaattgcttgagcccagggaggttgaggctgcagtgagctgtgctcaaaacaaaacaaaacaaaacaaaacagctcccgttctaccactcctaaaatccatatcatatatcaaaaaaggaagtttgatacctgaaatgactcttggcagggcttctcaacctctgttccctggtatttggggctgtatcattcagtgttgtggggagctgtccagtgcattgcagaatatatagtagcacccctggcctctacccagtagattccagtagcatgattcctctccccagctgtggcaaccagaaatgttctgtgggggaccaatttgcccccagttgaaaaccattgttttggggattgattcaacaaaggaaaagaaggtaaagaaaatggtaaagatgtcacgtatggagctttgtttttgttgtttgttaattttgtcatattaccctgtgaatttccaaagaaagtaaatcgtaagacaatgaggtctgccactagaactcccatttagccaccagttctctctccattgttgactggaatttagtttggattaatacaacaattgcaactcacaacaagtattgactttgatgctgtcattatcaactgaggaactccaggttttatattaaacacgcagaactttctatgaagtggccattttgatcactgggtgttttcacagggctggcttattgggggaaaaagagggagtggttggagaaaaagactcaaataaggctaatgcaagactttaataactgaatgtatgagttgaatgaagaaacacgcctactctacactgtaattcagcagttttatgaatgggaggtcagatacatgatttaaatacaggtttcattgaatgcagtatcttttacggtactaaaaaaggtctggaatcctgcattcttcctgtataggattgtaattcattctctctgctctcactctccttccaaatttacttctacctctgtcatagaatgtttgagctgccagacaagtaggatcatgtcactgctgtgacttaacattaaatgtcctggtgtctttatttcagatgttctgtttttcctctattttctgctcacatgaacatacacacttgccaggcacattctggcttttcttatttctctttctgattttgcctccttcctgcccctgttttcttcccttttctctggctatagaaactgtcaggtggccttgctggcatcatcctacctcttttgaactgtgttacccaggaacttccatttattatgcctcgagcactctctttctttaatactgtatctctctgagggatagttaatgatctttgcagcaaatgaaggtgaactgtagccacattattgttagaatacagccaactatatggaacagattgggctgagctttgaacagctggggctggcagagtgagtcttgacttctctcggaagagttccagaactgccaaatcatcaaacttgaaggggaaagagggacgagaaaggttatggggatagtggttcctgcaggtgctttttgctcttgtgatctaccttttttgaaatgtttactagtttgtggatctggcaaagcatgggctaattgaacccaagagctgctgtcattgccacagactagacctgcttagtggccgtggtggtgttttattgttcatttgcaggtactgaacatgggataagatggatgcttttgttgtgaaagcttgtggctctcttcaggcaactaactgaaactatgtgtaggtttgaggagaattttgatctgcaatgtgcatcgaaccctaatataaatttaataatggctccattggaacttttggactataatgtggcttcctggtggatataataaatgaaaaataggcgaggtaggacagatatcataaactgggggaccagagagcttaatcactccttcaaaaatgttgtgtttgcccttatgaggagttgtgtgtgtgtatgcacatgcatgggtgcatgtgtgtttaaatgacttgctgccaatattttaaaaatgtttatataaacatttggtcaatttttccaaagaagccagaatctgacttcactggtctcccacggtcaatatcagctgtggctgaataacaagtactccatacctctcctgggtgggcagggcagggactttccaattaactagagttttcaccctctactcccactgttactgcagagattggcctttgcaagaaaagttcaggaaagaaaagagacaagccttgggattgggaaataatgggtttgaatctcagcttcataggcagctttctcaattggggaaattattaaactttctgagccttagtttcctcctgagtagagtgggaatatactctgcacctctaatggttgctggaaggaatattaagtaaaacagcgtatttaaagtttctaaaacaactatgtacatacacaggaggattgctgtacacatttgctgttattgtagttttcagttgctgtgtatcataggtgagttgataccaaccctttagtgtcccattgaccatgttacaaaatttaataaacacttgtgttactcagaacaaaggaggaaacttgtgccttgtcttcccatattttgggctttgttctacaatataaaatatatagtttttctacggaaaaaaatccaatagaaactgatttcttaaaggtagcacaatttgaagagagaaaaatcttatagtttagttcatattaggtggactcttcgtttccttttgaccgggtcaaggctttgtatttttgcatctatacttctgaagtttctgccccgcaccccatcccaatcacattcaaaatcaggctgacagtaatcctgtacgtggaacatgtgctgaatcctcatggaaggaaaggtaaagaaatgaaagccctgtagaaattaatatatttccttagaggtgggcatggaatgtagcttttgttaggcttacaatgctgcgttgaaggtttgtcagcattttgtgcacacagattctttaaaacttttaaggattttttccctacattattgcattcagttggcatcatttctttctctaatgtgtgacctttgacatctatcagaaagtttcagtacatctttggatgccacaccagctgggggcagggactaccccgttattatagtcatggttcagaaatacaggttcttccccctatttttatacttcctgcatagatgggtttcctttagatgtggatatttctcttaaatgcatactcttgtctcaaaatggtgaaggataccagtgtagtagtttcttcttctacttctgacagttactgggaaacttgtgtctttcaataaaatgctttctagaagaaggcaaggtggctagaaaatgttaaggcagctcagggaccagtgggagaaaatagatgttaaaggtaaaaagtgacttgtgattagttcagttacggagtccaaaaatccaaccaggtttgtaggtaaccagttacgtttcaaatgtgatcttaagcccaccccgagtgagtgaacctcaacatgagagtagaagactctggaagggaagatgtgagaagataaaatactgttttcagagccctaggtttttgtttgtttgtttgtttgtttgtttgacatttttatgagtggaggaataggactacctctggaacctaaaattgggctgaaatccaggtccagttctaggtgattgctcagggtcccttcccattccttcctccatctgctcctgcccacttgagtgaaggaggtgaataataaaagaggaaagaatgtggatgaaaaggagaagatgcagagaatgaagattctctgtcctttgtaaaccttttgtcctaatcaccaaaagtattgtggcatgtgtaagtctgagaaaatatttaggtgaatcccttgaaattgtcagtatttcaagggttaaaaaaagacagtttcacatagttcaaatgaaagcaacaattaggtttttgctagaacttctctgggtccaccaatgggatgtatggagtggttttaaaaaaccacacaaggctgggcgcggtggctcacgcctgtaatcccagcactttaggaggctgaggcaggcagatcacctgaggtcaggagtttgagaccagcctggccaatgtggggaaaccctgtccctactaaaaatacaaaaattagctgggtgtggtggcacacacctgtgatcccagctactcgggaggttaaggcgggagaatcgcttgaacccaggaggtggactttgcagtgagctgagatggtgccactgccctccagcctgggcaacagagtgaggctctgtctcaaaaatgaataaataaataaaaattttaaaaaccacacaagttttggcatccaactggatttttttccttttgcatatgcttttctaacatatgcagatattttctttgatttttcttataatcaggctttcttactttttctaaaattgtagttattgcctcgaatctcatagcagaggagtagaggcaacaaaaaggagagccaagtgtgggagcaattgaagaccgtggagttttttcagatcattcgcctgggaacttgcatggcagttgtggggttccaaagatccaaaatcaggtgttgtaacttagctgacttgaatatttactttgaaaataagaaatgaatgttaaaaagttgaaaagttatacacatgggcacaatttattgaaaccttttcttagggtagattgaaccttgttgaaagttgtgaaatttgctcaaatagtcattttttctctttttttctaggtctgaatgatttcatgaatattgtggtagtttgggcaaagaacaaatttgcttagtcaagaaacattaaaagcctctacgaaggcctagaggtggtgaaatcagtggtcctctggtgggcatggtgtgtgtgtgtgtgcgcgcacacgcgtgtgactcatctggggttggctcagagtgaaagagacagatgcttccttcgcctgcttgtttcctggttttcaaagcccctatttcattgttgttttattttaaggttcgatgccttctccatccgtcagtgagggtgtggagagcctgcaggcgtgtgcctccctctgtaacttgctattccttgtgtaatgtcaagtggaagtgtgaagcaccacaaactgctctgagcagagcccacttcccttcacccacggagagcgtgaagcagttacaccaacatcaatcaaggaaaacccacaggctgagctcacacggttgaagcaggtgcgtgagcgagcgttctgtgacaggcacacgtgattgaggtgtacctcggcgtcttgcccacagatgtcggttgcgatgactgtgtggggctgtgcccattccctgcagagccgagcctgtcatgcttgtgggacacagtgggtgcagctcttggcagctcagtggggtgagcaggtcaggtagttctgaagtaggcttctttgctgtttactcacttgtttaatggtgaggagaagaatccaggagaaatagtgttttattttctttcagtggtgttttgcagtgagaacacccctgggattactcctttaaaacagtaaacaagaggccgggtgtggtggctcaggtctataataccagctctttgagaggccgaagcaggaagattgtttgagcccaggagttcaagatcagcctgggcaacatctctaaaagacaccatctctaaaagaattttttattttttaatttgccttgtgtggtggtgtccccttgttctcccagctacttggaggcagaggtggaaggatcccttaagcctgggaggtcgaaactgcagtgagccatggttgcgccactgcactccagcctgggcaacagagcgagaccctgtctcagaaataaataaataaatgaaataaaatagtaaacaagaaaacattagtattaattgatttgctaagcctaagggggaaaatgtaaggtcttgaatctctgtatgtatgcatatgtgtgtatacatatctatcaatatctatcaaatgtgtatgtatggagtggttttaaaaaaccacacaaggctgggcgtggtggctcacgcctgtaatcccagcactttaggaggctgaggcaggcggatcacctgaggtcaggagtttgagaccagcctggccaatgtggggaaactctgtccctactaaaaatacaaaaattagctgggtgtggtggcacacgcctgtaatcccagctactcgggaggctaaggcaggagaatcgcttgaacccaggaggtggagtttgcatatgtagagtagacgtttgtgtacacacatatatgtatatgtaaatatgtgtgtgcatgcatcaacacaggcaccaatttaaagcaaaactcaagtgggccatgagataaagagagaatgtcaatatctagacatttaaaaatatctgctgacaaggtgaaggggctagtaaaaaaatgcatatctcatcctaagtcgaaccatcttgatatgtattgagctttagaaaattttcacaaaagttttgagcaatcttaattttaaaaatacagaggcagttaatactaagacttcaatatatattgtgctttgtaaaaagtggccagtctctcaaggctgctaatacctgctattggttatgagtatctactttgagctgacacttcaaaatgttatacatattatttgcatttacatatgtgaaacaatcaccctttctttaagcaatgtaaagtaaaacaagacatatttttaaactactaaactgactcagttggagaataatgataaaaaccagtattactatgggtaaggaaaaaaacctgccattttgggggaaattttttgtatactctctaaaggtgatttcacgatatgtaaaatcaaaagccacaaaatattcttacagtttcagcagttcagcttctaggcaaattttttctcagactgtgatcaaatgtgtaaaaaatttagctataagaatgcttgatcgcaaacttatttatttttgatacattttgctagaaatgtctaaataatattacagtggtcaaataaattatagtagaaatatgcaataaaataccaagtgaggcattaagcagtggtgtagatttctctaagaccctgtttttttaaaaaactaacaaatcagtgtttcatgcattcagtatgtgcagatatattataagcagtttgtgagatttatataaatctaaaagttgttacagctgtgtgattagagaataattaaatggctttattttgcctgttgttataattttctaatattcaagtgtattacctgcacattaaatacagaaaatggcaaacatggaaatagcatattgggagtatacttgtaagttacctagagatatttgtgaagacgaggaagggaaagaggtttctttcttttcttttcttcttttttttcctagatgatgtcttagcagaaagtgttaaagactagtgattgattaattagttcaacaaatatttgtgtgcctctatgtgccaggtactggacaagactctggtcacattgctatgtacttttcacaggaaaaattgctgaatctgttctgtttgatattctgcatcaatgtagctttaccagtagagagtcaataatatgaatatgaaagtaatatgggcatgtaaaattatgatgtcacggcccagcatggtggctcatgcctgtaatctcagcactgtgggaggccgaggcaggtggatcacctgaggttaggagttcgagaccagcctgaccaacatggtgaaacgctgtctctactaaaaatataaaaattaggtgggtatggtggtgggcgcctgtaatcctagctacttgggaggcggaggcaggagaactgcttgaacccgggaggcagaggtttcagtgagccaatattgtgccgttgcactctagcctgggtaacaagagtgaaactccatctcaaaaaaaaaaaaaattatgatgtcagactgacgttttgcttcgtatttttacatatgcgttttatctgctttatgctgtttcacatattaaatgtgtgaaactttttctgtactgtagatagttgacaccatgaattgtctggaaagtcaaaagcaaaaattgagaagacttgttataattaatgaaaactttaaaggacattaaaaagcttatttgcaagtgctttgaaaaatctgacttttccatattttgtgaggttttggctttgatactcaatcttggtttaatgttctgcaggtgtcctttggggagttagaacagggtttgcagggatggggagattgagtgtgatgactctagtgtccactcacttggaatgttgagactctgaggccttaaataggaggtttagatttgggatgtctgactgaaagagggttaggattcaggctgatgtggagatgctcattgaggagttcaaattcttctctgagcccttaagaatctacccaaaggacagtcttctgatgttcagtctctttctcatgaaaatgatcttagaagtttaatccttcaaatgacctcttaacatgacttctcatactggtgtgagattagaaaaaaaaaattccagcctgaaccatcaagggctccaaaatgaagattttttttgagttttaaaactctgaaaaagtttttcataagttataaaaacagaaaggttcttgagaggaagggtttgttttgggtcagtgccaatgtgccacagttgctttccttgtgtgtgtttgtgtgtttgtctttgtcttctgtctgcctgtctgcggggatgattatggattcttgaacttggttctttctttcctattgattggtgaagggaagaagttaaactttggatttggctctatttccattgtccattgaatcgggagagttagcccattggttattctattgctcttttgctatgattttgtgggaaaattgtcattttcacttcccccttcttctctccatcctttcctctcgttaaaacagacatgatgcctttaacgaattgccttgggatagtttgaagtataaagggaggaaaaagagatttagctcttcctgagacaagccctgagtagtaaaatcaataattcaagaaatcacttgccctttaaaaaacaaacaaaaaaagacttgtaaatagaacaagattgagaaaaacatgtctttaggcaggctaatctaatcacacacagaaggcagcctgttttcttacttgctggatcgcttccactttatattctcacagggaacaatatattaagtacagtatttagaaatatttgttgaatcctactgtctgattttggcaagtcccaaggaaaaaaagaatatgtcttggactgcttgagccttcctgggaggatattggagttttcccagagaggctggcttcacactgtgggaaacactggtttggtagataacactgttagaatttatatttcagagggcatttagttgtcttcagagttttagagcagccacagctgatcttctatgtctcaggatctgaagaaactcaaagtataagctaggctttctttatactgatgtagtcattctcttttgaggggcaccctaacttgtaactcactgatcctgtgttatggcagcaggctgagttcaccagcaccaaaatatccagttagtgtatcagaagagaaaatgtgggtgtcacaaataagagtagctaaaagataggacattatagggtgaaaggtccattggctgatgccgccttctctcagggaatgttaaagtgtcaacattttggcaaaatcctaagctaattttgtttaaatgtgatcatcacatagcattgactgagtaattgaaatttgtgatgggaaataaggatgaaatatttagaaagtatgttatggcccctttgcttaagagtatatgctaaaataaaagtatctcattacgaggaatgtaagtgaaataaattctttcagtttaattttctcagcatgtatctggcattaagtagtttttataaatcttatgcaagggcctatcccacagctctattccattggtggcttaaatgtgaagtaggcatatctgaagggttcttttgctctgtattataatgttgagaagttagttattgaacctatagcttttcatctctagaatggagataagagaatcatcctcagagtttaaaaaaaaaacttttaatttttaagtagttttagatttacagaaatgtagcaaaaaaaggaagagtgtagtcttacatcccttgcctggttccttttcttgttaccttattatgtatgcttgtcaaaaaaaattcaacattgggacttgcctattaaatgactccacagtttgggtttttttttttttatctttatatttcactggttcttccctaatatccttttctgttccagggtcatactggatacgacattgcatttagtagtcatgtctctttagattcctctgaactatgagggtttttcagcctttccttgttttaatgagcttaacagttttgaggcgtgctggtcagatattttgtagaatgtccttcaactgaaattcatctcatgattggacttggttatgggttttttcagaggaagaccacagaggtgaagcaccattctccaccatcatatcaagagtacctatgatcaccatgacgtatcactatagatgttgatcttgataacctggctgaggtcatggtgccaagtctcttcactgcaaatttgccttcccccgactttttcccatactgcactctttggaatgaaattactaagcacatgtcatagggttattttaaggtttaagtgagatgatgaagcttgtggtataaaacccagtgctttagaaaacactcatgaatgtcagttgctactgtagttgctgcctttacactagtccctttcaatacatgaaagctagtattctttagagctgctttctcataattatacagttctcagccatttgctgatattgatcagaaagtaaaaataacaaaaaagagtgctcacacacctttcaaacgagatgcctgtatacaaagtcactctaggatggaaggatacgaattctctcaaagtttaccatggagagactctactaaactgggattatcagcctctggtcctgtttcatgtgatggagtcagtcattgatgacagagctggtgggttctggttggtcttgggcatgagagggagaaagaaagtttaatttaggagctgagcctgaaaaattggtgaggtttttttttttcttcctctggtgatagcttttgggtagaattttgagttcttactggaataaacgatcttcagcacttctctgtgaaatgaagggcttgttctgggacctgaaatgcttcaaaccctgtgcagttgttgccagagtggctgtctgagcctggataatagagcctggagtcctatgtaaccatgtctgttggaataaataagaacagctggtcgcttgtacagatactgttggcatgaattttttatttaagtctctccatgtatctagtaaacagtaagcagtattctaacattactaaaagcctcctaagtctcccaccaataaatttccttcactcttccccattaaaagttcagggagtagggcaaggttaatgtaccagagaaggaatggtagggaagtatttctgagctggagaaaataaggttcttcttctgtgtctcttttcccatttgaccttctagtttctctctcagataacacatttttttttttggactatttcttgggaaagcaagatttatacgatattcttttgctgtttcttatgtataagagagacttattcgtgttaaaatggaatactctgtccctgagcgcttaatgggaaaaaaaatttgcatttgtgttaaggggtaggtgagtggtaaaatattcttttggtttcttttaaatgtctagcaaggaaactcttccatgtatctttatgaatttttgtctcagaaagcttactagagactaaacactccttcactgtcctatagagaaccagagatgtacttaaagaacatagatgatgtcacgcattcattttttctgttttttttttttctttctttttgtttttgttttgagacagagtcttgctctgtcacccaggctggagtgcagtggcacgatctcagctcaccgcaacctctgcctcctgggttcaagcgattctcctgcctctgcctcccaagtagctgggactacaggtgtgtgacaccatgcccagctaatttttgtatttttagtagagacaaggttttgccaggctggtctcaaactcctggcctcaagtgatccgccggccttggcctcccagagtgctgggattataggcctgagccaccacacccagcctgttgttatcgttgtttttaaaagcagaaagaaatttccagcttaacctgccatattaaccctggggtgctaagaagtgagacctatcagagacaattggccccattgctctgttatttctttcgtcaaggagacattgagttccctgcactgggtgctaggaatgtaagtaagaagaagatgggatctgtgtaccttaggaatcaaatgatagtctttatgtgctctggtacaggtctgtgtgtgtgtgtgtgtgtgtgtgtgtgtttctttcaagcctttgtgagactcctatggcaattaggaaggctcacagatattctgatggccttccttgggcacactcagcacagttgtactttcttgcctcctttaagtctaggcatgactatgaaagtggcttgccatgaaatgtggcagaagtcacatgtgtcacttcccagatgaagctttaagagttgccatgtgatttgcttcatccccttccccttacattggttgaagcacaggccacgagagagcctacacagtctggtcatgtgatgaggggctatgatggaaagacctcccgaccgaggttgaacatgtcatgtaagcaagaattaagcttcagttactacaagtcatggggatttaggtagaggtggtgtgttcctgcagcattatccagcctgtcctaagtaatgcagtcagcattcttatctctttagagttataggaattaaggcctcaatgttgggctgtggaggggatgttcacagttgtgatggtggcagcagtggtggaaaatctgtacatgtggtagttattgatgcacaaaaattgggcatcagtttttagaggtgtgacctacatttcagtatcgttgttaaatatctgtagggagattacatcccttctgacactgtatgtctaattgtcagtgaatatctttatataatgaaacataattctaaagaaggaaaaaactcaaagtatgtacacacacgcacatgcacacacacacacacacacacacgcacacacacaccctctagtttattctcccaagaattatatgagagattttaatgttgttctactggttgagtgccaggaagaatttcttgggtggatataatgcttaatttatatttggggaatttccactgctaaatcagtgcttgtaaagtttaaaaagaaaagagggggagggttggagaaggggaccaaaaaaaaaaaaagcccagggatgtggttgacaatattccttttaatttaaagccacctgaaggcttcagctgaataataaagtaattcccatatggtttccgttctttcagtgttagaacctctgaaatgcagtctacttttagccttggcttctgcatgcctctttgtcaggctgaaatgcttcccgtctgcttgctctggtaggaaatggaaccaaagccgactgctctgggggacgagttcccaggctttgctttctatttggcaaacgtggctcatgtgatgggaggcacttctcctccagggcactcttgactctctgacagacaggaccagctctgaaggtggctgcaagttttcattaatgccagagctcgctataggcacttttctccctcccttacaattctgtttacaataaactttccctcaaaggaaaaacccaggattcatatgagtttcgttgttttccctggaaagaagtttttgtaaccctcagactctttagaagggaaaacatccagtaaatcctgaaatctgactgcagagttatttttcattatttgtactttcattaattcaaattccaccaaaaaacttttctctttttcctgccctgtgtaagtttactttcccccctgtgttcatatgagttcatgaaatacttaggaagtatatgaaaaatgtttcagaaacacagttgtgttatatgatgcttacccaaatcctgctgaagtaagtgaaaagacattccctctccctaccccttctttttctccccttctctctcctaactttctgtgttcagagtcaatgcaaagggccttcatttttaatgttaattttaaaaataactagttttcttttgaggtaaacttagggaaagcatatgtgtttggagatatatatctccatatataaatatttacatttacatttacatttggagctcaagtttttcattttatttttcaaacatgttgaattaaactagctaaggactggaaacccaccatgactatttgctgtgggttgtatgatcactattctggcttgaatttttgaacttctacagcaacatctttaaagtgccatgagataactttgctgttgctcaaaaagaagctctttaggaagtcggaaaacaggaattctggtgctactttatggtgataatgtcactaactttgtacctttttgtccatttaaaaaatgagatcaatggtgctggcctttccacttttcatgtagttgcaaaatcatttcttcatgcaaggacaatcaaaatatatgaataacgtggcctgaatatttggaagaaaagtcctgcaaaagtgtaggctgatggaagcagaggaagaacattttatattgaagaacaaaggaatttcaaaagaaatggtgttaccagctctttcagttgaccagacaagtaccaagtgtttgggacttgttcccatcccaacaaagccagcattttgaggaggcctctctggcagggtcattacatcagccagtttcctctccatttgaaatgagaaagtacatgttaagcacagaggcactctaaagatgaactcatgccaaaatatgccttcataagcctccaaagtcacttgtggggtacaatgtcagaatgaacatgatcttatctggcctataaattaaatgacacattttctgtttcttgcacaatgtgtccctaagtggtgcttcatgtgagtttctagaaatgccttctgtaaactagactaatatgcacatgtgctttttcttgatctttaattgttcattactaatatacggactttgcatcaaatgtaaagcaatctcaacaacagtctcaatcaagaggaatgtctctgtgtcttataattttcctcaacagaaatttttaatgatactactttttaaaaagctctccttctggttttcttgggtaattttacgtggtatatttaaaaatctacttcatgagctgaagatacaggcactgtattcttttctttagctctctgcaccattctactttccaacatatataaactgtatatttacttcctatttctaaggttgttagcaatgctgttctgtaaccattatgaaatctctcatggttcctgttcagcttgatactaaaaattgaaagccagtaagcagtgtttatgctatatatgcaaatacttttcaacaaagggccagttgggatgctctgattacatacttttccaatttcttgacccctgtatctctctatgaaaggggtcaaatgcaagaggccaaatgaagattctttatttaattttatcgctgattgaaaccatacaacagttagtttgcttcaaacttgaccttcttgcacaatttgttaactctcaagtttttgatctttgttttttcttgctgggagaagaaatacaagccttaaaaaaaggaattctctgtctagagtcaatgttgttttctgtcattaaacttttaggattgcttttaatctcggtgttctcagatttcataatgatgtttgggtcttattaatcctgattggtacttagagaaatctggaaactacgcctccctttggccctgagacattttctcgcattgttttgatatgttttcccaaggttttctctggtctttcttaatgggactcctatcagtcagatgttgcgtcctctgatttgagcctctgcgtctcttctctgtccttcatatttttcatcttcctgtctttgtccttatgatctggaagattttgactctatcttctaatcctttcactaatatttttcagcaatcgaaattttgatttcttaccatttgagctgggaaactcactagtgggtatatatacaaaggaatagaaatcattctattatgaaaatacatacatgtgtatgttcattgcaccactgttcacaatagcaaagacatggaatcaacccaaatgcccatcaatgatagactggataaagaaaatgtggacacatacaccgtggaatactatgcagccgtaaaaaggaatgagatcatgtcctttgcagggacatggatagagctggaagccattatcctcagcaaactaatgcaagaacagaaaatgaaacaccgtatgttctcaattgtaagtgagagctgaacaatgaaaacacatggacacagggaggcgaacaacacacgctggggtctgtcagggtggggatggggggagttagaacatcaggaaaaatagctagtgcatgctgggcttaatacctaggtgatgggttgataggtgcagtaaaccaccatggcacacatttaccagtgtaagaaacctgcacatcctgctcatgtatcccagaactgaaaataatttttatttctaagagctcattcttgattcccttatttttttgacatgtgtgctgaagtacattaaaacactggtataaaacactagcacattgccaggaattgatctgttataaagatctacattgtaaattcaaaattcctatgggtatttgaagagacagctagaattaccctgcagtgtcataatttgaccacttaggaaaactatctcagttgctgattggctatctgatttgacttatacattacaaataatgagtaccgaccagcagcaagacacagagagatgaaaaacatgcagttgtggccctcaaggagtttacggtctagttgtaaaaaaaagacaacatcagaaaataagaataaaacatgtcaaattatgcaatatggagtcttacgccaaagaatatatgttgttgttgttgttagttgagacagactttttttacaatatcttttttccatattttggattttttatttatgaagagatatagagagtcaaattgttggatgaagactatttgctgtggagatatatgtctatattccttttagagtgccattcaccatcaagcacaagaccaaatttaccaaaatttaactcacaataagaaaaaataaaaccactgagtagcttatttgtaaaaagtagaatttcatcattttagtttggattatttaattatgattatgttgctttttatcattcattgctattgatataaaaatcataatatacttatgtgcaaaagatattgtttgttttctccttctgctcttcttcctttccctcttctccttctccaacttcttcagtctgattgtccaatactacaggtatataaatataacaagtccaacttgtgtctgaatattttctatacattttctgctcagttctatgaccacatgggattgtttcctggagtgtagttcgatgtatattatatatacatcattatatattgtctagaggcaaggtggtattggttttattatttaattaataaattaattaaggccacctgttcttagatggtaagaaatctaaatgtggcttttgttgggttaggacttgaattggaaagcagagtgcagttgtttatactattaaactttttttcctgagtgctaatttctatgacttgtttaaaggctatctggatgtggaacgggagaaccatgtattctttggattcttaacctggcgtcagagcaggccttaattgagttgactggtcacagcactacttctgttttgaaagctctctacaaaaatatacaaagtttaacaacttcattcaaagggaacaataattggccctacttactatatctgttttcatcctaaaattcttcttcaattttgaaatgtggctgtcagtatattttggctcaagaaaattcatgaagaaatattgtaccactgagaattatatcggtcagtttctcatcaatgaaaagttttatttcttgtgtgaactagtcctgaaaatgtaaatgtgtattacttgatatttagaataaagctatctgaatagtgtttccagggttagaaatgaggctgcagagtgagccgagatcgcgccactgcactccagcctgggcaaaaaagcgagactccatctcaaaaaaaaaaaaaaaaaaaaaaaagaaatgaggctgtagatagagtagtagcaggacaaagactccattgtggctgagtatttatagttggcctgttatgctataatatttatatttttatcatatttaaaatgtacacttttgggtttttttttgaggcagagtctcgctgtattgcctaggcccaagtgcagcggcatgatctcagctcactgcaacctccgtctcccgggcccaagctatcctcctacctcagggaagcaagtagatgggactacaggcatgcaccactactcccagataattttggggtttttttttgtagaggtggggttttgccatgttgcccaggctcctgggctgatgtgatccacctgcctcagtctcccaaaagtgctaggattacaggtgtgagccactgcgcctaaccttaaaatgtatacttaagagagaaaaataactttatctatttgatccagtaaaattaccctaagctttcaggtaattaatctttaaacactttgctgatgtcaaagcccaaggtgaaggtattttcttgaatattatggtattgcctctggtggttaagagtcgtttgttgcagacagtaagaggcacggagacaaatttaattttagttttactttttagaaaaagaaaaatagaagtatttgttcaggtacagtataaatgtagaatatatatatgtgtatatattcacacaaacatacacacatgaaatatttctttgtttaaagcaatcaatacaacgtaagactccaacactttgtgtaaacatgttcctgtactacatgaaagttcctatctcagtatttatagtatgatgttgataaattgcatgattttttttttctgattggtggtaataaatgacagtgatttatcacttaacttttcaggtgagttcaaacagttgcctaggctgataagcaactaaaatatttaacagaaaagcagacctttctgttttcccagaagcatatgtccagatattagcaataggatatgaagaaggggaaagaaaattgtaaaagggttgttctgagagcagtccgtacagtcagagctgcaataagagctcgttttcatgcccagctgtgtgtctgctctgtcagcagcgttagagtcttgatctttatcaggttactgctgctgatgtctacattttcatttaccttggctgccatttaataataataataataataataataataataatacgacaaatgattaaggcagagctaggagtggacccgagaacgcatgtctcgttatatgtctattacatctcctgtgacatctatgatggggcatagtcttaattttaccaagccagattcctattttttggttttctaagtttttctagcttttaataagtttttggaattatgaaaacgatgaaaactctgaagtctcatttctagaaattgttcattttcaaactgtgttctaaggagtgttaaggacacagttgcctctgatgccatggagaacaggggtcagagaaggggaagttaacatctctctgggttcctcaggaaaagaagactttatcaaagacttctatttatatattggagttcgataagatttcttatagaaaaaatagcttttgaataaagtttgaagaccaatggtctaagccatcataactgcggaaatgtctttcttcagtatccctgcttggacagtggttttgcccccattgtgcacaacacttttccaaaaagcctttcaacattaattatggctggagctgactgctttcctcagaccatcatgcttctcctaatacaataaatgtttctcttgctgggcaggtggatgattggattgatgaatggatgcatagggatgggcaggaaggaagggagagagggcatgcatttatctccatgtgtctgatcttctatgtccagacatttttttaaaattatttgattatatttcttatcacttagggtaggaaccatatcttgcctgcattttttctagctcatatgcggttagagaaacagtgaactgcctactcactctttcatgtattttgggggccagatatccttctaggtgctaaggatacagcagcaagcaaaacagacaaaaatgcctgttctggtggagtttagttggaggaaaaagagtaaacagagaagtgaattttatggtaggccagttactgatcagtgctacagagaaatacaaagcagcaaaggggaggaggcagctattttgtatacagcaatcactgatacttgcacaaggacctgaaggaggtgaaggaggggacctgggagccataaggagaaagactttgaagtacgtgcttgtttggcatattctaggaccagcaaggagaccccctggggcagggcaggaagcgccagaagctgattgctatgaggtctgactgtttttccttgttcactctaagctgggaagacagtcacgaagtttgagcagagcaaagacgtgatccgacttaaaagaaccactcttactttagtgttaaccatggaccaggcatcagaaacctttttatgtaaaggtccagatagtaaatattttaggctttacaggctatatgatctctttcacaactactcaactctgctattttagtacagaagcagccatagacaatatggaagtgaaaggctacggctgtgttccaataaaactttattttttataaaacaggtgtcaggctggatttggttcccatgccacagtttgccaaccactaaactagaccatttgccaagtggttttgaattgtggctatgagtgcgtaattattttgtctgtatcacttgtcagccaaaacacaccccaaacagtctaccatctattgataatttttatgtgtaatgccctatttacacaattcatctgttaccacctcaaagccgtagatgtaatttaataagttgatgcttttaaaagacttgtctattagaaagaaagttagccattcatagtttcttcatatcaaagttcccatatcactttgaggaatggaatatccaggacaaggactgtgttccctgtaatgattgttgtgagttctgcttactcttctctacttttttctctgactgggctagcccagtgcagtccaagagaaatgtaacatgggtctcaagtgcaaaccatatcaagaagtttaaaacttctaggagccacataaaaaatgcaaaaagaaacaagggaaattaattttaataatgtttcgtttaaaccaaaatatttcagtacgtcatcaatataaaattaccgagatattttacattccatatcttgtacgaagtctgaattctggtgtgtattttgcaatgtagactagtcacatgtcaaaccctcactccgtggccacatgtggctcttggcagagatctacaggattggagaaggctcagaatttggccttccctgatgaatggccttttgtaaaaacagtagcaacactaataacccagcaataatctttaagctaatttgtgaaactaatttactttttctttgaaagagattacaggtatggaccactttacaagcactgagattattattattgctgtcttccagttactcaacaatgatgaacagcaaagtatgatataaggaggacttctaatattcaatagagttttcttttcttgtctttgtttaagtttctttttttttttttttttttttttgagatggagtttcactctgccacccaggctggagtgcaatggtatgatcttggctcactgcaacctccacctcctgggttcaagcaattttcctgcctcagcttcccaaggagctgggattacaggtgcccaccatgcccggctaatttttttgtatttttagtagagacggggtttcaccatgttggccaagctgatctcaaacttgtgacctcaggtgatccacctgcctcggcctcccaaagtgctgggattataggcgtgagctaccgtgcctggcctaaatttctcatgtgcttactaggtaactggttacaaatataaaaattgcaaaatcagctcactagtgattctctcaccctcacccccagctcaataactggctctagagtcatttggcaagactttagaactgcacggattgcaccttctcccccttcagggagaatcttctgtgtgctctatcggttgttttcaatgtgaaacaggactcagaggtggtggccactgaaggcccaacctgcaaataaagcttagtaatattcattttgcacaatttaaatacatatgtgtacatttactaatctataactgatccccccaatacagaattatctggaatttgcataagaaactgtttatataaactgcaaaacacctatatgttaaatgatttttaatagaattgaaattctaagaaattaaattcttttttctattctttgagaaaggttcttgctctgtcacccaggttggagtgcagtggcacgatcatgtctcactgccacctagacttcctgggctcaggcaatcctcccgtcaaggctcacaagtagcccagactacaggcacatgccaccatgcccaaataatttttttaaaaattaattttttctgtggagacagggtctcataatgttacccaggctggtctggaactcctgggctcaagtgatcctcccacctcagcctcccaaaatgctgggactactggcatgagccaccatgcccagtctctacaaaaaaactttttaaaaaaattagccaggcgtggtggcatgtgcctgtaatcctagctacatgggaggctgaggtgggaggatagcttgagccttggaggtcgaggctgcagtgagccatgatcataccgctgtactccagcctgggtgacagagtgagaacctgtctccaaaaaaaaaaaaaaaaaaaaaaaaaaaggaaaaagaaattaaaatataagacaacatagagtttgagagttggcaaacagcagggcataaataaaataaataaaatgctacagagccatttgactaaaatttttgagaaacttgtagcactacagcagggctactccaacggcctgtaacagcagtaaaagcagcagcacctttcctcactttgccagacactgccgttttggctttatcacccggagggggtcccatgccattgtgggagtgtccagtggtgttcacggggaccctgacacagaaaactggccataggatctaatgaaggaggcgatgatcagagctgggaaaatttgagttaccacagtttctctaactacatctgattccaccacaggatcagtcatgggtatctttgaggtacacacatactcaaatcttgctcagttaattactttcaggcacaaccaggccattaaaatagtaattgagttataagttactattttataaatccctttctaagtctttgtagatttatagattcagtcttcattaaatttgaccataagccaagtaatttcaatttctttaagaagagagtttggcagatgttaaaatagaagggaaaacctgattttatggaatttcttgaaagagaacattttgaatccagtgaaaagggaaaaaaagtcagtattatttatagtcacatagtataacagcaacaagaagtaattcctctggctagacgtgacctcctctggctagggcacttttaaaaatgctttatgtagaacttatttaattcttacaatcatatgagataggtattgctcttttcctcattgtgcagtgaaagaaactgattccaaaaaggtttcataacttgcccaaggttatacagccagtaactggtaaagctgggatttgagcccaaacagcctgactctggagttcctccctttaatcaccacactaagtaaatatccatgtgcatgatgaatggataacctgaaaagcattttacagatcaagtcgtattaagcacctaatgggtttaaaacataatgcgatcccctagtgagtccttgtggcatcagtgggacattattagcttaaaattcagcagttttaaaaatgtagattttaaaaaatcagattcacctaaaacggagatcatttatagaaagaaaaaaacacaaaggtcttctgttgaactgttcagtaagtgtgtactgatacaataatatggcaggatattgggtttccaactcagagttgatagttcagaattaaattttggcctatgtcttgctttttagctttttaagccattctgacgctaccatagacatgcccatctggtagatgagaaattcaggtgtagaaagacttgcagaaatcttatgagatgctctttctttgttcctgttctctttctctgaaccagctcctaacttacatctttgtagtcccaccattaatcctacctttgaccttccgggctcaatttttacagttagtcttaccagtgtttcacacttagttttccctaagtaactcttgctgtctgggtaggacagcatgagtcctgtcccataagacccaacctgcatctgctttctcggacatgtttttttaaaagcaaatatgctagtggagtgtgttatttacaatgcctttttcttagagatttctctggaggtttatatgggctaatggctccccacccacttgactttttgcccattacattatatgtttcttccaaggaacaaaaatataactctctttctctgacagcatgagggacattctcttgctgttgctctccaggaaaaatctcataatctaactagacaaacccttgctgaaaaattagaccaaatggcatttgtaaactccaaggaaagcatttttcttctgtgaagtgttccctagctggaagtgttagaaactttacatatactgataccaattaggtttatggaaaaaatgaaaagctataaacagctggatacactgtcaaaactgaaccctgtcaacttaattttttccctagctctgtattctaagaacctggaaacaatctttattcacactgttaagacgattgagaaaaatggatggatagagtttatttgctaagagaaaaactgagtgactacctagctacctcactcctttttgctctattggtaagttcaaatgaaggaaatagcattagaaaacatatgttgggattatgtgcctttatcctctttctcacactgtattcatacataacagtcaatgcacagattgtccatatgcctgatatgattggtgtttattttatttttgactcatgatctaaacccattacacaatgaaatatttcatctcgagaaatacatatgatttgcctcttttggcttaccagggaaccataaagatctatgttgtttacttgttttcagcatcagataaaataaaaatgttacatcttttttgggtaattatgctgcaccaatgtgacttgctttatagggttcttttatttgttaattggcactccactatctaatttatttgaagaaacttctcatgccttgtatatgatgaagaactactagtgaagaaataagcatagcctgtaacttatttaacatacttgtaggttcttagtaaacacagttacataaatgttgaaacaaaaatgggctggagtgaaggagtcctgatctatggttgatattaaatgtaactaacttcactatctaatgtgccttcttctttttaagaatgagattggtggcatgtctaaagttggattttggttctaatacattaaaaaaataactttcttatcttgaaaaagcaactagtgaacagtagagatgcttgctcactttatgagtgccatgtattaagggagttttgaagtgatatttatctgtacaacttcaaatctaccatggcattctgtggtagagtaaaaactttagagctaaacatacctgatgtttatacatgacatatagctgcatgtccttgggtaagttatttaatttctctcaaccctaaattttgactgtttaaagtaggttttataggttttatgtaatttgaagtgttgttgtaaataataacgataataaaatatcttacacagttcttggtttgcaagattgttaaaaggtacttgtggcctaattggtttcactagtaaattctagcaaacatttaaggaagaaacaacactaatatgcaaagtctttcagaaaatagaggaggtaagaacatgtcattttatgtagccatcataaacttgattaaaaaaataagttttaaaaatagatatcttaagaaaatatgaaatggaatgtagcaatgcataaaattgggatttatccctggaatgcaaatggaatgcaaatctttaaatgcttaaagattaacctgtgtaattcaccagaaccacacaatagaggagacaaaatataggatagtttaaataatatagaaaaattatttgacaaaagggaacatctatttataataaaaacttgaagcaaaggtgcaatggtaaggaatttcaatctgttaagtgaatatatggaaaatctacaactaacattacacttaatagggaaatactggatgttttctccctaagatttataactagacaaggatgcccactctcagctcttttaattatcattgtgttggaggtcatagctagcgcaataggagaagaaaatgaaataaaagaaatatagatcgaaaaagaagcaataaaactgtctgcttgccgatgatatggttgattgcacagtatgtcctaatgactctacaaaacacctatgaggaatactaaatgaatttggcaagaatgcaggatatattgttgatatgcaaattcaaatgtatttttagatgctagtacaaagaagtggaaaaataatttttaaacttccacttacaatgtcacgatgaaacacaaaatacttaggaatacctttaacaaaatgcatgcaaagatgtgagggtgacctggctgtgacatctgtcaccccattgatcaccaaggttgatttggctgatctggatggccaggcgggtgtcccctacctcccttactgcttcgtgtgtatccttcctgaagctgcatgcttggtcgaagaggacaaccacccctgatatagaggaggaactatcttcagtgaagagtatatgagtagctgtgctcccctgctagaacctccaaacaagctctcaaaatgcatgcaaaacctctacgccaagcactataacacattgctgaaactaatgaaagacaagctaaatatctagaaagagatgccatgcttattgattagaaatttctcaataatgttgagatgtctgttgtttccagattgatctataaagtcagtgtaatcccttataaagcccaccaggctgttttatttattctgcaagaagacatcctaattctaaaaatttattttaaatgagctagagctaggatatcttcagcaaccttgaaaaagaagaacagtgttgaaggaattatactatctggcttcataacttactacaaaactacagcaatcaaaactttgtgaccccttcataaggagacaagcagatcaatggaacaggattgagagcctggcaatagacccacacttacacaatggactgatttccaatatatgtgccaaagcagcccaatagagagaggaaaatatttgtagaaaatggtgctggaataactgaagcatcaacccctacctcacaccattcacaaaaactattttgagatggttcacaaacctaaaaataaaagccaaaattataatgcatctgaaagaaaacataggagaatatctttgcaatgtagtgggtaggtgaaagtgtcttaggtcacagaaagtgataaaaattgataaactaggtcaggcacaatggctcatgcctgtaatcgcagcactttgggaggcctaggcaggtggatctctttagccctggagttcaagaccagcctgagcaacatgactgaaacccacatctctaccaaaaatacaaaaaattagctgggcgtggtggtgtatacctgtagtcccagctactcaggaggctgaggtgggaggatcacttgagcccatgagattgaggctgcagcgagccgtgatcatatcactgcactctagcctgggtgatagaatgatagctgtcaaaaaaaaaaaaaaaaaaaaccaaaacctaataaactagacttaaagttgaacttgagctaatcagaaggcattgttaagaaatttacagaatatacatatatgacaaagggttagtatccagaatatatagcactctaaatctcaataacaaaaagacaattcaataaaaaagaggccaaagactgtcaagtactttgcaaaggaagataaacaaaaaatgctcaatattattaattatcaagggaatgcaaattaaaccaagatgagagacatccactagaatggctaaatttaaaaagaccagcagcaaatattggtcaggatgtggagcaactggaacttttaaatttttagtgagtgtgtacaattgtgcagccactatggataaaagcctggaaatttcttataaagctaaatataaacctactctggaacctacaattttacttctagatattttccaaagagaaataaaaaaatacatctacaaaagtcttataggagtatttacaacagctttatttaaactagccaaaagtgagagtggatgaactatgggattcctaagtggaatacttgccagctatgccaaagaacaaactacacattcatgcaacaacatagatgaatcccccaaacttttatgctgcataaaaacccttatacaaacaaatacctactgtatgtttccatttctatgaagttcttgaacaggtaaaaccaatttatgatgaaaatatatcagaacagaagggattgcagcagggatttaccaggaaggggcatgaaattttggagttgatagtaatgttcagtatcttgatggaggtacttgttatacaggtgtatgtatttgctagagcttattgagtggtatacattttctgtatttcacagtatgtaaattttgcatataaaatactgtaaagcattgcagcatttaggggtaaagtgtactgatggttgcaactgacttcgaaatggatcagaaagtaaaatagattgattaagagagggatgggaagatgcataggtatatataaccaaacatcaatgacagaatttaggtggagggaaaaatgggcttacattgcataattatttcaacttttctgtgtgtgtgaaaatttttataataaaatattgtgataagcaattatttttatgttctaacctttaagggtagaaatgatcttgcttacaggtgaagaaggcattgaaattcaatccctcaaaatccaaagttgtcaaataacagagctagtattaaacttcattgtaggctctaatcctacaatccatatccttgctgtgttgatgcacaaatttctaaatctaaacacccagcgacctttggttaaaataggaagtgaacatgaaacctcagctttgctttgaaccccagtgacgactctccagtttcttaatcaactgacctttccttaaacaaaaattattctcgagggaagaaatgctagtagtcaggttgttgagcacacatttactaaatacccataaaaggagataaatactgagatgaaataaattataagtcaatttctgaaagaattatttttcttcctaagctcaggtgctgagaattctagatgcaaaaataaaaggccaagtgtcttagaatgatatgctcatgcctatgtctatttttttcttcgcctttcaaagcagaaattcatcaaagtcgtgcagatgataagtgcgtattctgttcctaagatcactacagggcaggcttagagcagtgtgtggcagtggaaagagtttggggctggctgtgtgagaccgggcctctcattgcaggtcctgtgactttgtacgactcctttaacctctgtcagcatcattcttcaatcctgctttccttattagtgtgaggataaaaataaagcaaatttcgaagttgaaagagagctaaaagataatcaagcccaacctcctcattttatcagtgagaaaatgaacctcgctcaaggcaactgagcccgatagaagcaaaaagtgtttacctgatttagaggttagtttaactgcttcatcaaaatgatctctagtcaatagctatggaaatacttcaaggatataggtactataggaatgcaaagtgttgatatttctttattagattgtgtaaatattgtatgcacatttttacttagaaagtatgtcttttgaattatgcatattaagattttatattgaatctgtaactgtataatcacgtatatataacaatctatgtgtagggacatggtcctttttgtaaaattcatcacttttttaaatactctgaccacttgacaatatgcttgacctttttacagattattctttagtgtaatattcaatatatataataaattacaagagtcagtatttcaattgtagatatttcactgggacccggttgaggaaaagtatataaaacacattacacagcattgcattttgaaataataaaacttttgcaacactgtaactaaatataatgacatcttgtcaaatatagtattttctttttatctttaaaaagccaaaagccattttgaggcaaaacaggctaaatgagatttctttaaaccaaatgtgcattggcagctttttaaattttgggttgtgtttgtgttttgtcaactttatattacatatatatttttaaacaactttattgaggtataattgaagtacaatattctgtacatatttaaatacaattttatcagttttgacatgtttacacactggtgaaaccatcaccacaatcaagataaagaacatttctgttatcctcaaaacattcctcagagcccctttgccatcttctctccttccaaccccgtccccaggaaaccactgacttgtcttttctcactataaattagtttgcatctctagagttttatataaatagaatcataagcatacacagttttttggcctggcttcttcactgagtatatttttgcaattcatctgtgtcattgtgtgtatgaaaattttgttcttttttctttcccttcgctcagtaggcattatgtggataacgatgccatcctttgcttatccattcacccatttgttggacacttgcattgtttccacttaatggctattacaaataaagctgccatgatcatttgtatacaaatccttgtgtggaaatatcttttcctttcttttgggtaaatatctaggcctggaataattggattatatggtatgcttaattatttatgatgctgccaacgtgttttccaaaatgattataccatgttacattcccaccagcagtgaataagagttctggttgcccaaagtcattgtcggtgtttggtatggtcagtctttttaaccaatctgcataaccaatctaatggatatgcagtatcacttaatattttatttgctttcctataggcacgaatgatgcctgtatgttttatgcacttttgtccatttgcttatcttttgcgaagtgtccgttcaaatattttgtccatttttctaaacacttcagttgtgtcttattatttaactgcaaaagttctttataataattttgaatacaagtccttcatctgatatttgtttggagaaaattttcttccacaatatagcttgccttttcattttttcgtgattttttaagaacaaaagttttagattttgatgaagtctgatttatcagttttagcttgtaagttttgtattttttgtgtgttttatttaataaaactttgcctatcataaggttacagctgttttctctaatgttttcttttagaagttttatagttttaggctgtacatttaggtctatgattatttttactcaaattttgtttcgagtgcgaggtaaggatcgttgtacttgtttttttcagttttgatttccagttgacccagcatcatttgttgaaatgactttcttttctctgttgaattttcttgacaccgctgtcaaaattcaagttatcatatatgcatgggtctctttctaaacattctattttgttccatagatctatgtctctatttttttttttgccaataatccacattcttgattactatagctttattgtatatcttgaaggttaagtgaattctctaccttttcactgtctagatcctttgcatttccatatcagttttagaaacaagttgtcaatttctaaaagaaaaaaagaagaaaatcttggtatattttgtttggaattacattgaatctataggtcagtttttggagaattgcccttcatgaacatgccatttatttatatattctctaatttattatagcaattttttgtagtttttaggcgagaggtattgggtatatttacttagatttattactaggtattcttctcttctctctgcccaactactgtaataggaatttgaaagaaaatcattttcattttttttgctatgaatacataattacaggatactttttatattaacatttatcctgcacatggcttaattctttcatgctttatgtaagttttggggagttccttgctattttctgtacaaacaatatatgatatgacaatattgacagatctgtttcttcctttttggttattatctgtttgtttcttcttttgttgggatcaatcataccccaaacctcagcatcacgcaatataccagtgtaacaaacctgcacgtgattatatggtttcctcctttactaggttactgttttaaatgacattgatttctgcatgtttaaccaactttgcatttctaggaaaagcctacttttgttatgatgtatttttttatatacagccgtgtcatttaatgacagggttacgttctgagaagtgtgtcatgagtcaattttgtcatcgtgcaaacatcatagagtgtactttcacaaacctggatagtagagcttaccaggctacatggcagggcctattgctcccaggctacaaacctgtacagcatggtactgtactgaatactgtgagggaattgtaacacaattgtatttgtgtatttaaacatgtctaaacatataaaaaaggtaatgtgttgagctaggacattctgacagctacaatgtcacgtcactgacaggctaccatgtcactaggcaacaggaatttttcagctctgttatagttttatgggactattgtcatatatgtggtttattgttgactgaaacatcattatgcagcacatgactgtatatagggaattatatttgataacattttgtatctttacatctatatgaagtacattggaattttttaaaaataatatttttgtttcatttttatgttagtcttatgctggccttacaaaaccaagttgggcagtgataccaacttctttatcttctgaaaatatttatgttagataagtgttatttattccttgaaactttgccagaatttactactgaaagcattttaccctggagttttcttttaggaaagatattggataatttaattatatataattatacattattaattgtctgcatataattaattatatatagttgtatatagtatgtattatatatatttgggcttatgggttgctgaattaaatatatatttgttattaaatacatatattgtaactttgtttttcttgtgtcaattttggttagtgtattttttaagaaaattgtcaattttatgtaattgttgcatattttgctgtaatattgtattgttaccccctttaaagtctattggttctgtgtcattcctgacattagtgatttgtgtcctttctctctttttcttatacattccagctaggactttttaaattttattgattcttttttcaagaaactagatggcatagtctagtatacacctagggtatatggtagatcctattgctcctatgttacaaacctgtacagtacgttactatgctgaatactgtaggcaattataacatatgccctaggtgtatagtagactatgccatcaagaaactagctattagatttttgtctatctgttttatctttcattgatttttgttttttgctattttcttccttctacattgagtctttagaccatggttgaatttaagtccaagattaaattacatattttctgtaattttttttatttacagaaataaaatttttttcttctatttctattttttctatttctttctatttctatttttttatcttcattagtcttttattcctgccatgttttagtttatttgaatatcttttcaaattccatttttatttatctaatgtattttggctaaatctctttttgtgtgtgtgttttctgtagaaattttattatacataccagccctttcagagtttatttagagttaatattatgccatttcacataaaaagtagaaaaattttggggctgggtgcagtggctcacacctgtaatcacagcactttgggaggccaagacaggaggatcacttgagcccagaagtttgagaccagcttgggcaacacacaaaaccttgcctacaaaaataaaaaagaataatttaaaaacagtagacaaattgcaataatataaatgatcctccactgacccttatgttgtaatttttgtatgtattgtacatatatacataaaaaaatcccaacagataataaaatactgtttgtttcaactagttatatgtattttaaagaacttcaaaaggaaaaataatcttttgtatttacccagaaatttaccatttctgttgctatttcttcattcctaaagatccacggtcctctctagtattattttcattcagtgtggagaacttgcattagcaatcttatattcagctctcctagtgatgaattatcttacttttcctttatctaaaaatgcgtttattttgcttgcatttctgaagaacgttttcactaggtatagagtttggggttgacaattcttttctttcagcctgtaaagaagttgtctgccatcaggcctccatgatttctgatgagaaatcttcagtatttccacccattcctgtctgtgtaatgaggcatatatttctagctgttttcaattattttttctttatatttggttttcaccagtttaactgtgatgtgtttaggtgtgattttctttgggcttgtgtattgctgagcttcttgaatctgtacatttatggatttgattaaatgtggaaagctttccagcattgtatcttcaaacaattttccttctcaatctctcctgtccttctggtactccaaccacattatttttgatcttcggaaattttcctacaggtccctgaggttctattcacttattctttattctccactttcattctctgttcttcatattagattatttctatcgagctatttccaagtgttaaattgagtttagcctaaagcagcctccttacaaattttaagttcagcctaaaggtttctctgtaaatcgtgaactaaatggagttgtatacagactgcagtctactcttgtgccaatcactgaatgttggccagtccaaggtggccaactgtccaaaccatgttcacataaggcaaatgccaagctataaacaatccagctgcttctgaacctcacttctgttttctgtaggtcactttccttcttcctatacataaatcttcttccagtgcatggctatgctggagtctctgagccttctttggctcaggaggctgcccaatttgcaaatcgttctttgctcaattaagctctgttaaacttaattcggctaaagtgtttcttttaacacacatttgctgattcttttctgcattgtttttacactgctttcaagttcacctagcgttttagtccgttttcatactgctgataaagacatactcgcgactgggtaatttgtaaagaaaaagaggtttaatggactcagagtttcatgcgactgaggaggccacacgatcatggtagaaggcgaaaagcacgtcttacatgacagcaaggaagagacagaatgagagccaagcaaaaggggtttctccttataacaccatcagatcttgtgagacttattcactaccatgagaacagtatgggggagaccacccccacgattcaattttctcccactgcgtccctgccacaacatgtgggaatcatgggagctacaattcaagatgagatttgggtggcgacacagccaaaccgtatcacctagtgagtttttcattttaaatgcagtaacgtgctgcattacaatgttttggtcaacaacagaatgtatatatgacactggtctcaagattataatggagctgaaaagtttctattacctagtgatggcatagccattgtaatgtcatagcacaatacattaccttttctatgtttagacacacaaatacatagcattgtgttataattgcctacagtattcagcatagtaacatactgtacaggtttgtaacataggagcaataggatctaccatataccctaggtgtattgtagactatgccatctgggtttgtgtaagtatgatgttcccacaatgatgaaattgtcgaatgacacatttttcagaatgtatccccatcaagtgacacgtgactgtactgtatatttcacttcccagcaatttaatttttttattgtttattctctattgagaatttttgttttcattcatttgaagagtgttcttacttataaagcatagtcgtaagagctgcttaaactttcttaaactagctagatcatcaggtaacttgagaggtttttggtttttttgtcatgagaattggtctttttttggtctactgagtaattttggatggtatggatattgtgaatctctgttgaatacagtctgttagaacattcctaatatacttattttagcaagcaatcaggccacttaaattcagactgtaagttgtgtgtcatcttctatgagaggtagttcaaatctcagttgagtttttaaattcttggctttatcgggtttgtgtccctcctatgcatttgcaattcaggggttagaataagacttgtgcagacagctcaaatctctgtttggcttccaaagcatttgtgatctttatttgggactgtctcatgtgtgcttatttcaggaattatgctgatagttttgtgaggttcattcacaaattaaaggattcccttcgctttctgttttatctgtgggattctccttaaactctcaggcttgcaggagtctttctttttggtttcttttgccagagaaacaggatttatctcagagtttatctgcttctgcagctgccatttcctcaccattttgcaactgaggtctacccttgagatcatattgcacaagaaagaagcaacatggaaaactcaccactgtgcagttcactttttcaacttttgcctctcttctatgcttgcttttgagaggtggttgttttcttaaatgtattttattcagtttttagttgtgattagaatgaggaatgggctgccatgattgaactagaatgtttattaattttttttgccagaaaaaatactgattatatgtcaaggtatagaacctgtcttttaaaattaaccaaaccaagccgggcacagtggctcatgccttttgagaggcccaggtgggaggattgcttgatccccggagtttgagaccagcctgagcaatatagtgagaccctgtctccacaaaaaaaaatttttaatttaaaaattagctggatgtggtggcttgcacctgtaagttccagctactccagagggtagtagttgagcatggtaatatggtagtactgagatgggaggatcactggaggtcaaggcttcagtgaaccatgatcgtgccattgtactctaacctgggtgacagaacaagaccctgtctcaaaaaaaaaaaaaaaaaaattaaccaaaccattgtgatagatgaagttctgtcttcatgagtcagttgtgtagaaaagagcaaaagtgattgttaaattgtgactattacacacacatgcacacacacacaatttaataaaatagctgcttgtgatactttagatttcacattccacctattctgtgtacttagtattattgtcagtgagtaaaagacaacactgtgttttccttctccactgggttattaaagataaaaccaattgtatatttgaagtgcttggtgctatcagaatcaagatgtatgtaaattaaagtggtattatttttctaatgcataactaattcttagatattgttaaatctctttacgactgattctttgagatgatttacatataaggcttagttaaaaatcaagtttaaaattaacattggtgacagtgtttcttgttgtcaagttcaaatagtaggtcagtgacaacttccttatgaagtcgagtttacatagtgatacaatataaaaatcaaaggataaattactgtgtttgatgcacattttggatgtagtatcgttttcttttcttttttccctcagaataatcaagggctaatgtgaatcctgtattatgtatttctacttttttgatggtgattagtgacttttaaggaaatgaaagaatgagggcagcaaggccattttatgtagcattgaagttaaattgttctttaaaaaaataaaggatgtatgggcatatgataaaccataagattttccatatgcttatgatacccttctgaccctgaattggatcaaattatttaaatatggctcagataagaagcacattgcagttcagatgaaagagtatcctaatggacactttccaaacatttattattcttgtttgccttttgaaattgtgggcatagaaatagcaagtctctgaatttatgttattatttgtgaaatgatgaactatttagacattttgttatatgattatgagaatttaaaaaatacttatctgattaatctctaatttattgtatcacatgacctcagtattttacagttttcaaagttgagatataattggcactcggtaaaatgcacagatcttaaatgtaaaattcaatgaattttcacataaagtctatacagtttttacatatattacccagatcaagatataaaacatttctgtcattcctgaaatttttattgtacccttttcctttcaatagctcccaccctgcaactagagtcagtcacacctttgtcagcatagattagttacctgctcttcaggtgcatatatatatatagcagcatacagtgtgcactcttttgcataatgttttcaagattcatgcatgtgttgtgttttcatccatgtgttgtgtgttatttcatttatatatttggggaatattcagttgtatcaatattccccagtttcattgttcatttttctcttgctggacttttgactcacctccatttttgagctatcatgagtaaagccacttaggacattctgtatgtctttttgtgagacagttctcattttttacattagataataaatttattatgaattcatatgtaaatttgcctagttggatttctgtttcatgtcaacttttagaatataatttgctatgaaaagtggttccaaaaggtgaaagttacactaaaaaattctaacattatttgaaagattattcttccttttttaaaacatggattatccatatttgattctcctgtgtaaactgcaaggaaaattaaactttataaatctgtaaaaagcatatgaaaattaaaacactacacacatggcattcttactttttccaaacaactgatgtgaccatttctcccttcaagggccagccacatggctccatatcctttctccaccatgctattttactatattatggtaagcagtgtattcacccatctccccatgagactgtaagctccctggagacaaagaccatctgtgtcttttctttttatccctagcttctagtgctttgcctggtacatggtaggtacacattctatgttgaatgaactgaacaactgccttttgtctagggtatatatttgctttgcaaaagttgcttttgctatggaaacacaacatacacttagctttagctcaagaatttactattccctttatgtcttaaggcttttgtttaatacatgagctgacttatcctagtttcctgtttatgtaaagtatgcttctgatgaaaatatacactactagaaacttataaagggttgctgttttattagtttaataacattgttaaaatttactgatgtgtcattgagaaaaaacaacttcaagtgaggacaacacacacacacacacacacatctttaactgatttttttcttcgagagtatattgtacttagcacactatatacttagtgcatggaatataaacatcactttgcttatttttattgttggcaaaagatacaatatctgttttacacaattaaaagaccttgaaattatgcatgatttttattactactgggatttccatgttggatcaaaggtcatcattccaatcgtctcaggctccctttttttcttctaattgatcattgcagtgcccatctgtctgtggctcacggtataaccttttttgataggggcagggtggcagatggacagcagatgggagttttgccctgcctcgtggttcagatcttggcccaggcacgaactgtcagagactgtcagtttgtcgtctcggcttgtgggctccagtgctgtgtttggcacctcagccatgggtctgaattgatgccaagctggaccagctatttgtcattgtgactagttaatgaccaacattaagggtgggagcacctagtgagtgtgtaagataacctagtagaattgtgctttctactgtgagctggatccccaggacccgagagtcagctcattctcgggatagaagttacagaattagaaacatgtaggtgtcttataggtatttacccactttaaaaagaacacaatttccccaaagatttcctttctatacaaaaccacatgaggacatgagtgaaaagtagaggtagatagacagtggcttgtgtttttgtctaattgttggacagttgtcatcttctggaattcctaggggtgctgcatgattgaaactttgactattgataacattttgaatgcaataactgtgactgcttctgccatcacattaaaagacagttcctaagattgctagtcttttcaaaaggaaagaagaaagcctttaaaaaaatttattctgaactatcagcacactcttttttttttttaatgtgtgcatgaatttactgctttacaagtgactcttttcatttcaatagaaaccatattgaagtagacagacgaggctgggtgaagtctcctaatggagggtaaaccttggcagtgaccgtgaataaaaggcaataatgagtcagagtggatgctgagttctgtgcttttccttatttatttaatttctttagacttagagctccacggagatcatatcgtgccattctttagctgagctgaatcccaattttgatgaatgacacgagagtttatataatgaacatgtgcccacagatctctaaataaatgtccacaataagtatggaaaactgtcccactgtctctaccagggccatcagtaacttctcacccagttgtggagatctttagaatactccatttctttcctgtcctctgaactaaatcaaaatattatgtcctgatggttaatagtatctctgttcatacaataggtacatgatgacattattagacagtttattaatatgaattgtccacatttgaatattttcttgtattctgggagtcagaggttgctcctacatatttgtaatgaattatgctgctccaaattatatgaacaacattggattgttatgctcaaataaattatgttttcattcactccagatattctctcagtttgatttagatatctgcagtgttgaccaccacaaggcactttaaaatctacattataacagatggctagacaatcgtttacttaaaccttgagtaacccccgtattataaaataaatatacattttattccatattccatcagatattcttttatctcttcaattttcttctttcataattgaatatatttaaaaattgtaaaactgtgcttatatcctcaggtaagatagtgtgtgtatgcatttgtctgcttatctttgtaattattgttcaatttatatatctgacaggtgaccaaggtgcttgtattttggaatcttggcattgtatctgtggcttccttgagaccaactcatttattctttccttttaaaggaatcttgaaatagaaaaaaaaaaatcttattacagtgctactcaggatggcctaaaggactgtgttataccccggctagctattaatgtactttaacttggatcttgctaacatgatttcaggtgaggtgtggacaggatctaattagttataaatctgtaaatgcttgaacagaggctagcttgatattctccatctgactgatgctgctgtaatactctaatcccagaaagctgtctaaaatgaatttccattagccatggagttaagggaaagtcatgaacttgaggaaattaagcaatgtctgtgacttagccagttagatagaagctttgctttgccagtacgctatctgcttccccctagtcttgttcttgctttgggatggcagttcttaaattacaaccaccatgagctgttctacagaaatgtttaagctatctaacaccgaacgtcttctataaatagctaatttcttgtgtttaatcatcctttaggttatatagtacttatggattacaaagtgtttcactcctgctttgtctgattttttaaaccccccattaggcaagcaaagaagaaacctacataaccaagaaaacaaatcaaagttcagcatccagctatattaattattgccttttattcatagtcattgctattggatatagaacggcaaacaagaaaaaaagtcttcaccttcaagaagcttacattctgataaggccggcagtaaatagaaaagcaaatactagaacatcagatctaaagaagtgctatgacaaagactaaggctaacgtgtcagaaaatgagggagagggaggtgaaattttatgtagggtggtcatagagagcccatctctaattgtgtgtgtgtgtgtgtgtatttacagattgacaggttgtgaatcgcacaaatcttaagcacgcacacacacacacattgatataacctgtacctccgtcaatatatagaacattttttcttttctttctttctttttttttttttttgagacagggtctcactctgtcacccaggctggtatgcagttacataatcgtggctcactgtagcctcgacctctcacctcagcctcctgagtgccaccacagctggctaatttttgtattttttttgtggagacagggtctccccatgttgtctaggctggtcttaaactgggctcaatcgatcctcctgccttagcctcccacagtgttgggattacaggcgtgcaccactgtgcccagcctatgtagaacatttctataaaatataaagattataaaatataaaggttataaaatataaagcttgctcctgcacttttctcccccattgcccccaaggggcacactgttctgattctttcttcatagatgacttttgcctgttctggaatcacacaatatgcactctgttgtggatggattcttttgctcctcttaagatttttggtgtgtacctatgttattgctccattgggatcgtttctttttattgtgttctgttgtctggatataccacaatttgtttatccattcacctgctgaagaacatttggatgttttcggtgtttgtccattgtaaataaagttgttaggaacctttttataccacattttttatgcgtatgtacttacatttctttggggtaaataccaaagggtagatggttaactttaaaagaaagttccatactggttactaaagaggttgtaccattttacgctcccaccagcaatgtaggagagttctgttttttcatatcctctttgacatttggcatcatcagtctgttaaattttagccatgtgagtgggcgtagggtgatttctcatgtggttttgatttgcatttccataatgactaatgatggtgaacattatttcatgtgctttttggttattcatatatatttctttgtgaagtgcctattcaggtcttttgcccatattataaattgcattgtctttttattattgagttgtaggagttagaagtcctttgtcagatatatatattgtgaatattttctcctagttggtagcattaaccacttattttccttatggtgtcttttcttttcttttttctttttgagacagagtctcaccctgtcacccaggctggagtgcaatggcgtgatcttggctcactgcaacctctgcctcccaggctgaagcaattctcccacctcagcctcctgagtagctgggattacaggcatgcgccaccatgcctggctaatttttgtgtttttagtagagacagggtttcaccacgttggccagactgctgttgaactcctgacctcaagtgattcgcccttctcggcctcccaaagtgctgggattacaggcatgagccactgcgcctggcctccttatggtgtctttcaaagatcaaacattttaattttgatgaaatccatttgtatattttttctgttattttaaatgttttcttatgctaagatgttcgtctttcccaagatcgtaaagatactcttctatgttttccttcagaaggcttatagtcttatgtttatgttaagatctataatctaggatacagttttgtatatgatctgagatatggggtatttccccaaataaatagccagttgtttcagtataactggttgaaaagagattttcctttatctattgaagtactttggggccttggttgaaaaatcaagatttggggcatccaattaggatgtagaaagctgaaaaaagaatatttccacccttacaaaacaacaaaatagcagaaaatttgcaaatacatgctgttcttgaacctatgagagagccgaggtctcagggaaaccagctacaacttaaaattcaaggagggacaagtgtctctcaggagagatgaggggctagcccttgcatacctggagcagatgcctaggatactggtaagaagaattccactaaaatgtttaacaagttgataaaggccaatattaagctagttagagcaactaaaacccctggggactgcagacacagggagatttgcactccttggcaggttcttcttcactgatgtgcaggatatgcataaaaaggatagggcaagagtccaaaaaaaaaatttccctcatgcagacctgagagggtgttcaggggagggcatgaagacccacctgtatcgctttcccctctctctcctacggaacaaaagccttaaacttcatggggaagagcaacaaaccctgttgtccttagggaactggggaaaacttactgcagctgaagggaggtacagaaaaatctctcttcccctgggatgaggcaggaatacatcttaggcccagacctatagatgggggaggagcaggaaccaaaggatagccctaccttcaagacccaggactcactgtctgcccagttaatcattgcaacagagaacgtctcccatccccatcacctggccgacaagtgacaagtggctataccaggatgatccccaggttgcaaatggaaaactaagaacagggaattaaatgggttgcccaaagtctcacagccggtaaatggaaaaacagatttgaacccagatagtctggtgccaaagtccccataaccaccatgcagtattgcagaggcaagagaatggggacttggagggaatgaggcaaatcagaagagtgactctcctggaacggacagaagtggccaacagagcatgtggttttaggaaagaggatgcaattgacaagaccaaatttaacagagctgttgaaacaggtgagaaatgaaaagtgtccattggatttagcaatgtagaagattttgtttaacttttaacagtaagccgttttactataattgtgaagattcaaaccagaattcactggattcagaaatgaatatagagtgatgaagatgagttagtaaaaatagcccactttcaccaaaagtttggagaggacgaggagttggagcacaggtatggagtgacatgcaaagaggagtggtttttaaagataaaagtgggccgggtgtggtagctcactcctgtaatcccagcactttgggaggccgaggtgagtggatcacctgaggtcaggagttcaagactagcctggccaacatggtgaaaccccatctctactaaaaatgcaaaaattagctgggtgtggtgatgtgcctgtagtcccagctacttgggagactgaggtaggagaattgcttgaacctgggaggcagaggttgcagtgagtcaagatcataccactgcactccagcctcggcaacagagcaagaccccatctcaaaaaaaaaaaaaaaaaaaaaaagatagaagcgatttgggcttgcttacgagacagggtgacaaagccagtaggatgagaaggtttgtcctcacaagaaagaagagtaaacagagtacaacgtagttggtaatagtttataaaataggcataaagaggtttgttgatttatctggggtatgttttgtggcagttttctgagtgtacaaacacccttacttttttttagcttcttgtagtattattttaagtgatatataatttgctcaatttcagtatattccttatgtgagctaagtttttatccaaacttaaatacatatgtgaatttcacatacctcttgtgtaaattttttttgagtaggaaaaagttgtttcatctttgctgctgtgtgttgatatgcattctgtcagaatacagctttttggtaatgctgcaataaactgtcactctaatgtaatagatacatgtaatagatacaataactcaatcattccatattacttgacataataaaaaaaatggcttgaaaaacacagcctaaagaacaaggttgaaactctagttagcacaggtgttaggctttctactgttgtagtcaatactttcggagctgatacctttggaggcaaggactgtgaaaacgttcatgtctttatcaccattgcctagaatggtggatgcctgaaaatgtcagaggtatgggaaaagaggatacatttatttaggtttattatcaatattttaaagcatatggctattttaaatgatttaatcccgtgtttgacaaatagtagaacctccagaagccctggaatttcaactacctccatgaagtttcagctgactttagagatttagtttaatggccaattactgtgggcaacctaaaaggcgttgcacctggcagaagcactggacacatcctttccttatgcttctaaaccttgagatgatatcatcaggtccagttccatagtatccatcttattctcaatattcactctctccactgatacaagtgtagcacatctgttaattttttaaaatgcattagtttttacttcaaacatgagatggttttgtttacaccagtatctcaactattaacacgtattaaggaaaaaattaaaagtttacctttggaaattgaattgacattgggaactttaggttaactatcacagtgggtcacaggaaagaatctggccaaatttgtcaaccatatttggcctagttttctgcatatgtttgccaggtgcaacagccagcttattgctggagggcacaaaaatctggaggaaaggcttggcacttgtgctgtttaacccattgaggggtcttatttttgctgagattttgcctacagagatctgattatacaatagcgtatgaatgggaaagtgaggcttctctttgccttccgtaaacgagagatttatagaatgcacctgtcaagcatttttgggaacacagtcgcaaaaaaaaaaagaagattaaaaatgttatctgtattgggaagaatacagttctaggtgtgaatggtcaggcaaatgggccaattaacaaacatgtactctttattagggggctctcaatttcccggaaagttatcacttaaaatgggaagcatgaatatatatatatttttataaagttagcctgatatgtaaaagaatttcagaatttttgacaaatcgtataattagaggttatatatttatagctgattcaaatcccaaaatgaatagagatgtcaaagccttgagcatattgaacgtttacacatgaataagcaagatggcagaaactgttttcaagcagacctatttttttgcctttgtatgtttttggtggttcttcaacttgcaatttccatataatattttttcatgtttacattagcatgtaattagcatacatataattccatagtgggatatgtaaatgctccccactccccaaataggtcaaatggctgtgaatttttattttgtttaatactatacttctagactatttgttatttagacagtaattgtattttctttctttttaattattagtttgagtcatgtggcagcttattaagtcccatttttaagtcaaagacattaatgtttcaggacaggtgtttgagtttcagaatttggaggaatagaattgaacacatttatattacttttccctttcaccacacttagtatttgaagactacagtcactctttaactatcaaatttttttccattattttcataaaaccttcatacaaccaggcacctaaatactatctcaaagtcataacttacttctggaggtagtctctctgtaactcttctcagatcactgggaaatatctgggaaatgtttgaggaaaatattttaatgaagtttaccaaatttatttttaatgctctgtgtgtgtatatacgtgttgagtgaaaaagagacacacactatagagaatgtatttcaatgattaaaacacgcagagaataaaccagttgaagtatcatttatttggacatcttatctttcacctaatacagatgtatgaggattatgagtaaagttatacatctttatatatatgtgtgtatatatatgtatgtatgtatatatatgtatatttatatatgtaagtatatgcatatatatttatatccaaagacctctgacacaggtgcgtgcatgtatacacacacacacacacacacacacacacacacacacacacacgcctttgcatttctttttctttttttttttgagatggattctcactcggtcgcccagtctggagtgcagtggtgcaatctcagctcactgcaacctccacctcctgggttcaagtgattctcttgcctcagcggactacaggcgcctgccaccatgcctggataatttttgtatttttagtagagaagaggtttcaccacgttcgccaggctggtctctaactcctgacctcaagtgatctgcccgccgtggcctcccaaagtgctgagattacaggcgtgagccactgtgcccagcctgcattttgtttctggttagctcaggtcagtgagtcattactgctgggtacagatgtgaagtgtagatgatttctctaacactgctgtgggaacaagtggggctaactgtggctgctccagagaggtacagtttttagggcactgagattgttgaaaaagaaaatgaccagtgatacatgtgtaggtagctggagtgggtggccctcatcacttccatgtcactatataccctgtatttctatctttcccttggtaatttgcagatttattgagacaaatattttcaactaagtaattcttcacatcctaacatgtatagtgaaattcctacttgtagagttactgtgtaaacttagtaaccattggaagcatggaaaaaattgatttggaaaccctgaaagccctatgataataaaaatcatacagcactgaacttgcctaggtgtattataattacatttgtctgcctccccccacccccatactgtgctttcattaagagcagggacaaattttaaatttccagattttaaatttcacagtttgttatggcagaagcacacaataaaggatagttgaatgaagaaaatgatgaatgaagtttaatgaaacatcaaggtctctctattttgttatctttaccaaaatcattattttttttgcttaggtaagtggcaggaatttatatttatatttctctttttttgtatttactgatactgtcaaggaactatgatgttagtaatgaaaagaatgctggaataataataccaatacctgagtttaaattttggcgtcacctcctcgagccttcatttcttcatctgtaaaatgggctaataatatctataccatataagtgttatttcacagttatctttctttattcaggaaactcttgaaaatctcccataatcctaaactgcctagctaatatagtaaggatacaattttgaaacatttcatgatgctttaaaaaaataaatccctgtaaatcttgctctgcaggtgccatgctcatggatggggaattgagagccactgttgctttaggagtagggcagggacagcctagattctagaacaaatgtgccctggtagccatcagagaagttcttataaaaaccaggatttgttgaaaattctaaagcttacatttaaatattaagaagaaaccctgaggatctgagacaggatcttatgtaaagtgagatgcaaccacataggaaagcaagatccttctggtggatcaaagtgatgcttgaggagagattgaggatggggatcaagaacaaggtgattaaaaacaacacaaaacacttcggaaggttgaggagggataggcagaggaggccgtgtcttcctgatcctctggaaccctgggggagtgccttttgaggatctccaaaccatcttggcacaggtagtagagttgaaaagtggcctgttgaagaaaaagccattctactcacgtcttttccaggtacctcatatcttaaaattgagccagatgttctggagagacagatgatgaagtgacctaataagtaggcatcagcacaccttgcagggtcctggtagctctaagcaaggaaatcggtggcagagattacagggtgcccctctccaagctggagtcacagctgagtctgagcatcagatagagctgagatgaggagtctagtcagtcgggggagatggccacaagcaggcattgtttggtgcctatgaccagaggaccatcccagacacttcagaaacagttacagtgaagttagaagccaacatccaccagcgaccaggcaagattagctgtgccttactcagacttcagcagcccacccaagaagggcagtgatgagagcagatgttcttttgccaccacagcgttacatacgcttcctctgaggaggtgctagcatgccagaaggagggggaagagagaaaacaacccgaaagactgaaaatctgccccaaattgaccattttccagagaacccgagtgatattaaatgaaccagcttaaaatgtttgttttgttttgcatttttatcaccaagggagaatggagacttgtgagcaacatgaagttagttatgtgacgggaaacaccattttttaaaaaattattttttgcacatctgtattataatgaatacatttccaatcagccacaccagtgtgtctttctctctttttaacttgtggatgtatagtgttcccatttgtaatgtatgtatttggagcattttatggtatacagaacgctttcccatacgccctctcatctgttccttaccgtaacacaatgaggtaatgtcaatattattatgcttatgtttcaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatgggtatggatgttttggtagttcttacacatttattttaaaatttaaagaagtagtgccataaagctttatcaggatgtatttaaaatgaaaatagtctcttgttatctagcatgcaactgattctttcaatttggtttggttagtcagaatcttaccagaagtctgtccaggtgataggttagttgagagcatcaagaccaaccaaaataaaacaaaaacaatagcctatggcaaactcattctgatcatttcacatcctagagaaaagtgcagagaaacaaaaatgagtcaatattttataaattcagggtcaatattgtatgcaatgtcaatagtgtatgagttccaaaggttttgtgtcactattaaattagaaatgatccatttttattcgacgtatagtagatcgggccatataatggccaataaataaataaataaataaaacccccacaccagaatacaaaggatagtgaggaaacgtattttgtacgacaattgcaaaccacttatgggcttcaatacaaagtaatagagaccatctcttctctttggctttccattcatttttagcattagtgaatttatgtcctgtgctcttgaccttgagccctaagaggtgtatgtctttgccatgcttctgtggctacattttaggagagtgagtgtgcattacatgtccgtaacccagatcttagatagtagaagggtgctgttataatttgtggacagaggctgtaatttggtgctcagggattacctcctttgtatatgtttgcctactgcatgctaccatttattgtaagctttttattcatgatcttcattctagttgaatctgtggagctattggtcatgagtagagaaatagatctatagggttttcttgaatggcatttctcattgctaatgtgttctgtgaccagccaggtttatggataaacccagtttttgtgtttctctgagaggtatgcatcaaagcagttttttcctcttcacttaggaattttaattttccttcagggttcagtgggccatttagtacctccattatctcataagttattcttactatttaaatgacttttttttttaggatgttagcatgttggcccttttacttttattttcaaagtcagaccaaacaaaccatcagagtgctgtaaatttacaccttacatttgtttggaattctttttatattaatatttttagagtcttcatatgcaagcagaaattttccatcccctctccactgatcaccattgaggacagggcatgagatgggcaaacccatgcttttgtgtgcctgtaatggctagcctctttgttacacactttatattggtcgttatctgatagaattccaacaaatgaaaacatgcccaagttaaagaaattaaatctccttatccatcaccttagaaaaatgacaacacagcatgtatgtaatttaaaatgacttgttggaatatttattgctagattgggagaacatttctactgataagaagctcctttgatttatcaaagttttccatattatttgttaattaactccatgtccttaatatccacagctcatttttcctatgataatgactccattgtgaaacatataaatataatgaaaaatatccctacctgtattaaaaattgagaaacctcaattacttcacacccattgtattttgtagtcagctcaggactgtagttacataacttcagttattattgctggagcaacaagataagagagtcattgaaacattgcaaaagagaatgcagtggaccagggtggtaatgttgtccttgtaataagcctactcctgccattgctgttagatgaaggttttctttttccaagtgttatataattatatgcaattatttttgtcgtttggttttcctattatctttttcctcctctttttgacacgaaaatgatagtaactggaaaatataaaccaataagatttgagctatttactatgttaaaagagaatttgccaggtttcaaattatttcctcatttggatctagcgtgcagcacttactgataagaattctctaacacatgtctatttaaaagtattaaaagtattgtgtacacatttcagcaaattttggcaaaagggtgtcctctgatggggaagtgactgttcctttcttttgccatttcccagtcttaaacccttgtttttacatcaagctcctttgttaaggattcaacataaaagtctttgatattattgagtccatctctgactcattattagccaacactttgtgtctggctggcagcttttccgtaagtggtaaggtcagcctcatacagtattgcacagcctttcccattccttttgcgtcagtgagaatcaaatgattcaacagtgaaaagcaaactcttggactggaatagcaagatgacccatctctaaacaaagcaaactgactaggattctctcatgcttaacatgcatcttactggttctttatgaagagctttctcttggtaagagtactctttaatatttgtctttactacaggtaatcaggatctgtaattcatgatttctctcctcagttaacaaggctatggaatatttcaaagcaactcagggtcagcatggtatagtggagaaggcgttgagtcaatagatacgtctaccatctgggtgctcattgagagagaggcctgttaccttctcttagtctataacttcatctgtaaaatggaaataatcttatctgcttcacaaggttgatgcaaaagtgaatatgtataaaattacttggtaaaatgtaaaaccctattcatatataagggactgctatccttttaagaagcagaagtgtttgctatcatcatttgagagaagttgagaatactggaaccttttaaaaattgcagcataatgtcttggagtgatttgttaaatattggcttaaactagtaggattttccttttttctttttctttttttgagacaagttctcgatctacacataggctggaatgcagtggtgttggtgtgataagggtcagtgcagtctcaacctcctgggctcaagtgatcctcctgcctcagccttttgagtagctgggaccacaggtgtgtgccactgtacctggctaatttttgtagtttttgtagagctgtagtctcaccacgttgctcaggctggtctcaaactcctcggttcaagtgatcctcctgccttggcttctcaaggtgttaggattacaagcgtgagccaccgtgcccagccaactaataggattttcagtagtcaaattgtagcattttccttagtctttggctctgtaagattatcatgttacattggaaaatctttctttgaccacaaaatttaaaatgaaactggatttgagttagctagtactccttcagtaaattgtatgtatttcctcttaagtaatttgcttcttccaattgtttcatctttatcattcattctctttcctcagtcctttattcgctgctgaggggaagcaatgaagaatttcctttgactctgcccagttttttatggacacaaacaaaccatttttttttttaaagaggcaggtattaattcaaaggaaatgtaatatattttttaaacctagtggcgggggtgccagttaaggaacttgtaagtaaaagttgaactttggagccaaaacgattgttgggactcatcatcttcataatgaaagtctttgcaattataatttcatttggcaaagatgaagttgtacccttgggagatgccttgccaaatctttatccataattctgaattgattccagccagactttgttatcggaaaactacttcatatcctttccttatggtgtgtgcccttaacctcaagaattcagtttgtgaacactgaaactgttcacagaaagtgtttggagaagagcgccctttaaaaattagtcattaaggtataatgccatatgggctcaaggggtggcagagatgctgagtggcttcttgttcgttaagactgaaatatttatatgagcagtaataataacagcatatttcagagtctgtgtggtatgaaattgagcagcgatgcaattagataatattgacagcccctattgtaattatgtaaatagtagtaagttcagctctccttttatctttcatttccatgtgcacatgtaaggagaaggctagaaaatatataaatgttgggcaggagtgcttggctatttatttataggacagagtagcctgaagcttgtgttcccctgagttattttttttttcttcgaaattaagcaagtccagtgggttcccagaggggacatgcaaatgcttagtgttaaagcatccacttgaggatcctgacaacgtcataggtccattctgagtacttttcttttggagttgtgtgttgggatcctacttgactaataccaatactttttttttttttttaacctttcaaacagataatttaaagttgttctccatagagatgttttctatgtctagctgcctatcaatctttccatctcaatgcagaagtatttgattagtgtatttaaagtaataaagatgccaacagtagtgtcaccttgattgatgctaattataagtctttaatggttcctctgcttcggccactgtctctgcagattgtgatttttatggttaaaatagtgccctgctgtccaaaggcttaatcataaattctggtctccctttctttaatgattttgcatgcagtggtataatcccagtaacatacattatcttcgttaaaagcaagcagtgactttcataggggcgattaatgcatttataaggagcttgaggaatcctcgttgggatcatagcagaggttacgatgattgtgcttcctgggcattagaattagcagcaatgttgcatagactgtctgaaaataattgaagattttgatgcagtccctatttagcacactaatgttgtaaatgagactataactgcaatggtaaaaaggcaggatttgtaacctgaagatgctatcagtatgtggctgtcagaccagtgaaatgaaaagcaagttaaattatatgagggctttccttctttagaacagtcttaaacagatttggggtcactcagtttgaaatatctgttgatgaaaatatctcttatcctgaagtttttcaggctgaattttcacagtgttaatatatgtttagtctttaatctccttactcaagtccacagatacagttttaaataagaagaaatgtgcctagtaatacacacatttatgggactttcaaggtatggataatttgcttatgtaaatatatgcccatatacactacacatactaatacttctctgaaatgacatatcttattgcagacaagcttgacataaattaaatcgatgctttgctatcttgtaagagcagtttactttcacatcaattacaatgcatagcttcttgcatgtagcgggtattttaaaatagtgctttaatgctcttattgaaaaaaccttgataattaaaaaaattgttttttaaaagcacattaatactggcatacattaatattattatgtacctattttctcctatttaattttactatattctatgcttacaaactaagctagatggaactataataaaatgttaggtgtttatatcatattgctttccactagttattcagttctaatgataatatcatactataatatcctctgttagtgctaaccactgacatctagacaaaattgttaacttctagtaaggagaagatacttttaaaatttttgaaccatttacattttcaaagaagggaatgctaaattgctttataggaaggtagttatttcccaagtggttccggcttatagggagaaaccacagacctcagaagccaagcttgaaagagtattcctcttgaaatagcatctattccacatttctgggggtagctgtagttaataattctggatgataagcaaaagtctacccaatatttatttttttggtggaaatttgaggagatatgcccagctgcatagtggttattagaaaatgcctcaatttacaagccttatattgagaaacttgtgacatctactttgggtatttacaataatgacttacttgcaaagtcttttattttgccatagtatagtttaaggtgattgtttgaaatgttaatgttcagatgttctgaggtgctcttttaggtaatggttatcatcggtgagccattggacatcttttcaccagagtgataatacggaaaacatgtacacagaatgtaacctctcccacagggaacgtttatcttctagagcgtcactcagacattctaaacatgggcagaccagaaggcggtgttagaaagcttgcgatggatgaggagggctgggattaaatgaactaggattgactgcggaagaagactggtatgggagcctatgggattattactggggatctgtatggtaattaatcccatatgaagacaatacctaccctccaatctgtttgtctactcattccaccattgtcgtgctctactgattatcaatagtgtcattagaaaaaccagagaaagactcttctgtgggtgtcaacagtcagcagaggtctgactaagcattcgaatgacatcttgtgtgattctacaatgagagttgcaaactgcttgatcagaggaggtgtgagctgcattgtttagtctgtcttgctgtgtgataattttcttttgtagttttgataaattaacattggcttatgtattcagcaatattcaacaggaatcttttttttctaagcccccgggcttgtgtttaaaaatgcaggttagttctcagaggctttcaaagcatttctgcatcatgctactaattaagataaggttatcattttaagttataccaggaatgcaattagagcttctagtgagaactgtagcaatcaattttctacaaattatgcagacctggtaaggtagaatacagttttaataggacaagtgaacatacagtgatttattagatataatgtgaattcaaaagacacctggacacagcatctgtaacacatcgtgtagcccaagtcactgggactctagttcaacagcccttcagtgggagagatttaataatatgccttccattctccattgttcagtgactgttattttggattttgagagggatttttgtttttcagtttgaatggttttagacatgagaaaggatacaaagcgcagatgagtgaggcccctcgtttatctagactgacccactgcggagctgtgggtcagtcctacctgtcattccttttacttttgtgggacccacagagtccaggtgactagctgacagtgtaattaactaatttttctacactgtccatctctgctaagagtatttggtgttggataagaaacttacatgccttatctgccaactgtcggtaattacttattcattgaatggatacctgttttctaaggatgtacgaggactgcaaggttgaatagctcccgaggaggctgtagatcttttcttcctaggatcactgcaggtcttctggagctctccattaggtcataaattacagtacttctgggcttccttttcttaaacctcttaaaaatatctggaacaccttttacttctccctggttgacttttattccatttgacctatcagcttgttctacatttttccatgcacctaaattcctcaaattgcagttgttcattcaatgtatatctagagattttccgttgtgtgccatgcattgtgctaggtattggacacatcgtggtgaaaaaggatacttgtgctaatatctgtaacatatgcctgcctttcccacctccaccattaagcacgtaacatcccttcccagcacttgtgaccttgccttgtaatttacagagaagataaatatcctctagtacaatctcctctatcttctcctttcttccatatctgccattatctgcagctgaaaggtgttttctttctgttccgtctcatagaaagtgtcacatctcctccattaaattgccatgattaagataaattttctttaatgtttctatgcattaatttttccaataatttctctttttgcgataatttttcttttcttttcttttctttcctgcataatttttttctactttatctcaatctttcttactcttctgctatttccctttggccaacaagcaggctcacattttagctcaaccctatccagaaacaaaaagtaaaaaatctgttatcttacctgttactcattcaaacttcctagttgctagtttcttcaaagtgtgcctacacaaattctgatttttcttcttcatgtctcttattacaacagtctggcttctggaccagcaaatctctagaccaaaacacaccagtggccaaagtttacttctcacttcacttagcctcgtactaacatttgttattgctgcgtctttcctacttctgaaaatcggcagctgtcttcaatctatggtgtcatttcttcgtcctcaatttcttaggctgagttgtcctttttttgctaacccttttggtgacaatgtccctcagggtttcaactttagtattcttctttacttactctgtgtgaggaggttcttaaaacaagaggcttcaaaggtgaactgtgaatgccctaaaatcatatgctaacatatatggtgtgggtacctacatttttctgagaaaagggtttgtagctttcatgtgattctcaacaggtgccaaagaccaagctacagctgaaacctcattctttgaatggtggcatcctcttccatggtgtcctgctccaaactctcacctgcgtttgtgctgtattctatctcaggctgacacattgctgttgacctaagttcttaaagaatcttccagtgtgttctgtttccacactcagttttatgccaaattctttccattatgattcagaaatataattagtctgtcatggttttgtcttagttagattccctgtcacctatttcttaccatcctggtccaatctgcacaatatctccagaaatatcttttgatgtatcctaaaattaaaaagcctgctcctaggattttccctcacttactattcttcagtacattctttccctcctcctctacaggtcaggttccaggtgagaaatcacttgaattataaaagtcttcaatataattctccttacttatatcactcttcctcaacttatgaacactttgaaccctttgcaattagccaagagaaaactcccccttcaccctttaaaggtttgcttaaaaatcaactgacaaaagacagattaataggagaagaggcatacacgtttattaacatgcactggagtcttaacaaaatataagaactcaaagaaatggccagatggttgaccttttttttttctttttctttttctttttctttttctttttcttttttttttttttagatagggtctccctctgttacctcggctggagtgcagtggtgctatcttggctccctgcggtcttgaccttctggactcaggtgaacctcctacctcagcctcctgagtagctggcaccacaggctcacatgactacacccaaatagtttttaaaaaattattatttgggccaggaacggtggcttacagctataatcccagcactttgggaggccgaggtgggcagatcacttgaggttgggagttcgagaccagcctggccaacatagtgaaaccccgttactactaaaaatacaaaaaaggtagctgggcatggcggcatgtgcctgtggtccccaggtatttgggaggctgaggtgggaggatcacttgaacccagaaggcgaaggttccagtgagctgagattgcgccactgaactccagtctgggcaacagagtgagactctgactaaatatatgtgtgtgtgtgtgtgtgtgtgtgtgtgtgtgtgtgtgtgtatatatatatatatatatataaataaataatttgtagagacagggcctcactaggttgcccatgctggtctcaaactcctgggctcaagcagtcttcctgccttggtctcccaatgtgctgggattacaggcatgaaccactgtgcctgtactggttgacactgtctttttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgtcctcgtgatcctcccgcctcggcctcccaaagtgctgggattacaggcgtgagccaccgcgcccggcctacactgtcttttcttttttttcttttatttttttttgagatggagtctcacactgttgcccgggctggagtgcaatggcacgatctcggctcactgcagcctccacctcccaggttcaagcaattctcctgcctcagcctcctgagtagctgggattacaggcacccatcaccacgtccagctaattttttgtatttttagtagagacagggttttgctatgttggccaggctggtctggaactcctgacctcatgctccacccgcctcggcctcccaaagtgctggcattacaggagtgagccactgcgcctagcctggttgacactttcataccatcttgaggttacagaaagaatgaaaactttgattacagcaaaacaggttatgagagggcaagaagagcaggcctggctagcaagggtggtcttcttatgtagatgaaacctcacaggtagcagccctcagagagaatagatggtaaatgtttctttagacttataaggtgtcagactctcaggtcatgtttcctaactctgcacaagggagaggctcagagaaaaagcatggatgcatccctgccaattttctctgcagatgtaaatctcccctacagaagacagcttttcggctgttcttatatttctagcccttctgaatagccatcttgaaatatgtcaaagaagtatgttttggggtgaaatattttggtttccttcacatttcgccagatgtgttatgctgcggttttctctccctgaaaggaacccctcttgtcttgaatctacatagatgtttcctatttatctcccacagtccagcagagccattaccctggtcccagccagcgttcagcatggcttccctcttgtccataactctgttgttgcattgacaactattcaatatcctcactttgttcctatctctctctccaacaatatgagaggccagggaatttgcagcaaatttttgttatctgagtctccttagcacttcaagaagtgcatgttgacagatcacacactctgaacttcaattggacatttatttagatataaatggcattttagatcattttttggatcaaacaaacacatcaactttttcagatttgctttctgagtgagactccaacagctgtggttaaaacagcagttgccatccctgaaattctccgcatagtgtagtctacataaatgtgcatcatatgtaatgtatattgttatacatgtaatatatgtgtatatgtatgtatatatatgtgtgtatatgtgtatatatgtatatatgtgtgtatatatatgtgtatgtatatgcatatatgtgtatatatgtatatatgtgtatatatgtgtgtgtatatatgtatatgcgtgtgtatatatgtatatatatgtgtatatatgtatatatgtgtgtatatatgtgtgtgtatgtatgtatatatgtgtatatatatgtgtatatatatatgtgtgtgtgtgtgtgtgtgtgtgtgtgtgtatatatatatatcactcccaggctggagtgcagtggcatgatctagcagaaagtcctggatctattttatgaaacaaaacaaacagcatatataagcatataatatattttctgtgatacactttttaaagagaaggtaaatcttgagtatgttgacaacagctctgggatagttgatgtgtgacttcagtggtaatttggtattttgcgacttttgagcaactttgtgcaaggagagatctctcccactccccccttccatggttcttattctccttcttgcccatggttaaggcaacatcagaccaaagcaactgatatctctgtgccttaaatttcacagtgtcacatattaataaaagtgatggatatttttctcttttctgagagtttgttagatttgttaaggtaatttattaacaagatgtatcctagggaaatacattttttcacctatcactatcttagtaacattttttgctaatgaggaaactaggtcacagagaagttaaattactttccatggagtttttgtcagagaaccattaagtgtgatatcattaaaagttacagcaaatttattctagaaaaaaatgtagtgcttaatcatctgtattagtactttatccttaagtcaacctggtaaatagtttctagatacagtacaaagttagagtacaataccttctgatccattgagccctcttccatctttccttctgctctctgtatcatttttttttttttttcctgaggtggagtcttgctctgtcgcccaggctggagtgcagtggtgtgatctcagctcactgcaacctctgcctcctgggttcaagcgcttctcctgcctcagcctcccaagtagctgggactacaggcatccaccactgcgcccggctaattttttttttttctttgtaattttagtagagatggggtttcaccatgttggccaggctggtcttgaactcctggcctcaagtgatccacctgccttggcctcccaaagtgctgggattacaggcatgagccaccgcacccagcggctctcttcatcttatgtagagaaaaataacacagagattcttattcatatttttatgaaaaatttaaaaaggaaacaaagatttttgtaaaaggagtaggtatagaaagagttaattttctttctgacacttcttaacatatgaaaggaattaattatttggctgttaggtagattaattaggtgatggacattctggtttttgttgttgctgttggtatcttttctgaatacctaaacacttctttggccaggcgcggtggctcacgcctgtaatcccagcactttgggaggccgaggtgggcggatcacctgaggtcaggagttcaagaccagcctggccaacgtggtgaaaccccatctctactaaaaatgcaaaaattagctgggtgttgtggcggccgcctgtaataccggctaccggggatgctgaggtaggagaattgcttgcaaccaggagacagaggttgtagtgagccgagatcacaccactgcactccagcctgggcgacagagcgagattccatatcaaaacaaacaaacaaacaaaaagacttcttttcccttttaaatgctttaatatttgggtttgaatagacagaatttgaatcaaagccattctcttttacctggcacttttgttttgtttttgtttttgtttttgagacagggtcctgctctgtcacccaggctggagtgcaatggtgcaatcacatcttactgcagccttgacctccttggctcaggtgatcctcccacctcagcctcctgggtagctggaactataggcatgtgccaccatgcctggttaattttttgttgttgtcgttgagacagggtttcactatgttgcccaggctggtcttgaactcctggactcaagtgattcacctgcctcagcctcaggctcccaaagtgctgagattacaggcatgagccactgcactggccttacctggaactttttcttcaaacttcccttcagcctacaaagagtcgtgttacaaaacctctgaatccaaattctgcctccttaccttgtcatgtcttggcatgagtctatgcattagtctcagactgatttgattcatgttagttgtggccacctcatatgtattttcttgtgtacaagaatggagcctagttttataaatgtgataaaatgcactggattttttttttcttttttctggaaggaattttgaaagcttgaactgttgtctcctggagtatgttagagtataggaatgtctcgagatacctgactttgtccatgaacttctgcatatccttgattatcaaatatcacacaccacaactgaaagtatgttttatgatcattcattaatcctctccattgcaaaggctgagtggcacatttaagaggttggggaacatgaactgatgggcacactccttttaacattgcttcattataaggcagattgattagggcccctgctactgtcctgaaaattgtacatgtcctctgggtccaaattactgttactcctgtttcactctgatttttttgatgacttttagtacctcctaggtttttattcaagatctcatgtgaactttctgtatcttatcctttctgcctttgtgatgctaccaattagattatagatagaacatcacatctgcttggtgcatcccagaatgggccctatatacattaattatccacttttctgcccctgttcaatcctgatttagcaatagcaatcttatcagattgaagcttgctgctttaagcaatatctttgcaggatattttcttttgggtcttgatttctatagatgagtctaaaggttctaccaccggcattagctctctgaaggcatttaaacaatgttgttagtctgtgggcatgatgagaacgtataccttactaccatagacattagattggcctgttaagagtcaacttgcataaatctgcacaaagtgatttatcatgagtaattgttaactcaaaattttctataaatagagactcaagagattacagaacccatagatgctaatcaaggtggactctgggaaaaatctgagaggcaggactggaaagtggttatcatttgctaatcagaaacattatcggagtattgtatcctgttttgaaaagggctatacaaatataaccaggttagcaactaagaaaatgtagaaaaggaaagtcacaaaggcaaatactgttgatgttcatgtaagcaaagtctggtggagaggaagtcttgaataaaagacttgaaccttaccagcaaaactactgataaatttagcatctattgtgccaggcatatgctaaaaactttatctgcactattctcataacttcttaaaaggacttttgacctactgttgcatttttttctttccaacttttgttttaggttcagggatccatgtgcaggtttgttacatgggtgaattacggtcactggagtttggtgtacagattattttgtcacccagttaataaccatagtacccaaaggtggtttttcgatcctcacgctccaccctcaaataggccctggtgtctattgttcccctctttgtgtccatgtgtactcactatttagctcccacatctaagtgagaacatgtggtatttagttttcttttcctgcattaatttgcctagggtaatggcctccagctgtatccatgttgctgcaaaggacatgatttcattatttttatggttgcatagtatgccatggtgtatatgtactgcattttctttatccagtccactgttgatgggcatttaggttgattccgtgtctttgcttttgtgaacattcctgcagtgaacgtatgtgtgcatgtgtcttcatggtagaacatgttatgttcctttgggtatatacccagtaatgggattgctgggtcaaatggtagttctgttttaagttctttgagaaatcttcaaactgctttccacaatggctgaactaatttacattcccaccagcagtgtataagtgctctttttcctctgcaacctcaccagcatctgttattttttgcctttttaaaaatagccattctgattggtgtgagacagtatcttgtggttttgatttacttttctataatgtttagtgatgttgagcatttttccatatgtttgttggttgcgtgtatgtcttcttttgataagtgcctgttcatgtcctttgcccattttttaatggtattgttttttgcttgttaatttgtttacattccttatagatccaggatgttagatctttgttgggtgcatggcttgcaaatattttctctcattctgtaggtagtctgtttactctcttgataatttattttgttgtgtagaattaggtcctgtttgtcaatttttgtttttgtcacaattgcttttggagtctttaaaatgaaatctttgtcatggcctatgtcctgaatgtatttcctttatctttttctagggtttttatagttttaggttttacatttaagtctttaatccatcttgagttgatttttgtacatagtgtaaggaaggggtctagtttcaatcttctgcatatggctagccaattatcccagcaccattttttgaatagagtcctttccccattgcttgtttttgtcagctttgttaaagattagatggttgtaagtgtgcagctttatttttgggttctctgacctgttccattggtctatgtgtctggttttttttgtttgtttgttttacaaataccatgctgttttggttattgtagtgtatagtatagtttgaagttggatagtataatgcctctggctttgttctttttgcttaggattgctttggctattcagcctcttttttggttctgcataacttttagaatagtttttttttctatttctttgaaaaatgttgttgatagtttgataggaatagtgtagaatctgtaaattgctttgggcaatatggccattttaataatattgattctattcttgatcatggaatgttttccatttgcttctatcatctctgatttctttcagcagcattttataattcttgctgtagagatttttcacctccttggttagctgtattcctaggtttttttttttctttttttcttaatggatattgtgaatgacattgcattctcgatttgacttggacattgttgatgttgatgtattgaaatgcttctgattttgtacattgattttgtaccctgaaactttgctgatttattagatcaaggaatcaatgagctttttggcagggactgtggcgtttcctaggtataaaatcatatcatctgtgaagagagatagtttgattgcctctcttcctatttggatgccttctgtttctttctcttgcctgattgctctggctacgacttccagtaccatgttgaagaggagtggtgagagtgggcatccttgtcttgttctgattcttaagaggaatgcttccagcctttgcccattcagtatgatgttggctgtggtttgtcatatatggctcttattattttgaggtatgttccttcaatgcctagtttgctgagggtttttaacatgaagagatattgtattttaccaaaagacttccctgcatctattgagatgatcatgtggttttaaattctatttatgtgataaatcacattgattggtttgcatatgttgaagcaaccatgcctcccaggaatacctacttgattgtggtggattagcattttgatgtggtgctggatttagtatgcgagcattttgttgagaatttctgcatccatgttaatcagggatattgacctgaagtttcttttttttgttgtgtttctaccaggttttagtatcagaatgacactggcctcattgaatgtgttagggaggaggattccctcctcctcaattttttagaatctactgttgtgttttgaactgtcagggattcgttctaataaatttcttattaccaagtaattcagttataaagctgggatttgaaccaaggttttagggttccaaagactacagtctcactaactgtgctatataattttcttgtaccaagactatttgctataagtaaaataaacttcttatactccttgaagtacccacttaacacatagagtcatacagccatcaagataatcaaatctctcctgccactttgaaaacaatccctatattcctactctaagtacctggaagccattgctctgtcttccgttcccacctacattttaaaaatgtatttttattttaaaattatatttacttgtgtaaacttaaggggtacaagtggaattttgttatgtgcatttattgcatggtgaagtcttggcttttagggtagccatcatctgaataatttacattctacccactaagttatttttcatcacccactctccttctgcaccccgctttctagtctctaatgtctatctttttttttttttttcatcttccccttacaagcgggaacatgcggtatctgactttctgttttggagttgtttcacttaagataatggcctctccgtccatccatgttgctccaatacatgattttattcttgttttatggctgaatagtattcaattatgtatatataccatattttctttgtccagtgttgatgaacacataggttgatcccatatcgttgctattgggaatagtgctgtgataaatataagagtgcaggtatctttttgacacaatttcttttcctctgggcagacacatggtagtgggattgctgacctgagtggtagttctatctttagttctttgagaaatctccatactgttttccacagaggttttactagtgtataagagttcccttttcttcccatcttcgccaacatctgttgttttttgactttttactaatagccattctgactaatgtaagataatatcattgtggttttaatttgcatttctctgatgattagtgatttggggcattttttttcatatgcgggtttaccatttgtatgtcttcttttaaaaaatatctattcatgtcctttgcccacttgttaatggggttgtttttgttgttgttgagttgtttgcattccttgtaaattccggatattagttttctgtcagatgcatagtttgtgaatattttctctcattctgcaggttgtctgtttgctctgttgattatttcctttgctgtgcagaaacctttttatttcattacgtctcagttttttatttttgttttttgtggcttgtgtttttgaggtcttagtcatgaattattttcttagaccagtgtccagaagagttttctctaggttttcttctggtatttttacagtttcaagtattacatttaagtttttaattcatcctgagtttattgttgtatatggtgagagatatgggcctacctacattttttaatgtaaggtttaccaatctgtggctggcttggccagggtaaaaatatgcattggtcagattaacaaaaatatctggttgaattgacagttgtacatctcattgtaaattaatagattgacattctgattagaatttctttccgtgttgtttgcttagtaggagagaattaattgacaggtgtgtgtctgcttaaaaatactcttttgtataaaataataaaatggcatatgcatatgtttttatatttgtaggagggatgaatatgatcatggatataaaagtataactaaatattagactacaatgccttctttaattatgattcaaatttatattgataaaaatacttattggtgaccaaaatcagaagcaaatatccaaaatcggattgagtttcagattgggttttgatatggttaggcttcgtgtccctatccaaatctcatcttgaattgtaatccccataatccccgcgtatcaagggacagaccaagtggaagtaattgaagcatactgatagtgagtgagttctcacgagatctgatggttttataaggggctcttccaccttcacttggcacttctccttcctgccaccttgtgaagaagatacctgcttcccctttgccttccatcatgattgtaaatttcctgagacctccccagccatgctgaactgtgagtcaattaaacctctttcctttataaattacttaggcttgggtagctctttatagcagtgtaaaaacggactaatacaggtttgtttcagtaaatgttttgaacacaagttgttcaaccaatgactgtttattgaacatcttcatcaggctagaaactggttgaagaggtggggcattggatggagtgaaaaacattcttagctgagaaaaacagcaagtgcgatgtgtccgaagtgagaggaacgtggcatatggagtcatgaaggaaggcagggatagccaaagagaaataaggaaaccaatgggtatgagagcagagtggagcataggcagggcttggatctattactggtttctgtgacatgtgttatgaagagtatcatttcactgactggctctgcccaaatatgtttgaccatatttacatcccatctctctcactctggactgctgaagaagcttacactatcaacgtactcctttttttttttttttttttttttgagacggagttttgttcttgtcgcccaggctggaatgcaatggtgcgatctcagctcactgcaatcgatgtacttctctcatgtgtactcaactattccctctcaaatgaatcctttccattgactttcagacttgaatacagctctcccatctcacctgtaaacaaacagctcctccctgactcctttagctccctgcaggtattgctttctttcctactctttatagcgagatgtgctgaaagcacttccctgtcttcactttcttgccttccatgcacccttctctaatttagcttccagcttcatcaaaacaacttttacttgcaatgactgactgttgtccatcccatagtcctcttcttagtaaacttaacagcattaaataaaaactgtcttcttctggagcaccaacttcccttggcttccaggatagcccagcctcctcctccttcaggtctggtgatatactctcagtcttgtctgccaggaatcagttactaatactggcaacgtcaaaatccctcttcttttttaccccctaccgtctccaaagttggtttcaacgcccttccttggcttgctatgagaatgacataggctagttataggatctgctcatttaataattgtgaggatataatgagttcatatatggaaagtacttaaagtaatgccaggcaaatgatagttgccccttgagtcgatagctgtagttacaatttgtggatgaaacctgaatgacatcagtccatacctatgtattcagtggcctataactatctccatattcaactctaaaggcacatcaaactcagtgtatccaagaccaaatgtatgtcattcttgtgcttcatcctgacaaaaataaacctggtctctcctagtgtgtcctgcttcaatgagtggtccaaccattctgtcatttgcacaagccagcaaagtaatttggcccactaaatttctatgaaaagcttccatttctcaacattccctctgccagcacaatagccagagataccatcatctctcttctgagttctataaaaagagattgccttgttttcattctgtcgactcatcaccccctataagttctccccccaacccccattgccagaatgcttatttcagaagaccaccctgagcccccctttgcttccagcctttccatggcttcccgtgactctcaggataatgaccaaaatccttcacatggtttgccaagcccagcctctgaggactgtcccacacatctcccatcccacctcctgctgttctctccactccagctgtgcatgtcactttcagctgctcacacacactttactctccctgaccagaggatttgtacatgcaattcatcatgctggaaagctctctccacctttataagcaatgtcttatgcatccattatcacagctcaaacctctctttttcggggaagactttcttgacctcctagtctacttcaggttactatgttataaactcccacaaactatattcttcttctttagaatatgtacctcattttttaattgtagtattgtgttggggatccccaagataattctcaggctcagtgatttgctggaaagactcacaggacccaaaaaagctgttatactcatggttaaagtttattacattgaaaggatacagaaaaaactcagcgaagtgaaaaggtggatagcgtggagtagaggagaaattaagcaccagcttccagttgtcctctcccagtgccattacatggagtacacttaattttctcagcaacaacgtgtgacaacatatgtaaagtgttgccaaccaacgaaactcacttgaggcatgtgtccagggtttttactggaggtcagtcatgtaggcatgcagcaccttagctaccagtcttcaggcctcagatcaaattggtacagcatgatccaaagcctcaggcatacaaaaacaggtgtttgccataaatcacactgttggcataaactcctatctcagccaagggctcagaagtaatcttcccaggagccaggccaagaccagtcttgagactctgggaatacgcaaggtttgagcagcccaggcctgttgacgtaaccctttcctgcacaagtgtcaatagtgccattctttgattaatgtctctcttcctgcagactacatgaaagcaaaatttgtaactgtgtaggtaatatacctaatcttcagcacagctgctgataattggaggtactctgtaaatttttgttgaataaatgaatgaataaaatcttctgattgtctttatctccttctagtctatactgtgttctatacctttctgccctatagctttcagacacttctttataatggagtcttgtcatgcattttatacgtaaagttacttttgtgttaatgagtaatatgtagtaagtacttaaaatatttattttattactctaattcccaattatatccctatacctccaggcattattctgtctacatattaaactttaaactggcaaatgtttttcacaattatacttgaaatatatgtataattatgaaaaacatttatatatcagattatatgataccacataatctgattatatatcacatatatcagattatgtgatatcatataatctgatatgtttttcacgattatatatataatatcagtgtatcagattatgtgatgcctacttataagcaccaaagttatttctaagagaatgagttaatgatccaacatctgccttaagaattctagtaaacaaattatgcttaactttgaagctactgactatatatattgaattttatcctggatatattagaaatataggaagaaagtttcctggaatgaggaggtatatccccattttctctgtgagatggaagagcaaatatgtcctgatgatccgtagtttcttaaccttcaaagtccacatgacgtcacagtgctttgctccatccagaatctctgtttagccaaggtcaagaggtgtcaggcccattttagcaacgaatttgaatgcatctccattaaaaatttctttattgtgttagtattggattataacccaaagtataaaagaaatacccatgagtccatactgatataaaaaaagatcaaataaataaataactgggagagtgagatgattttcctatgcagaagaatgccaaacaaattatgtagattttctgcttacaaatgggtggagcataacttcccactccttaaatttgggatgcatatagtgactttcttccaaagagtacagtacagaaaagtgggtgatgagaagagtaactttacagtgaagaaacatgacaaacactaccacagccaggcaatcaaagttcacatcaatagtataaggcatgctgatggtatgtacctttaatataatttggtgagaatggtacttcacctctgtggtcttcctccccaaaacccataaccccagtcaaaccctaagaaaaacatcagccaaactcaaatttagggcattctgcaaaaataactgactgactagtactccctcaaactgtcagggtcaccaaaaacaaggaaagtctaagaaactcacagccaagaggtacctaaaatgacaaataaattcaatgtggtggcccggatgggatcctggaacaaagaaaaagaatgttagctaaaaactaaggaaatctaaataaatgtataggctttagttaataatactctattgaatattcattagttgtgacaaatatgagaggttagtaataggaaaaaaatgggaactctgtgtatctttgaaatttttctgtatatctgaactattctaaaattttagtaccactaaaggtttttattacataatagtgttttaatttaatctccatgctatttaatgaaatttaccagttgtatttgtgtttgattagacattatctcaagttgattggaattactcatatttcttaatgccattgttgcagctgtaataaggttgacttttctacaatagacacagaaatcattacatcaccatttaatttttgaaaaataatccgatcccctgtgattataaacttgagattctttaagaaagtagaaaggttgtaagatattatgagtcataggatatttccagttttgaagtaataagacaaaaatcattaactaaacaaattggcattaaaaaaaaacagtatttttgagaggaccagtccagacaatgtgtctgtaagatagactttacaaacttagtttgattaatttttgtttttccgaggatatgattcttttctataattactgttctgtttttttctgacaggctatcaaatattggctgccttaagctctctgtgaactgagttattctcaataatactctgtattatgaaggcattatttgagtggctgtccactgtgatctggttatttggagctttacataaaacaggtggttcttgcatctcattgacatttcttattatccagaattcaccatcctttttctatggctcatcatatgcaggccatcacagacagggccctatcctatggtttgcccgagtttatttggtttttcatttacattgtggtcttttctcttagatactccaagtttgcatgtttttggactttatcaaggctcttgctatatggttatgtgtttatttacactgggaataattcccaaaaggctttgcaatagctaattgtatttgtttggctctgtgagatgacccaggcacctccgattccaatcagaggggccacttactttgagtggacatgaggctgatgcccagaaccaaagaggaagcagcctctgatccatgatcctatagtcacagtgctgctcaatcgtgccgtttctgctgacccaaatgcctggagttgaccctgtttgtctctccaaacctctttactggttttccttgacttagatgatgctttgaacttgatctgttgtactatgactgtaattccaagagcacaggctttcccgtcatgtagagcaatatccaaatcctgcctcaatcgtttgttaccttttgatcttgaggatgttacttcatctctgtgggtttcagtttcttcatctgtcaaaggagaataacagcacactggcagagttgttataacaattagataaaatgtttctaaaactcctttagaaagcctggttctgtatcatggacactaactatgaggcctgagcagattcaagagagggatctgcctttgatatggttttgggtgttaggggtcaggtgggagaagagaaaaagaaggaagagatacaaggcagagtaatggactctggggcaagaattgtggagcctcactacctgaatatgcagcctggctctcccatgtgttagctgtgtggccttcgtggttattgaacttctctgttgctgcacttttctcatctataaaatggagattgaaatagtgcctaactcagtaaatgcgaagtgctcagagcagtacctaacatgtagtactaattgtccagtattagtagatttactcttttcccagggttttacactttacatttaactacacctgataatccgcttactgatcaatacgtctttttgcagcctcagtaacctaaaagtattaagatcattttggcctttttagtatactcgtataaacaaaagtttctcctttcaaagaagtcatatgaagaggtgctacatttatgtcactacatcaacatatttgaataattatttttaaattttccttagattctgaaaaaagagattcttttcagtatcctcagtaataacaaatctttgtccttgaatacagagtatcaaaaattaagccaactctattaagataagttatctatgcagatactatcttctatatgtataattttgcatacttgtacagttagatatactttataactttataatctcaataaaacatacacatatctatttatatataaactgtgagtgagtgagtgtgtgtgtgtttgtgtgttttgggaaagggagtatcaggaaccagtgtttaatgtaagctgaactattttcatgaacataaattcaatcattgagtcacagctcatatgaaaaaaatcacatgtgatttattgcatgtttcagagcttttaaaataaagcctaattagatttttgaccttatgggatgaattctacataaagcatgcattgagtctaatggagtaaaaaatgaacatcttttctttccagttctgccgtccttttcctcccttccatatacctacatcctatagacaccataatactatagcactgatcttggaggaacctgcagaaaaggccatcaaatgcagtgggggcggagggggtgctgtacttcaataagacactcaatctaaccttgggcataagcgtgcctcctctttgcctgagaaagctttactgctttagcagccagtgatatatctgtatgcatttggcatcctgaacgtggccactttaattattttaaggtttcctctaaaagtctgccttgctacttgaatggagatgtggtcatttgtgctaattgcattttagaatctctattttattggttacaataagctaatgtttacaacttttgttcatatcaaatgccattgggcacttaattatgtaacaatttgctacctaggtatattttgcaaacatcaaaaggcaccagtccatctccacatcactatgtctgtactatgtgtgcatcatatagctgtggctttttttttcaggctcattgaagtgctgcattcccactgctactgaagcccagggtcttggcttgagagccctctgcctgatgcccagaaagggatttgagactgagacaatattgttgcactagggtctttgccatgaagcttttaagaatgagagaaactaagatacaatatgacttgtggatctccaggatcatacgctgcttggatagcttacttgttgaaagcaggggatcttcaaaagccaaaaaacatgcctcctttctgacatatgggcagagagcctagacactcagagacctcttctattttacagaagatggcgctgaggtcaggatggtgaaggaacatgcacagagaaaggctgggccaaaactgggcccagattttgagaaaatgaagcccactgttccaatttttattttatttcttttgatctaagagaaaaactgcatagtctagtaatatacttagtaaaaagaccaactattgtactctgtgaagttaatgttatgagggttggatgtgtcttagaatctgatcatggagttaattttactgtattgcaagattttaagatgagctggtgttctcttgttatgcccatatgccatcattccctcccccctcacccagaatgtgaatagtattcccattgtgggaactgctgattgacatcaaggcactctgttgtcatggctctagtttaaaaatgtgaaagaaactagatcttttcaacctaaaggttctctctgtatagttaattaaagacattttaagaagacatttggattataggaaagtgatgatatcacgttatgacatttattccttaccccaagaatctcagtaattggttcacctattcaaaactgttattttatcagagggtaaagattccaggacccccagtcagacttatctaatttccctaattggcatattaaaaaaaaaactctggacacaagaactttctgatttgtgaatatgccattcactcacttaagacaaaatttaatgtaaaacttatctaatgttaatgaaagtctatagaaaattttagccggggcttaaccactggctaatatacaatttatttcattgtattaaagaatagatttacaaatttcattagaattccacagaaatataaactattagaatgcggtacagcgcagggtgtgtattgagattctcactttacaatgaaggaaactatagcttggaaaaagataaaatgacctttctataattatataacagataaacatatagtccatagcaatatagataccagatcccacagcttttgacttctagtccagtatttttcctactaggccagggtattttatgtaatcagagttattttattctatgcagtgctgttgtgatagatgaaaaacagaaggtgtactcaatgccttctaagaacttctgctctcataagtctcatatcttaccatggatagatatgtgtatttacaggtttatctatgactccttcaagaataacttactactacttctttcctttaaaacaatttttttttttctttgagacagggtctcactctgtcacctagcctggagtgcagtggtgcaatcatggctctctgcaacctccgcctcccaggctcaagtgatcctcccacactcaggtgatcctcccacctcagcctcctgaatagctgggaccacaggcacacaccaccatgcctggctaatttttgtgtttttgtagagacggggtttcagcatgttgctaaggctagtgtcaaactcctgagctcaagttatctgcccccggcctcccaaagtgctgggcttacagacatgagccactatgcctggcttaaaaatgttttaaaatatacctaaaatctgatcagatgtggtaaccaaaaccaataacaaaacaaaaccagtcaaattaatgcacaaagacattgtctgaagatggtagaaatgtgatttaggtgaaactgtatgaataaaggcacaggtgagcccagtaagagtcaccaacatgaggtacccactaggaaagcaagtgcaggttagtctgcactaaatgaaatgtgatcagtttgaatgatggaagtaataggactattttgctttgtgtagccacatgatgggaccttgtgttatgttttgtgtgacacatcattcaaagcactaccgatcaactggaatgtattcctaggctcagaaattgaatgttgaatagacttgaagtcacagagtaatgtctaaagaagttgcagatattttgtgtagagaaggaaaatctggatgggggatgatagatgccctccagtaactgaggaaccatcatggggaagtcacactagattgagctcccaaatcaagggctaataaacagaagctccagtgaggctcctactgtcatagaataggacattttggctcagaggtttttcttttcttttcttttctttttttttttttgagacagagtcccactctgtcacccaggctggagtgcagtagcgtgatcttggctcactgcaacctccgcctcctgggttcaagtgattctcatgcctcggcctcttgaatagctggaattacaggcgcatgccagcacgcctggctaatttttgtatttttagtagcgacagggttttaccatgttggccaggctggtctcaaactcctgacctcaggtgatctgctcgtcttggcctcccaaagtgctgggatttcaggcatgagccaccgcgcccggccttagctcagggttttaaatactgaggctgttgcattcaaaagatggaatggcttgtctgtctcccagggcactgcgtttatagtcaccagaggtgttccccttgagcctggatgattacatggaggaggttttaaagggcagcattcacaatttagatttgcagttggaccagatgacctttaaggtgctttccagcacctggggttttatgattctatttctattatgcatctacgctgggtatgtgtcacattgtttgaagcaaacactgagaatgaacaggagcacagtgtggaatgttgatggcgctcacatctattttgtgtttcaatttctggaagcagtctttgtctttgaggcagtttggtccctgaccttctgtaacatttggagcccagccacactgtctttgtttactgtaaagagcatggaaaaaccgacttcctgacagtgctctgcaaagtctaaggtcaaaccactcacaggtgaacaaacacagttcttccaccttaaacttgccatttggtccctgtaaaatggacgagggtaataacgctggacagcagagagaggggaaatcagtcctctgccagcagccagcaattagtcactttgtcagtctgctttgggaagggctcatcttaattcagcatccattttgaagaggttagaaaccatgacatgcagttttaagtcctctagcaactctgctaaataaacctatagaccctgcctttcttgacactatcagcacatcattaatatttcccaggattgcacagataaagcatagcattcttattcacttaaaggattgaagagtcacattcactgaatattcacatcatgcaagccatttctgctatggtaagatctctaaggtgggttggctccctgtcaagagagcatacccttctttttttttttttttttttttgagacagtgtcttgctctgttgcccaggctggatggcagtggcatgatcatggctcactgcaacctctacctcctaggcgtaagtggttctcccacctcagcctcctgagtagctagtactacaggtgcacaccaaaacacccagctaatttttgtactttctttggtagagatggggttttgccatgttgcccaggctggtctcgaactcctgggctcaagcaatccacccaccttggccttccacagtgctgggattacaggagtgagccactgcacctaccctgcctcccctgctattttttgctctcatcaaatgcaatagcttccctctgtaaaaggaagggaagtgtcttcctgggtaagtgtattgtaagctctttaagggccctagacaatgcctaccacactgtcttagattagcaggtccacataatgcatttgtgtgaacatcattgaatcaaacaatgaccttgctcacacatttaccccctttactcaaaatcacttatttgtgagatccaagttttcttcttactatttaaagattattagagttgatctaaagtgatataaatgaaaatattgccaacataaattcacatttttcttttctcttggaataaattcagctttggctgtattttttttttctcttgttcttttttttttttttttttttggtctgtggtgtaagcaggctcttgaaatgccctagttatctaacactgctcttgaactccacttacagatgatatactagccttttactaaaatatatctgggtattaaaagctcaattctttactgctgatgagaaagattattaacacttttttttccccagctataatatgaggcagtaacacccctttttacttccagagccagaggcagtatgtcacattaaccttcattaactgcccaagaaatgaggtacgttcgttaatttagtattctggttagctaaaattgtgtgagaaggctgataaacgtctgtggtttctccctgtgctattaaaaaaaaaaataaaagaatgttaaagtatgttagcccgcttatcttatcatcttggtaagttcaacattctgattagggggcagatctggacaggatgagtctacagctggtgggcaaggatgggggtcgctggggcagggtagaggaaacgcagcctgactgagatcagcctgaggaagagcatctgaggcgtgtggtgggggaaatcaggtagcatctgaaaagcaagccaaaggtggaaagagaaaacaaattctgtttatatataagtaatggcatgatggaagccaacccacctaagccactcagataccctgtgaattactaaattcactgtagagatttttgttatatgtggcgtcatcacttctgatgttcccatttctaccttcatcaccttcatttattcattactttaaaaaggcatatcaagcattttgctagctactggggaaaaaaagatgaacgacacaactcctaagctcaggaacctgcgttctttcttcagctgagctttaaaaaatgtagagtcagctttaccatcacctcttctctgttttccaagaataccgcaataatgtcatttcttcataacacctccagaatccatctcaattttcctttcaccgctaccaagatttgggcaccattcccttttagccaggcaattgcagaagcctcttgattagtctccttatacccaatcccttcctcccccatcaatcttagatttggctaccggacttattatcctacaatttggttgttggtcccaatgtttatgaagagggtaatagctttatattgtggctctcctcaacctagtcccgcttctacagaactaacaccctacttgattccttcatccaccttcagacatatgcatgtattttcacctacctggtctccctcccacaatttttttcatttccaaagcaggacagcacggtggttaagaccacgcactcgggggccagatatgctttactacttacttgctgtgtagtttgggcaacttatttaacctccctcttgtgcttctgtctgtgtatcactgaaaataacttattaaaaatattttctcataaaattaagtaggttaatgtacctaaaatgcttagaatagatgctggcacatagtaagtgctaatttttagcgactgccattgctattgttgttaatacctaaatcctgccctactccctggcccgatattttatagctcactgcaaatcccagagaactcggggaacctccgcagacatttaggtagaagtgtttgttcccttttcagcccatctgtggtaccacttatctgacccacacttagcaagtggattgagacttactaattattttcatgggaaataaaacctgaagaaatgactagcaataaaagataataaatggttagtaatgattgatagaaaaaagtagcacaggctctatagagtatgttctctgagggcagggacaatgcttcgtgtgtctttgtttcttacacaatgctttatgcgttgttattaacaaaattgagcccccatttttttttctgattcaatggaggatgtgatcagaagatcattaatagaccaatctgtttaaatagacaatgaataatcagataatagattgtcttgactggtagtgtatgaacgtgaagaaataaggagccaccttggttttggacaaagggttgtctaacccatctggacagtagttctggacatcatgaatgtggtggtttggtacgattagtttggtggcaggctgccaaatggaatgaaacaaaaagagggtgaccagattggagatcattgggtgggagggtatgagaacctgagcttggactctaggaatgaatggagaagaaatcttaaatccaagggcagatggtaaagaaacaatatataggatttgggagatcatagaggatgttgaaaaggcaagggtaaaaagtgactgctggatctcttccttggttaactttggagaattcaaattgggaaaaggttgtcttgaaggacaaaagatgtgtgcagttactggaccttgagctccaagatggcagagaccatgcatctcttgctcatcattggaaccccagggtctgggaccatccttgacacacttatacagtgagaggctgaaagggcatctcaaatgaattaaaggccacttaccttgatatctacacagtccaataagacatgttgtagacaattacctcccacctgtttaatgattctccggttctagttagccggcataatcaattttgctaaaaaggtatacctctcacgtcttgggaaggacgtcccaaataggcaacttacttaattccaggatgagtgacagaatctacagaccctgaggccatctcacttgtacttgccttaatgtaactagtaaagcatacctggcagtgcagcacctccacaggaaggtgctccagaaagcaattgtttgctctcaccctgctgagaagtagcaatatccatgtggcttaagggctgtagctgcagccatgagcagtgttagaaaaatatcaccaccatttgccagcatgagatgccaaactgcaaataagagacatgtcgattcaatgaagcagaaacatttcacttgtttttaagattacttgcgagaactttattgctatgtgtttgtctgcctttaaataagaaattgcatttttaaaaaaccatctcttctcttctccctacaaagggacgaggctttcctactcgggtgaatattgcctgtgctgcttaccgaagaaagggagcagtcttggcaagcatcttattagtctaaaaataaattattcagaatgcaggttcagatacagattgcagggagagataatagaataggttttccaagcctgatcatgctatgaagacgtggtgtgtgcttttcaggaatccacttaagtggaatcagctttgactaatacatactagaaataatattgctgccatccagctagtgtctgtggtacagcatcctcagaatgtcttcaagtatccacggcctctttagtctctgtaagtgcgcatatgtaaaagtgtatatgtattcccaagcaagcttcagaggcatgcttctcattgttcttttaaggaaatgtcttcctggccgcctgagaggggcatgtctcacttgaggtttgtctccctcctgctccccctgcctgggtgaaatagttgaccacatcagcagccgactgcagtttgtcatgtggtttctcatgtgatgctgggtctgcagcacttgggagcaagagtctttgtgactggcactcatggacagacagtggtgttcagggacagaacagattttggagggggtggggaggccaataaaccaagaaacgtcagaaataaaagtcgcatgaagtactctgatctctgtatttccttttttttttttttttttttgaaatttgattttaactcttgcttttttttatggtttgtgtctgttttttccacccccgctggcgccgagctgcgctgttttgtgtttctttttttttttttttttctattttttttttttaaattctgaagccagaccgtctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggtgactgtaccagtgtccccagagaaaatcgcagcctcgcagcatggatttaaatgcatgtgcatgcatgtagagacatgaaaaaaggtttctgaccattttacacaggaagtctgtcactttgctggatcgggcttgattgcagcttgtgttttcagctccagttcaacacccatttcctgactagtgagacagcatggccaaagcagctgcatgcagaattttctttttactgtgaaagcaagccccctctgttttaactccttccagttctgaatgctctgtgctttgctaggaccgattgtggggttttgttttcttcttctacaaatccctgtaaacacagctgtattcagtaatggcaaaaaaattctatcctgtaaatagaaatctgatcaatttaatcaaaataaatgtatcccagatgactttgagaccagctggctaccacaggcttcagatgctaaatgctcagtggagatgaatacagtgttatatttacatgtttcagagtgccgggatcagcctataatttgcaaaaagaaattattttctaaagacgagaggtggtcctaccagctcacagctgatggttaggtacaggtgtaaatgctgttcatgtgatttggagatttgcagtgttgcatttcaaaaggcatgtgccatgaggcagagtatggctgttgttagtatggagaatgcttgcttctaacttgctgttatggagagccgaatgccctctgaatagcttctagtgaggttgagggcaggcacttgaggcttgttgtagattcagatgtgagagctggggttctccaaccccagctcagtggagtcagctcaaccctgggggtgaggaggtttcccagttgtcatggggagctcttctgggacgcctgtctggcccttccactgtttgttactaattctacaaaggcagctctgtgtgttggattatgtttggccagctgttgatgcattcctgcggatggggctgggtgaggatcttattactgtactttcaaactgtagatctgtgtgcagggatagtacagaaggaaaggaaaagcaataagttacagaatctgatcattcttacctctttctccagatagtcctagagtgaatccagaaaggctttaaagtgaaaagaggaaagagagagtaagtgattgggggtgggtggcatgaggagaagagaatgaaacagagcaagcgcacaagagaaaaacagccttagaacttcaaagctgcatagacaagcagaatgtcaccagcttgtaattagcagttcatggttgcgtcagtgactgtatctatccaagaataactatgtgatatgtgccacaaagtgaagaagatagtcataactaagttatcaaacccagttcaaacaagggcaaatggattaagaaattttctgtttgtaaatcaaatactgatggattacacagataagacttaactgaattctgcgtaattgaaggctgaattatcaatttgtcaggggggatatgttcattaaatgaaactgtgaacgcttaaacatgcaaattaatcatgcgagaaaatatcagtgcaagctctatcaatacaagatgttttactaaatagccaaaaatggcactgccagtctcctatctctgtatccacacataaatttttttgtttgtttttgtgcatttcaatagagagaagtcaaaagttacattcgagtaaatagggtaaattaaattctaaaattcccactttagaatttaaaaaacaactaaggagttttgatttttggtgatctcccgagtttaaaccttgaaggagcttttgctgtcttgaagccaaacagcagctagtcagtaatcgttatgggaagtcagggtaccacagttgttgagatttcaaggccacgttcacttccctcccttgtctcttgtgcttggagatttgggtgctactacagcctccacaaagagacagtgggaggagctgattggtccgtaggcttagaatgtttactcttatttgttttcagtgctcctccatggcattcattttctgtttgtatttgtgttcatgctgcacaattactcctgacctgctttgtttctctgcccaaagagaagtcaattttagttcagctctgtgtgtttagcttgctgggtaatatgtgcatatgtattgcattacccatgtatgcatttttctttttttaaaatgtggattagggaaaattgtagcatggaaagctgcatatattaaatcaatagctttttgaatcacatgtaatataatttaaatatactcactttgaggttgccaaaactgacattgtctgagcccgtttaatttacatcttcgatttagtcaagaagcggaacctgccagatcagaatagtgtattctgtgcacccaacagggtggaagacattattttgtttgtgttagttcaaacagctggtcattaatgcagtccccatttctagagcgaagtgctgctggacatgaatgcccgcctgattaatgctgcccctccgagggtccttcacccagcagtcatgctcgcagcagaataatgtagcatgatgtgattgcactctaacaggatagtatgtcattgtgtcaccaagcaattgaggttattatggggcagggcagacagacgggacagtggggttactagaccgtagcatttttagaaatacaggcctgacctacttagagttattctctctggctggcagctgcatggtacataaagtctcctgataggctgagtctgttgctagggggaattagcatgaatttttccacacacagactcagtggctgaatgataaaagctgactggaattaaagagatttggtttagtattatacagatttatgtgcctccttttctttctcaagtgcagagaaagagtgcaaaacacagattttgtttccatttgttctttgaccttcttgttctctccccctcccctcaagatgcatgaggggaggagggcagggcagttatgaaattttggttaatctctcactgttggggtcactgaaacgatgtcgcaaattgcaagatatttaagcttaaaaactgttgggaatgactaacagaaggttagattatttttcctcttctgtgcactaagctgttttgaagttgggcatgcatctttcatgcactgtatatttaaactctctttcccttttgggcttgaacaaaacatttatataaattcttttctatccaaacagattgaagcttgcaatctctgtcttgtttaaaacaaggtggtcaggattccagatttagataggaaaaaaatatatataccatttttgttattacaaaatattattttctggggtattgtgggtttggctcccttttcaaaaaccagcctgatgtggatgcttatggatgaaactgaactgctcctaccctaccctgttggcttcacaatgtataggaaaacataggtttttctccagaagaaaatctgcctgcagaatgtatctggaggttgttttccttgttgctgacatatgcactgcatgtagacaactcacataatcaactgtataagatgacccatttttttccttctcatggatctccaagtgtctgtggcttttaatagatcttttctagaggaggagtcttgatagatctttttaaggtaatctgaaaagccatcaggagaaaaattaaagcaacacatatttaagaatactttaatttttcttgttcttaattatatgctaactgtgcttaaactgcaatttctttctgttaccttttactgctgaaagtagtgattatccttgccttttagatttgaaattaattttcgtgagaacaccctgggatatcacaagtaaaaaagaaactgggctacataaaggaaaagaataatagagattcttgtaaacttgtcacattagttttttttgcccacgtgaaaaaggcaagagaaaatttaggtgtagatttttcttttcatttacattttaaaaaatatttggaactatttagatacataatgctttaaaacagtgattcctacttatagcggagactacagtcaaaacaaaataaaacaaatcctctaatgctatcagagccaagaaatctatcaatcatatatacattttttaaatccaggagtgtttacatttcagcatataaatcttatcaagctaaaatagagtatatattctgatgttgtaattgatcgatcataccctcactggctttgagagtccccaaacatttattgtaaaggtttccaactacactagcaatcttttgtaattgaataaaatgccaatttatatttgttgaataaaagattatctggggtactgctccttccgaaatgaagcaatttctttgttgttttaataagtgaacattttttggttttcttttgcagtatttattttgcttaggtcaatggacaattatttaaatatttaaatgcaaatatatagaaataaaatgtcactttaaaatcacttaagaaaggaaaaacgtcaacatacttttattaacattctttaataaacatatggctaatttgtatgtaaagcacagcctgtttccaggtacccagtccaatcaaatgtttatagtttgattaaaaataaattgatcacattataatagttcaatataagtcttatttggctgtttaggttgctaagaatttcccattgtttttatccattaccagggaggtaagtattcaataagtcaaaaacaaaaacaaagcaagcatattttaaaatgtcatttatgctgacttggctaagcttaagcttatacttaagcttgaatcctagatattcacttagacaatgtatgtcatagtattcatttcatcctttgccattcattaaaacaccaaaggagcgatcatcctcactcattgcatcaatcatttatttattaggtatttattttctgctcacacaggaggctaacttctccagttataaggttcaacatagaccaatgaggttttggtgggattggtgggtaaacaaaaaagggaatataagcagttgattgtggtgggccacgaagcgcaggtgaatcttgtgttgaatagtttccctgactgtattctgtctgacacctaatgttacttagtccttacaactttggggaagaactggtgcccttactatcagatgcttggagatgatcagctctcctgatgtcacagagaagctacatctcttccaaactgtctcaacacttttataatatgaaagatctatcagtaagtcagaatgtgccttttgtgaagtcataaaagcataatgtaaaccagtgatttttgacatcactgttaaaatgggtaatagtatctcaaccataatacctgaagcgcccaaactgtacactgccggagaccttatctgattccctcagcctgatgcctcctgggcttcctttttaccaggctcctgtcttattagaccagccatcacctggtggtattctttagtctgtttccccactagtctctaacccattcttcatctgtgtgccaggggcacagaagatgtttcacagacattagttgattaacaaatgaatgaatgagtgaattgatgagtatccagaagacagatgttaagaggaataatgaagtcttctatctgtggatgtatcaatggcatagggcagggatcaacaaagtttttctataaagggccagatagtaaatactttaggctttgtggactgtatggtttctatagcaactactgaacttggctggtgtagctaaaaagcagccatagacaatagtaaatgagtgagtatggctgtgttccaatcaaactttgtttacaaaaagaggcaaggggttggatttgcctgtgggttatagaccccaagttataatcattacctttgatattttaaggatgtgatttacacctataggtttactgaagatcagtgtattaaaaaaggaggaagatttcaaacaattcaataaaaattaagaagaagtgttggataaatattaattatttgcgatgagaactcagtgctaatcaaccaaattttcttttctcactgatgacacggaacaatttattttaaaactcaaagaggaaagcaaggattgttactctttcttaaaatataatggtattttattgctcaatatgtaaaaaggaagaatggaaaatttttaccttcaaaattatttttttagtgttggttgcccaggggcaaagaggaagtccagcctctttgtttgaagagctggaaaaaatttaaaacgtgtgaaatggtaactctggaagcacggccactgtgcatcatgttatcttttgcatattcttttaatcaacgtaaatactgtgctatttcaacaaactaggtcagatctttcctttgtcctatctctccagtcccttctctgttagtaattaatctgcaactgtagaggttctggatgaacccttttcctcctttctcttgctctacttgaggcctttccttgcctttctcctttgttgtagggcagctggtgttggccttatatgttggtggatggttttggaggcagtaaaccaggacggatcatgctctaaaaaccacaggcctgggaattaggcaaccttgtgtgtacatctcactcctgtatccaccagctgtggggctggagatgcttcagtgaacttccctaagcttgaacttcctcattcataaactaagggtgatgataatacttaccatgcagaggctttgggagggtgagatgagattatgaacataaagccctcctagaactttctaaatgtgcagcagaatttcactgctggtgctgtgactcctactaccgctcttgtttttataactgggagttgtcctgctatcaaggaagtgtgcattaggctttgacatcctgatggcatccttaagggtaattctccttaatgagagccttcatcaagagcatttattttggggagtcggatatcagaagtcttgaagccaagagcagagcagacacaggaacttagaataagtctggaggtatccagtatatttcaaggaatttgtgttcttgctgtttcacctctaattttgttgttgttgttgttggcttggtgtgttttagcatattctcttttaggattgtcctagagacaccgtttgtttcttgtctgtttttagagtaagaccaaagacagatagagcaaaaaggactgcccctctaccctaaggctgtgatttccttattttgaaactgtgctcaaggctgatcttctccagaaaatttgtcctgattaggtggcttgggagcaacacatgctcacaaacattcgtcagtcttcagctgactttgtgtgcaatgattttttaaagcacatttattcatcatcacctgactaacttttctatcacttccaggcctcttacgttccccttgaagtttttatggccccaaaatgtggccgaggttgtcctcttatgtaagcgcccatgagctcacaaagcaaagtacttatttttgttttttacctccctgatcacctccattagactgcagataccaaagggcttaccttaatatgatattcccagcaactagaagagccataggcacattctaagtgctcagtagatatttgtatagaaaataactgtcagagccttgttcattctgcatattctaataatttatattaaataagtcacttggaatattgctgaactattagtagtaactactactactaaattgatggtgaaattcatgagttaatctatcccagtaattgtagaatattacttaaaaataaagggttctatccacacagttttggaattagtagatgagaaaatgcatatactattgtgactccttctgagattggacccaactaattatacatttttgtttagacagcatgcagcatagagatgaagaagagaaaccaatttttttttaaaagcaggaagaataagaattattccaaagcaagaataatcattcttcttttgtagggatttcataaaacatgtatcttattctgtgagtgagacatgttctcagttctaacaaaccattgagaggcttattaaatgaaaagtgttcaggaatcatcaattgaacgtgatatttgatattttagcttgcctttatatttttcttaataaaaaaatcctttagttctctaacagaaatgttagaaaaatgttactttgatgcttttaaggaccctttcctaacccacaaggctaaagtatattaataacagagaggtgtaaggcaggaggggtgggggtgtaattgaacgtgtctggtcttcctgtggttttttccttgtggctgctggtggctacaaatggccatgtaccccaggggaagtgaatgcaacagcatgggagtgagagcgtttttgtgttctctgccaattattaggtgtgattgaatattttgaaagaagccagtacataaaaatggacatttggctagtgcctgatagaagtgattctttttccgcctgttttcttttcaaatgtgtttgatattctgactttagactctgcctacccctcttgttatcagaggtagacatcagtcttacaaaggacactcgatagatatggggaggatgacactgggtttagaatgttttttccttctctagctcccataggtctgtgttttcccttgttctgttatagggaagcctttgcttcatcttgttttgttccaagactgtagtaatcaaagtctataccaaaaaggcctttggatttaggcttttagttgtaagaatgaggaatgccaatattgtttcccaagcatgaccactgatacttttaattttatggtattttcagaataaaaggcataacagaatttgtaatttttataattttaaggaaatttctttatactcctttattggaaaacatcttctatagaatgttgcatttcatacttttaacagaaaacacaatagtagcaggagcagtgtttggtgatcattaatcttcactaggatttgagaactcttaattaaagaattatggaaggcctgggaattttttggcaacacatataaatataaaaagagagagtcttctagcaaaatattaatcacttacagccaattcaaatgatggccagcaaacagaatttgaacattgcatccctccttttgatcaattctccatgttgctaattgttagaaatcaggagtagagggcttgtcttcattctggagtcctgtttagagttttgaggaatcactttagcataaaggatggtactgtattgtcaggaatttgtatttccagcattctctttagaaccaatgtgccagtttttgccatcttagtcacatgtacaggtagcaaggtaaacatggattatggtctatatgtttgtacggctgctttgtgggggatcagtttttgataactagaaggatgacatgacgtatgatgtactcagtccttaaaggagcatttagtttaattttctttagacctatccaccaaactataagatccatggggacaagtttgtcaatttagctcatcatcatgcgatgcctggcccagcaaaaatgccatatacacatctattgaatgaaatggaagtaagtgggagtagtgttaagatatttgaaactgaaattttccatataaaccagtagctttctgttcaaaatgtaaaaataaaaatgtctatccatacaatataattttatgaatttctcacttttatttgtgtgaaataaaattttctgaagagaagtgtaattttaaccatgctattgctttttataatgcttagtgttgtaggatggttgcttatagataaacactattatggtagttattacttgagatttaacatttttcttctttataaaatcattcagtattatttgattaatttttagaagtatccataaagagaacaggtggcaccgtttttttccctctgagtagaagactaacttagaaaggttattatgatataatcatttgtttagcaggaattagaataagtatcttagaatggaagggaccttagaaataatctaatcctcccactgccagtcattttgcagataaggagattgggtcatggagcggttaagagatttgcccaaggtcacacagctagttttcatcagagctagaactatagctcacttttttttcttgattccagtgttctgccccgctatatcttaggcctcatttctgtagttcagaagtggtctacatttcttatattttagaagttatttgagcttgttcatcacctaagaaatgtatcactgagagctcgcatagggaaaatacgaggaaatactaatgccatgccatagaaatatatatacagtagcctccagtaccatagtttagtatggtaaaattcaacatactgcatcagaaagttcatggactgcaaactagaattgtggattaccaacctggctctgctgctaactagctgtttgagcttagctgggtcatttgtctctctagacagtgagagaatagcactttgatagttgcttgaggttgcctctagttctgttcctccaacagtctatcattgcccagaaaaagtgatcctgtatttttgaagctgtgcccaaaatatctctttattcaatcatggtctgtgaactagcgtgaatgaacagaagtctgtttccaggtggactaaagacatgacagttgaaattatattgtaagaaactgttgccctgctattgtttcccatattcaaggaaaaaggaaaaaaaaagtactagatggtacgctgtccagtatagtagccactagcctcatatggctatggagtacttgaaatgtggctagtacaaattaagatgtgctgtaagaaaatacggtctggattttgaaaatgtaaaatgaaaagagaatggtaaaatatgtatttcatttaatgcttgtgacaaggtaaatgataatattttggatgtgttgggttaaaatgataatattttggttgtgttgggttaaaatgaaaatattttggatgtgttgggttaaaatatgttattaatttttcattttactttttaacaaagtagctcctagacaatttaaaattaaatatgtagctcacatgatatttctatcggacagcttacatccatactacagcttgactcctttttaatttggagaataactctttgtgtcttagaagccttgtgaataccatggtgtgttgagaacactgagaatgtgctggagaatatgggaatgacaggtgactatgaagtcattgagaggagtaagattctcatggttgaggtaggggtttccttctggaagctgctagctatgctcccacatttatattttaatgttaatgagcttacttggaatgcttacaagtaacccggagatgggtacagtcagctaccaattcacaatcaatcaacagattgaaatcaatttccagggtccctctaatctctacagtgccaaatgtcttgccttttaaaggatttttccttttctaatgcagttcactggcttaaagtagatttagtctgaagttcttacaatgccaaaagacacaattacccacaggattcatgatgtttggaaaattacagaatttggggtagaatagatggaatagacaccctaaaggttcataaaggagttattataactttgccagtaacacaaaacatttgagcaataatgattgtaaacttgtgggataaccaccatcatcataacaagctatagggctctttgaaaatagcattgaatttaagtcttgaaagaatgaatagagcactgaactgattatgttgtttagtgtgtgtcaatattgccttaaactaagaaagtgtaactgtttattgaacatagtaatatttagacttacatatcttagaggttttctctatatggctgaaagctagctccagccttagagttgaaacggacatttttagcgaatggaaaaatagagattcaaacatagtaagtgattcagtggtgccatacctggggcccacatctgttgatttcaagtcaaatactgtttccatgttactgtggaaatacacttccataaatctactgttattttttaaacgttaactttaaaaagcactaaatcccaagattacaagatcacatcactaaagcacaagtcttccagctttataaattttcttgatgacttgtttcttaaattacagaataaaatgcagcaggacctattcagaacccccaaccctctatgaaagctacttatttataaacaaattaagtaggaaaataaataaattttaaaaacagagtattgagaaacaaatactctttaaacactaatggaacatcttgtttgctggctagaagaaaggaacacttgtgttgaacaactaatagtgactcttgaggtcaggacctcctgaaactaaaacaagtatcaaaggaaaaggaaagaaggatttgctttacctaatgactaagtaggctcctagggactgacacctctgcaagaaaacaactatgaaatctgggtataatgcaaaaagcagccacttgacaacactatagcagaaacacaagtaggcagagtctattagaggagtatcttcttggaggaggggaatcagatagagttattgctttttgtcaggacttttcctctttagacatggcatgcaggataacagagtgctgctgaaggaatctacagtccttcaagaaaggggaccagaaaactgaatccggggaaacctcagccaccagagaggaaaagagttacacgtgggattcccatattctgtctccaacataggtggcttacccatgattcacatatacatgaaacagattcaaagcctccagttaaagataaaatatctgaattgggaccagagttgtcatccagaaatcagaatttgcagttctgaggtgaaacaagataattttgtggtaaatttaaagggaagaacactcataggagaaaactaacaatccagagtctctacatctcaatattaataacgtctaggatgcaatccacaattacatgacacacaaatcattaggacaatggtgtatatcctcatgaggaaagaacattaactgatgtcaacaccaagatggctcaggtattggaagtaacagacaagatttaagacagctatcacgaccatactctatgcagtaaatacaccgtgcttatagtgaatgaagagatagaaatctctgccaaaaaataaaaaagataaagaaccaatgggctgggcactgtggctcacccctgtaatcccagcactttgggaggccaaggcgggtggatcatgaggtcaggagattgagaccatcctggccaatatggtgaaaccctgcctctactaaaatagcaaaacttagttgggcatggtggtgcttgcctgtagtcccagctactttgggaggctgaggcaggggaatcactcaaacctgggaggtggagattgcagtgagctgagattgcaccactgcattccagcctggcaatagagtgagactctatcaaaataataataataataataataataataatgacaattctagacctaaaaaatgcaatatatgaaaaagatttaacttgatggactaacagccaatagagtttacaaaagcaagagtaaatgaactttaatcaatagtaattattcgatatagagaatagagagaaaaaacagattgaaataaaaatgaactgcgcttcagagatctgttacagcaggggtccccaacccctgggcaatggtttagtaccagtctgtggctattaggaactgggtcacacagcaggaggtgagcagcagatgagcaagcattaccacctgagctccacctcctgtcagatcagcagtggcattagattctcacaggagcacgaactgtattgtgaactgtacatgcgaaggatctagtttgcacattccttatgagaatctaatgcctgatgatctgaggtggaaaagtttcatcctgaaaccatccccgacaacccttctgttctgtggaaaaattgttttccatgaaaccagttccttgtgccaaaaagttggggactgctgtgttagagaatattaactggtttaatttattacatgtacttgtagtctgagaaatagaagagtgaaacgatgaaacagaaaaaagtatttaaagaaataatagccaatattttcccaaatttgataaaaaacataaatatacaggttcaagttgacaccggataccaagccgaataaacagaaaggccacacaaaaacacagcatagtcaaagcagtaaaagtcaaagataaagcaaaaatcttataagcattgaaagaataataatgtgattagcacctggcttttcctcagagacactggagacagaaaagtatggaacatttttatagtgctaaaaaaaaccctgtcaaccaaagtgtctatatcccagcaacaatatccttaaaagtaagtattttctagactatcactgtgcaatacaattggacaataacggaaatatctgtgtctgtggctatctagtagagtagccgccagccacatctagctattgaacacttgaaatgtggctagtggttttgagaaactaaatttttatttaacataattcaacttaaatagccacatgtggctagtggctaccatattagaactctagaatacataaacttgaaacactaagataataattaaatgattctcagtagccaaagaacataaagttattgccattaggactgtcacaattaacaactaatatttaacatggtaagtttcatatgatttatccataatcgttattcagctattctcattactggaatggtaaactaggtaaattagtattgactaaagatagtgttataaaattaagatagcttttgaataagaatatttaagaaatatattgattgaacagctaatataaatagttcaaaagaatatcattaaatctttatatatttttatatttaaatatatatgtttactgtaacacttacaaagaaatacatttaagcaatgtgatgtctctcaagtagaaaggggaaggcctcctttgccctatctctgctccctactccagaggtgatccccgtgaacagtttggtgtgtatctttccagacttgtttccatgcacatctgtatacatgcacatctgtgtgcttctacttatttggaagctttacttttttttttttatttccataggttattagggaacaggtggtatttggttacatgagtaagtttttcagtggtgacttgtgagattttggtgcacccatcaccctagcagtacacgctgcacccaatttgtagtcttttatccctcacccccttcccaccctttccccctgagtcccaaaagtccactgtgtcattcttatgcctttgcatcctcatagcttagctcccacttatgagtgagaacataacgactttggtattttattcctgagttacttcacttaaaataatagcctccagtctcatccaggttgctacaaataccattaattcatttctttttatggcttagtattccatcatacatatatatatatatatatatatatatatatatatatatagttatatagttatatagatagttatatatatatagttatatagatagttatatatagttatatagatagttttatatatagttatagttatatatagttatatatagtcatacatatatacacacatcatatatatagtcatatatatacacacacatatgtgtatatatagatgccgcagtttctttatccactcattgattaatgagcatttgggttggttccacatttttgcaattgtgaattctgctgctataaacgtgcaagtatcttttttgtataatgacttattttcctctgggtagacacccagtagtgggattgctggatcaaatggtagttctacttttagttctttaaggaatctccacactgttttccatagtggttgtattagtttacattctcaccagcagtgtagaagtgttccctgttcaccgcacccacagccacttctattgttttttggttttttgattatggccattcttgaaggagtagggtggtatcgcattgtggttttgatttgcatttccctgattattagtgatgttgagaattttttcatatgcttgttggtcatttgtatatcttcttttgataactgtctattcatgtccttagcccatattttgttggaattgtttgtttttttcttgctaattgtttgagttcattgtagattctggatattaggactttgtcagatgtatagattaaaaaacatttttaattgacacaattttatatatttgtggggtactgtgtgacatttcaatacatgtatataatgtgtaatgatcaaatcacagtgattagcatatctgtcacctcaaacctttattgtttatgttagtaactttccaaatcttttagctgtttgaaaaaatacaataaattattgtttactatagttacctaaagttctgtagaacactaggacttattctttctatctagctgcaattttatagacattaaccaatctcttcctgctcctgtctctctatctcttcccagcctctagtaaacactgttctgctgtctacatctatgagatcaacttttttaacttcaacatatgaacaagaacatgcagtatttatctttctctgacttatttcacttaacacaatgtcccaggctcatccacgttgccatgaatgacaggatttcacttttcttttatagctaaatagtattccattttgtataaattccacatattctttatccattcttctgttgatggacacttagtttgatctcatatcttggctattgtgaatagtgctgcaataaacatgagagtgctgatatctcttcaacatactgatttcttttcctttggatatatacacagtagcaagattcttgaatcatatagtaattctatttttagctttttgaggaaaatccccataatgttttccttaatggctgtagtaatttatattctctccaacacagcatgagagtttcctttttcccacatccttgccagcctttgttattttttgtctttttaataataacccttttaactgaggtgagatatctcattgtggttttgatttgcattttcctgatgttatttttttaatatacttgtggccatttggaaatcttctctggagaaatgtctgtacagatcctctgcccattttaaaattggattatttgtttttttagctcttgtgttgtttcagtaccgtgtatattctggatattaacctattgtcagatgtatagtttgcaaatattttctcccattctgtaggttgtctctttactctgttatttgtttcctttgctgtgaaggaactttttactttggtgtaatcccacttgcctatttttgcttttattgtcattacttttgaggccttaactataaaatatttgctcagaccaatgtcttgaagcatttcccccgttttcttctaacagtttcatagttttaggtcttatattgaagtcttttattttgtgttgatttctgtacatagggagagataggggtctagttttattgtttatggatatccagttttcctagaaccatttattggagagggtgttctttcctcaatttatattcttggcccctttattgaaaatcagttgtctgtaaatacatggatttctggcccccttattctgttccactgttccatgtgtctgtttttatgtaagtacatgctgttttggttactaaagctttgtagtatattttgaagtcaggtagtatgaggcctccagttttgttctttttgctcaagattgctttggctatttagggtcttctgtggttccatatgaattttaggatttttttttttctatttctgtgaagaatgtcattggtattttaatagggatttcattgaatctatagatcactttaggtagtatattcgatttaataatattcttccaatccatgaatctgggatatctttccatttatttgtgataagtttctttcatcagcattttatggttttcattgtagaggtctctcatattgttggttatatttattcctattttattttaaattttttaatagctattgtaactggaattgctttattgatttatttcagctagttagctgttgatgtgtaggaacactactgatttttatatgttgatttcgtatcctgcaacttcactgaattcacttatcacttctaaaaatttcaatggagtctttaggttttctctatataaaattaggtcatctgtaaacagggacaatttgacctcctcttttccaatttggatgccttttatttttttctcttgcctaactgctttggctagaaattccagtactacattgaataaaagtggcaaaagtgggcattcctgttttgtttcagttcttagaaagctttcagcattttcttgaatagtatgaggttggctgtgactttattatatattgcttttgtgtttaggtttgttccttctttacctaatttgttgatggcttttatcatgaaggaatgttgaaatgtatccatgctttttctgcatctattgaaatgatcatatggtttttgttcttcactctgttgatgtgatgttttgtatttatttggtttgtgatataatttggctctgtgtccccacctaaatttcatctggaattgtaatacctaggtgtcaaggggggggcctggtaggaggttattggataatgaaggcagttttgcccatgctgttctcataatagtgagggagttctcaggagatcgcatgctataaaagtgtttggcagttctccccctttctctttctctttctctctctctctctctctctcttctctctctcctgctgtcacataagatgtgccttgctttccttttttttatttttttatttttattattattatactttaagttttagggtatgtgtgcacaacgtgcaggtttgttacatatgtatacatatgccatgttggtgtgctgcacccattaactcgtcatttagcattaggtatatctcctaatgctatccctcccccctcccccaaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcatcattttttatggctgcacagtattccatggtgtatatgtgccacattttcttaatccagtctatcgttgttggacatttgggttggttccaagtctttgctattgtgaatagtgtcgcaataaacatacatgtgcatgtgtctttatagcagcatgttttataatcctttgggtatatacccagtaatgggatggctgggtcaaatggcatttctagttctagatgcctgaggaatcgccacactgacttccacaatggttgaactagtttgcggttgaactagtttacagtcccatcaacagtgtaaaagtgttcctatttctccacatcctctccagcacctgttgtttcctgacattttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgttttcttgtaaatttgtttgagttcattgtagattctggatattagccctttgtcagatgagtaggttgtgaaaactttctcccattttgtgggttgcctgttcactctgatggtagtttcttttgctgtgcagaagctctttagtttaattagatcccatttgtcaattttggcttttgttgccattgcttttggtcttttagacatgaagtccttgcccatgcctatatcctgaatggtattgcctaggttttcttctagggtttttatggttttaggtctaacatgtaagtctttaatcgatcttgaattaatttttgtataaggtgtaaggaagggatccagtttcagctttctacatatggctagccagttttcccagcaccatttattaaatagtgaatcctttccccattttttgtttttgtcaggtttgtcaaagatcagatagttgtagatatgcggcattatttctgagggttctgttctgttccattggtctatgtctctgttttggtaccagcaccatgctgttttggttactgtagccttgtagtatagtttgaagtcaggtagcatgatgcctccagctttgttcttttggcttaggattgacttggcaatgtgggctctattttggttccatatgaactttaaagtagttttttccaattctgtgaagaaagtcattggtagcttgatggggatggcattgaatgtataaattaccttgggcagtatggccattttcacggtattgattcttcctacccatgagcatggaatgttcttccatttgtttgtatcctcttttatttccttgagcagtggtttgtagttctccttgaagaggtccttcacatcccttgtaagttggattcctaggtattttattctctgtgaagcaattgtgaatgggagttcactcatgatttggctctctgtttgtctgttattggtgtatgagaatgcttgtgatttttgcacattgattttgtatcctgagactttgctgaagttacttatcatcttaaggaggttttgggctgaaacaatggggttttctagatatacaatcatgtcgtctgcaaacagggacaatttgacttcctcctttcctaattgaataccctttattctcttctcctgcctgattgccctggccagaactgccaacactatgttgaataggagtggtgagagagggcatccctgtcttgtgccagttttcaaagggaatgcttccagtttttgtccattcagtgtgacattggctgtgggttttgtcatagatagctcttattattttgagatacgtcccatcaatacctaatttattgagcgtttttagcatgaagcgtcgttgaattttgtcaaaggccttttctgcatctattgagataatcatgtggtttttgtctttggttctgtttatatgctggattacatttattgattttcatatgttgaaccagccttgcatcccagggatgaagcccacttgatcatggtggataagctttttgatgtgttgctggattcggtttgccagtattttattgaggatttttgcatcaatgttcatcaaggatattggtctaaaattctctgtttttgttgtgtctctgccaggctttggtatcaggatgatgctggcctcataaaatgagatagggaggattccctctttttctgttgattggaatagtttcagaaggaatggtaccagttcctccttgtacctctggtagaattcggctgtgaatccatctggtcctggactttttttggttggtaagctattaattattgcctcaacttcagagcctgttattggtctattcagagattcaacttcttcctggtttagtcttgggagactgtatgtgtcaaggaatttatccatttcttctagatttgctagtttatttgcatagaggtgtttatagtattctctgatggtagtttgtatttctgtgggatcggtggtgatatcacctttgtcattttttattgcgtctatttgattcttctctcttttcttctttattagtcttgctagcagtctatcaattttgttgatcttttcaaaaaaccagctcctggattcattgattttttttgaagggttttttgtgtctctatttccttgagttctgctctgatcttagttatttcttgccttttgttagcttctgaatgtgtttgctcttgcttctctagttcttttaattgtgatgttaaggtgtcaattttagatctttctgctttcttttgtgggcatttagtgctataaatttccctctacacactgcttttaatgtgtcccagagattctggtatgttgtgtctttgttcttgttggtttcaaagaacatctttatttccgcctttatttcgttatgtacccagtagtcattcaggagcaggttgttcagtttccacgtagttgagcggttttgagtgagtttcttaatcctgagttctcgtttgattgcactgtggtctgagagacagtttgttataatttctgttcttttacatttgctgaggagtattttacttccaactatgtggtcagttttggaataggtgtggtgtggtgctgaaaagaatgtatattctgttgatttggggtggagagttctgtagatgtctattaggtccgcttggtgcagagctgagttcaattcctggatatccttgttaactttctgtcttgttgatctgtctaatgttgacagtggggtgttaaagtctcccattattattttgtgggagtctaagtctcattgtaggtcactcaggacttgctttatgaatctgggtgctcctgtattgggtgcatatatatttaggatagttagttcttattgatgaattgatccctttaccattatgtaatggccttgtcttttttgatcttcgttggtttacagtctgttttttcagagactaggattgcaacccctgcctttttttgttttccatttgcttggtagatcttcctccatccttttgttttgagcctaggtgtctctgcatgtgagatgggtttcctgaatacaacacactgatgggacttggctctttatccaatttgccagtctgtgccttttaattggagcatgtagcccatttacatttaaggttagtattgttatgtgtgaatttgatcctgtcattatgatgttagctggttattttgctcgttagttgatgcagtttcttcctggccttgatggtctttacaatttggcatgtttttgcagtggctggtaccagttgttcctttccatgtttagtgcttccttcaggagctcttttagggcaggcctggtggtgacacaatctctcagcatttgcttgtctgtgaagggttttatttctccttcacttatgaagcttagtttggctggatatgaaattctgggttgaaaattcttttctttaagaatgttgaatattggcccccactctcttctagcttggagagtttctgctgagagatccgctgttagtctgatgggcttccccttgtgggtaacccgacctttctctctgtctgccttaacatttttctcttcatttcaactttggtgaatctaacaattatgtgtcttggagttgctcttctcgaggagtatctttgtggctttctctgtatttcctgaatttgaatgctggcctgccttgttagattggggaagttctcctggataatatcctgcagagtgttttccaacttggttccattctccccatcactttcagatacaccaattagacgtagatttggtcttttcacatagtcccatatttcttggaggctttgttcttttctttttattcttttttctctgaacttctcttcacgcttcatttcattcatttcgtcttccatcactgataccctttcttccaggtgatcgcattggttactgaggcttgtgcatttgtgacatagttctcatgctgtggttttcagctccatcaagtcctttaaggacttctctgctttggttattctagttatccattcatctaattttttatcaaagtttttaacttctttgccattggttcagacttcctcctttagctcagagtagtttgatcttctgaagccttcctctcgtcaaagtcattttccatccagctttgttccattgctggtgaggagctgcgttcctttggaggaggagaggtgctctgatttttagagtttctggttattctgctgtgttttttccccatctttgtggttttatgtacctttggtcttcgatgatgaccacatacagatgggtttttggtgtggatgtcctttctgtttgttagttttccttcttacagtcaggaccctcagctgcagatccgttggattttactggaggtccactccagaccctgtttgcctgggtatcagcagcagtggctgcagaacagcagatattggtgaaccgcaaatgctgctgcctgattgttcctctggaagttttgtctcagaggagtacccggccatgtgaggtgtcagtccacccctagtggggggtgcctcccagttaggctcctcaggggtcagggacccacttgagaaggtagtctgcctgttctcagatctgaagctgcatgctgggaaaaccactactctcttcaaagctgtcagacagggacatttaagtctacggaggttattgctgtcttttgtttgtctttgccctgcccacagaggtggagcctacagaggcaggcaggcctccttgagctgtggcgggctcctcctagttcgagcttcccagctgctttgtttacctactcgggcctaagcaatggcgggcgcccctcccccagcctcgctttcaccttgcagtttgatctcagactgctgtgctagcaatgagcgaggctccgtgggcataggaccctctaagccaggtgcgggatataatctcctggtgtgccgtttgtgaagcccgttggaaaagcacattattcgggtgggagtgacccgattttccaggtgccgtctgccacccctttctttgactaggaaagggaattccctgaccccttgcgcttcccgagtgaggcgatgcctcgccctgctttggctcacgcacggtgcactgcacccactatcctgcacccactgtccggcacttctcagtgagatgaacccggtacctcagttggaaatgcaggaatcacatgtcttctgcgtcgctcacgctgggagctgtagactggagccgttcctgtttggccatcttggctccacaccgccttgctttcctttcaccttcggctgtgattgtaagtttcctgaggcctccccagccatgcagaacagagccaattaaacttttttcttcataaattatccagtctcaggtaatacctttatagcagtgtgagaacagactaatacagagaattggtactgggatagtggggtactgctataaagataacctgaaaatgtggagacaactttggaactgtgtaacaggtagaagttggaacagtttggaaggctcagaagacaggaagatgtgggaaagtctggaacttcctacagtcttgttgaatggttttgaccaaaatgctgatagtgatatggacaatgaagtccaggatgaggtagtctcagatgaagatgaaaaacttgttgggaactggagtaaaggtaactgttgctatgcattagcaaagagactggcagcattttgcccctgccctagagatttgtggaatttttaacttgagagagatggtctgaaattggaacttatgtttgaaagagaaggagagcataaaagtttggaaaatttgcagcctaaacatgtggcagaaaagaaaaaccaatttcctgggaagaaattcaatctggctgcagaaatttgcatacacaacaaggagccgaatgttaatcatcaagacaatgtggaatatgtctccagggcatgtcagaggtcttcacagcagcccctatcatcgcaggcctagaggcataagaagaaaacttggttccacaggctggactcagggccttgctgctttgtgcagtcttggaacgttgtgccctgcatcccagctatggctaaaagggaccaacatacaactcaggtctttgcttcagagggtgcaaggcccaagccttggtggcttccaagtaatattgggcctttgagtgcacagaagtcaagaattggggttgggaacctcagcctagattgcagatcatatatggaaatatctggatgtccaggcagaaatttgctgttggggtggagccctcatggagaccctctgctaaggcagtgtggaagggaaatttggagtcagagctcccacacagagtccccactggggcattgcctaggggagatgtgagaagagggccaccatcctccactagaatggtagatccaccagcagcttgcaccatgctcctggaaaagccacaggcactcagtgctaacctgtgaaagcagccttgggggcggtaccctgcagagccacagggacagagctgcccaaggcctttggagcccatcccttttgtcaaagtaccctggatgttagagatggagtcaaaggagatcatattggagttttaagatttaataactgtcatgttggcttccagacttgcatgcggcctgcagaccctttgttttggccaatttctcttgtttggaatggagtcatttacccaatgcctataccctcattgtatcttagaagtaactaacttgcttttgattttacaggctcacaggcagaaggaattttccttgtcttggatgagacttttgacttggacttttgggttaaggttagtataagctaagattttgggggactgttgcgaaggcatgattgattttgcaatgtgagaagaacgtgagattttggaggggcgagttgcagaatgatatggtttggctcagttccccactcaaatctcatctggagttgtaatctctagacattgagggaggggcctggtgagaggtgattggatcatgtgggtggtttctgccattctgttctcacaatagtgagggagttctcagaagatctgatgctgtaaacgtgtttggcagttccccacttctatctctctctctctccctctccctttctcctgctgccatgtaagacatgccttgtttcccctttgccttccaccatgattgtaagtttcctgaggcttcccctgccatgcagacccgtgagtcaattaaatctgttatttcatagattaccaagtctcaactagtatctgtatagcgcagtgtgagaatggaccaatacagtgtgtgtatgttgaactgtccttgcatttgtgggataaagctcacttgatcatggtgtatgatgtttttgatgtgctgttgaattcggtttgctaatattttgttgagaattttgcatctatgtttatcagggatattggcctgtagttcactgttgttgttgtatccttatctggttttgatattagagtaatgctggtcttatagaatgaatttggaacaattccctccccttagatttttctggagtagtttgataaaagttggtattagttctttgtcccccccccccacttttttttttattatactttaagttttagggtacatgtgcacattgtgcaggttagttacatatgtatacatgtgccatgctggtgtgctgcacccactaactcgtcatctagcattaggtatatctcccaatgctatccctccccactcccccaaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcggcatgatttataatcctttgggtatatacccagtaatgggatggctgggtcaaatggcatttctagttctagatgcctgaggaatcgccacactgacttccacaatggttgaactagtttacggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttctgatggggttgtttgtttttttcttgtaaatttgtttgagttcattgtagattctggatattagccctttgtcagatgagtaagttgcaaaaattttctcccattttgtaggttgcctgttcactctgatggtagtttcttttgctgtgcagaagctctttagtttaattagatcctatttgtcaattttggcttttgttgccattgcttttggtgttttggacatgaagtctttgcccatgcctatgtcctgaatggtaatgcctaggttttcttctagggtttttatggttttaggtctaacgtttaagtcttcaatccatcttgaattgatttttgtataaggtgtaaggaagggatccagttcagctttctacatatggctagccagttttcccagcaccatttattaaatagggaatcctttccccattgcttgtttttctcaggtttgtcaaagatcagatagttgtagacatgcggcgttatttctgagggctctgttctgttccgttgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagacagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgctcagctttggtatcaggatgatgctggcctcataaaatgagatagggaggattccctctttttctgttgattggaatagtttcagaaggaatggtaccagttcctccttgtacctctggtagaattcggctgtgaatccatgtggttctggactctttttggttggtaaactattgattattgccacaatttcaactcctgttattggtctattccgagattcaacttcttcctggtttagtcttgggagagtgtatgtgtccaggaatttatccatttcttctagattttctagtttatttgcgtaaaggtgtttgtagtattctctgatggtagtttgtatttctgttggatcggtggtgatatcccctttatcatttttattgtgtctgtttgattcttctctctttttttctttattagtcttgctagctgtctatcaattttgttgatcctttcaaaaaaccaactcctggattcattgatatttttgaagggttttttgtgtctctatttccttcagttctgctctgatgttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctgatatgttgtgtctttgttctcgttggtttcaaagaacatctttatttctgccttcatttcattatgtatccagtagtcattcaggagcaggttgttcagtttccatgtagttgagcggttttgagtgagattcttaatcctgagttctagtttgattgcactgtggtctgagagatagtttgctataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctggatatccttgttgactttctgtctcgttgatctgcctaatgttgacagtggggtgttaaagtctcccattattaaagtgtgggagtctatgtctctttgtaggtcactcaggacttgctttatgaatctgggtgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctctgcatgtgagatgggtttcctgaatacaacacactgatgggtcttgactcttcatccaatttgccagtctgtgtcttttaattggagcatttagtccatttacatttaaagttaatattgttatgtgtgaatttgatcctgtcattatgatattagctggttattttgctcgttagttgatgcagtttcttcctagcctcgatggtgtttacagtttggcatgattttgcagcggctggtaccagttgttcctttccatgtttagtacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaagctttgctcatttctttgtattcttttttctctaaacttcccttcttgcttcagttcattcatttcatcttccatcactgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggataggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgtcctgcccccagaggtggagcctacagaggcaggcaggcctccttgagctgtagtgggctccacccagttcgagcttcctggctgctttgtttacctaagcaagcctgggcaatggcgggcgcccctccccccgcctcgctgccgccttgcagtttgatctcaggctgctgtgctagcaatcagcgagattccgtgggcgtaggaccctccgagccaggtgcgggatataatctcgtggtgcgctgcagtccgaaaagcgcaatattcgggtgggagtgacccgattttccaggtgcgtccgtcacccctttctttgactcggaaagggaactccctgaccccttgcgcttcccaagtgaggcaatgcctcgccctgcttcggctcgctcacggtgcgcgcacccactgacctgcgcccactgtctggcactctctagtgagatgaacccggtacctcagatggaaatgcagaaatcacccgtcttctgcgtcgctcacgctgggagctgtagactggagctgttcctattcggccatcttggctcctccccctctgtattagttctttgaaagtttggtagaattcagcagtgaagccctctctccctaggcttttctttgttgggagtgagttttttttgtttttttttttaaattactgactcaatctcatttctcattattggtctattcaggatttctgttactttccgattcagtcttggtaggttgtatgtgtccaggactttatccatttcctctgggtttttccatttgtttggtgtacaattgttcataatagtccctaacagccctttgaatttctgtggtattagttataatgtcttcttgttttgtttctgttttatttttgtctttttttttcttagttaatctagctaatggtatatgctagtcgattctcgcactgctataatgaaacacctgaggctgggtaatttataaagaaaagaggtttaattggcatatggttctgcaggatttacagaaagcgtggtgctggcatctgatcagcttctggggtggcctcaggaagcttacaatcatggtggcatttgaagtggaagcgagagagagaagaggagatgcaacacacttttaaacaagatttcaggagaactcattcactatggtgagaacagtaccatgctatgagggatattcccccatgaaccaaaaacttcccaccaggccccacctccaacattaggcattacatttcaacatgagatgtgggtgaagataaatatccaaactatatcatgatgtgtttgattttattttaattaatttagagacagtgtctgcctctgtcccccaggctggagtgcaatggtgcaatcttggctcactgaaatctccacctcctgggttcaagcaattctcatgcttcagcctcccaagtagctgggattacaggtgtgtgccaccacactcagccaatttttgtatcaatatttttagtagagacagggtttcaccatgttggcaaggctggtctcgaactcccaatctcaggtgatccacctgcctcagcctcccaaagttctgggattataggtgtaagccacctcacctggcctatttactttatttttaatttttttaacttttattttgggttcaaggctacatgtaaaggtttgtttacatcggtaaacttgtgtcacaggggtttgttgtacagattatttcatcacccatgtattaagcccagtaccgaatagttatctttgctccccttctccctccttccaccctctaccctcaagtagaccccaatgtctgttgtttccttctttgtgttcagaagttctcatcatttagctcccacttataagtaagaacatatggtatttggttttctgttccttcattagtttgccaaggatgatagcctccagctcatccgtgttcttgcaaaataagtagtctcattattttttatggctgcataattttccatagtgtgtatgtaccacattttctttatccagtctgtcattgatgagcatttaggttgattctgtgtctttgctatcgtgaacattgctgtagtgaacattcgcatgcatgtgttcttatggtagaatgatttatattcctctgggcatatacccagtaatgggattgctgggttgaacggtcgttctgcttttagctttttgaggaatcatcatactgctttccacaatggttgaactaatgtacgctcccaccaacagtgtattgtgttcccttttctctgcaacctctccaccatctatttattgagtttttaatactagccattctgactggtatgagatcatatctcattgtggttttgatttgcatttctctaatgatcagtgatactgagctttttttcatattctttttggccacatgtatgtcttcttttgaaaactgtctgtgtcctttgcccactttttaacggagttttttttcttttggaaatttaagttgtttatagatgctggatattagacttttgtcagatgcatagtttgcaaatattttctcccattctgtaagttgtccgtttactctgttgatagtttcttttgctgtgaaaaagctcttaagtttagttagatcccatttgtaaatttttgcttttgttgtgattgcttttggtgtctttgtcataaactctttgcctgtttctatgtccaagatagtattgcctagattgtcttccaggcatttcaaaaaacctgctgtttattttgttgatcttttgcattttttgtctctttcatttatttccactttgatctttttttttccccttctagtaattttgggcttggtttgttcttgctcttctgtttacctcaggtgtactgttaggttgtttatttgaaatttttctactttttgatgtggacacttattgctataaagttctctcttagtactgcttttgctgtataccataggttatggtatattatttctattttcatttgtttcaagaaatttttacatttccttcttaatttcttcctcaacccattgatcattcaggaagatgttgtttaatttccatgtgtttttatagtttccaaagttcctcttgtcgaattctagttttattccattgtagtcagaaaaaatacttgatatgaattcagtttttaaaatgttgttaaggcttgttttgtgacctagcatatggtctatcctggagaatgttctatgttctgatgagaagaaggtgtattctgcctttgttggatgaaatgttctgtaaatgtctgttaggtccagttgggctatattgcagtgtaaatctgatatttctttgctggttatctatctagatgatatgtttgctgagagtgaggtgttgaagaccccagctattattgtattgaggtttccctctctctctttagagctaataacatttgacttatataactgagtgctctggttttgggtgcatgtatacttagaattatatcccgttgctgatttgatccctttatcattatatagggaccttccttttctctcttgacagttttttacttaaagtctaatttatctgatgatataagtatagctactcttgcttgttttggtttccatttgtttgaataatctttttccatctcttcaccctcagtctgtagtgtctttacaggtgagattgagtttcttgttggcagcatatagttgcatcttatttcttcattaattcagccagtctacattttttaaatggggaatttaatccattttcattcaaggttattattgataggtaaggacttactgttgtcattttgttagttgttttgggttttttttttttttttttttttggtatatcctttgtttcttcttttattgttgatctttgcagttttctgatttttttttttttgtagtaataggatttgattcctttctctttctcatttgcatatctgttctaccagtgagttatatattttcatgttgtttacgtgatggtagttgttatttcacttccagttgaagtacttcctcatgcatttcttgtaaggctagtctactggtgatcaatttcctgaagttttggttgtctgggaaggactttatttctcctttgtttctcagagataactttgctggacatagtattcttctctgacagcttgttttctttcagcactttgaatatatcatcccattctgtcctggtttttatggttttctctcctggtctgctgagaaatctgctgttagtctaatagggactcccctatacatgacttgacactcttttcttgttgtttttagaattctctatcatttacttttgacagtttgactataatatgccttggagaagaactttttgggttgaaactttggggagctttagagcattgtgtatctggctttgcatatctctcccaagacttggaagctttttagctattatttcattaaattttctatgacttttcccatcttttccacttctggaactgccataatgcaatcatttgtttgcttaatagtgtctagtaagtttgacagactttcttcattcttttctattcttttttcttgtttgactggattatttcaaaaggcatctcttcatgttcagagattcttctgcttgatgtaatgtgttgttgaagctttcaatgataatttttattaaattcagctccaatatttctgtttttttcatttttgatacctatctttttgttgaatttctcaaatgatggttttttcattttaattgaattgtctttttaatattcctttgcctctgagttttcttaaagttattattttgaatttcttttcaggcaatttaaaattttcatttttgaggtcaattactggagaattactggagaattactgtgctttgtggtgttatacttcactgctttttcatgttcttgtctcccttgcttgatatctgtgcatttaatggaacattcacgtcttccagttttgtagtgtggctttcatgggaaaaaactttcttctacagatatgtcctagggtgtcagttgggtagggtgcgttggcttttctttgggtgggtgcaatagtgtagtctttgtacagtttcttcagctatagtcaacatcagcaatgcctgtgtgtgcctcaatggcttaggctgtagagatttgtatggctattccacctacttgggctctgctcctcggggggttgggtgctgggctggtccacgctttggagaagtgaggggctggtaaatcagtggcttgagtcagctcaggctctgctcctcacattaaatcttgaaagatgtgaatttcattacctcttagttacataaagccatatacaaactctttgttgtttgttttaaatcttatctctgacttggttataaatgattgcacttttctactatttctaactacagtatagcagtgctgaaacatctggggggcaaaagaaagttagataggctagtaacaccaaagtaatgctgaaacctggaaggaaagaaaacacattactttcctctccattcttctttgctcccctttgaatatatgcttattataatagcaagctgtgtgaccttgagccatttatttgtctggagccacagcttctttacttacaaaataaagttaatgccatttacatctcagaaattgtgaatatacatgagaaatatgtttataaaatctcatgatatgcttgtcacacagtaaggtttggtaaagtgaatccttcaacagcgttccccaattctttctcttgtgctgaaagtggactatctatcttagaaaagaccatgcaaaccaaaatagaatgacttggctacagagcagtttcactgtctactgattaccaacctgtcttaatccagtgagatagaacactcctccacgcaggttacctgaagccagtgtattacttacagataggacaacagaagcctatgattcgtaaaagcctcaagaaagctagtttggcagatggggtttcatctgcatgtgccacatttgcactgcagtcgagggtcccaagaaagcactccaccctaggttttataccccagcataacatgattcactgtgctaatgtgttgaaggacatgctgtttctatgagggattagaacagaacctaggctgttcaggctagtttctccctatcttaagatgttgcattctcagcatattctatatttattcttgagaactatgagtaaaaaagaggggtaactgtgtcagtccaaagatacctgaagaattgtcctgtgctaacagcagaaaagtttccagttgatttaaaatcaagtgatttgcaatgtagttacaaacaaaattattaagtgcctattttgtatttgaccccatggtaatactgattatgataataataaaatatattaagcaattatttttacctgtcattctttgaagcattatctcatttacttctcccagaacccagtgaggtagttagtattattatctctcatttacagatgaggatatactgagtttgcatgtttaactcatccacagtcacattactatttgtggtggaggagtgatttgaacccaacctatctgactgatttttttaaccagattgttaagaaaataaacatcagccatcccaaatctccccatctaatccagaggggaagtttacagcttgaaataattactctcaagagatttcagagaagtggtagaaaaccaacatggccttggtcttctaccactaaggttttatttttaaaattaatgaataagtaggtcttgagttgccattttatagctttgttcttagtttaacaagaaggagcaagtaggaagacttttcatagcccaacccccaacacagttgaaatcagcattagcatagagcattagaaataagattcagcatgcatcttgccatgtgaccaatcctggcctccatcacagaattctagttacgtggtgaacctgggagaccactctctgtccccatcctggacgccccctatactgcagatcctccctgacatgggaccccggaccctagggctcaggaaggctcaaccaggacttaacagcagtttccgaagggccttctgagcccctcacccatctcctaagtctggccagactgacaggaccagcaagggatggggcatgggaaagattagaaatatagaataaaacagcatcgtggagagccttgaaaaccaatttaaaatagttttatcttctaatagtaggtcctagcttagcatcctagtttagcagcctttacgctttggatcttgactccttagtaggttgtaaaatttgtttattgggtcacaaccaacatacctgttttaatgaactgggatagggtaaaatggaaaatagaaacgtgtcttgcagttaataagggcttttgtgaaacatttgttttagttatatacagtcaattcttgttatgtgtagtagttctattctataaagtcaccaccaacaccgaattagtaattacaaaaccattgctccctgtgtaaatacaagattaggttcctttgttcctctggtcacaaaattttcatcaacagattaatacataaccttattttatgagtgtttctgtataaggacacctcatttaatatatattgttgattcattaacattaaactctaggctaaaagcactatcactcatacctgaatgaaacttctcgaacacatgtatttttctccctgaggtccatcacagccttcttacgctgtcgaacccagttaccactttagcactatgcttgggggccattttaaacatgaaatcaccaattaaaaaaagcacaaaaatgcaaaaaatgtgacatcaaataggccttgaaaagaacactttttgagctgaaataagaagacagagcatcacttttttcaacctcagctgggaacacatatgtcaggtactaacattttcatgactctacatatgtctgtgactgaccacaaacatgctttgagtatggatttgggagctacaaataaatttagcaaataggtgaatttgcaaatatagaatttgtaaataatgaggatcaactgtttgtgtacagacacacaaatacacaaatatgtttactaggtctacgagcttgtaatgtaaaatgtatttctcaaaagaaaggatttttggtttgttttttagacatacatccctaaataatcagattgctgaggaatgacacagtggacattgctttaagatgtaaacagtaagcagaatggggtttcgaggcaagcagcctagattagaagacttctatagtaatctaaccccttgaagcaatgagtgcaaaagtgggcctggggactagggagaattaagccaagaaaaaaaaagatgataacttggttacaaactgaatatgtaaataaagaaggaaaaattgatgcttattctgaaagtatctggtgtagaaattagaagggtggtaggtatagtgagatatgttatatcttggaaagaatagagctttgaatgctggtggaatccagtttcagtcttgcctctatgactttactagacatgtgatctttggcaagtcacaaagccttctgcctcatttttacaatcatgccatttaaatatcagttaattgctacagttaaatgagtcaatatactatatatgtgacattcgtagaatacactaacacccaggatgtagctgcaatataaataggtgatatatctgtattatgtgtaattattcataatatgtttattatatctacatatttatatatatacatgcaaactatagtataattacacctgaagaaatattgggacatcaaagaagagttactcatcaggccatgaaattaggagatggcaataaagttgaaaggccaggattactatatatgtggattatcagtttttcaaagcactagagtacaggtaatatatattaaaattgcctgacaaaatttaaactttgtttgagaatgcatgctaggatcttgcaaccgccataatcataaatatcaatttttaccatattggcacagctcaaaattgctagtagagaggaacttctgattgatggactaccaaatacgtaggcttttactgtaatttgttctacaggttacagttagtattgtcaaagcacggcaggcaacattatagattttaaggctgcagtatctttatatctcccatgatattaaatataattcaaacacagaaaaatgctcttctctcattatgtcttttctttttgatgagagatgaataggtccacttgagaaatgattatatcgactgttgtactttaaattttctttagcactacaaaactggcaagaagtggcaagtcagtaagtccaaatacacagctgatatgtgatttcatatcacagatattctgtctgcagcacaacagaacacagggtattgagttatcccccaatgaattaaagtccctcttgcatcctttacataccaatttcattaatattaataattactaattctagctaacacttgccaatgcataatgggaactgcgtttttaacaaatgttgcctaacaaagactgttatttttttctatatcttggttgtggtacagtctgatagctttcaaagaacaagccaaattgtcaaacgctgttggtttgtaatgtcatgttcgatctggagctgagaagtgcggcctcaggtttctggcctgtcttttatgtcacagaagcacagaattgttaaacaatctggggaaattgaaagcagcaaatgcgcaataaaattttctctgtagttcagtgctacataacaaaagagacccataaactttgttccattctggcattggatggtgacttctctttgggaacggcggccacaacagatgtaaagaaaaacagaactttaaaaaaataaacttcaggaaatagttttcaagtctttatttttccctgtgtttcagctaatgctcaaagctttcctaaaatgttctgttggaaatagtgggactggaataagctctattttccattttgtccccttgtttcagggctttcagatgtccttaataaccctgaacttgtagaatgttttaattaagaacttcactgttagagtataataacataaacctaagatccccctgtgataatcatgctttgtttatggttttacaacaaacttgtgttttatcctgttggtatatttattgtatcttggcatttcttttgatgatgccaaaaaaatcccagaagcttaaagagggagagacaacctttgaagccactttgacttttgttttttttcttgacaaagtgttttatctctgaagaattcaattcagtacatgggtcttatgagtacatttattgtactaaaatgtcatatttgcttagatcaaatgaagatcaactacactgaaaataagatagataactattttataaaagaattcctatctttctctgccaagaacactgtatgttttttccttgcattaggaaatggggataattttgacacttttcactttattttagaaagagcttgtacttttgttttgtaaggaaaataaaaaaggtaagcatggtagggcacagtggcttgtgcctgtaatcccagcactttgggaggtcaaggctggaggatcacttaagcccaggagttcgaggctgcaatgagctatgaatacaccactacatcccagcctgggtgatagagcgagaccttgtctgtgggaaaaaaaaaaaaaagtgtgagtgatactgtttattacgaagcttaatttgcattgaggttaaatgttaatgggattctcctctcttctttttctaactctgaaatcccattctaagccttgaaatgggcagagcaaggtaggagtctccagcagggaggaggaggggagttgtggtggctcagagcaacatgtcagacccgagagggtcagtactgatagggcacagcctgtcaagggctgtcagagccttggcagggtgacaaggatgttcacatgtggggacaggctggtgtggggttttggaggacaagctgagtgaggcaggtatctagaggtagagtggattggaatatggacccccaaaatatttgtccaagtgctaactcctagtaccaaactctgtattaatttctcagagctgctgtaactaattatgtttaacttgatgacttcattcaacagaaatttattctttcacagttctggagaccagaaggccaaaatcaaaagtatgggcaggcttgatttctttagaagactccagcggagaactgtgtctccttgcttctggtgggtattggcaatccttggagttccttggcttgtaggcacatcgcttcaatctctgcttctgctttcacgtggggctcctccctgtatgtgtctgtgttgcctccttttctgactctcataagaacacttgttattggatatagagccctccctaatccaggatggtctcatcttgagatctttatcttggttatgtctacaaagacccttattccaaataaagtcacattttgagattttgggtggacatgtgttttgatgtgccactattcaacacactaccaaagaggtcactcatcacgtggtttcagagatcaagaggagtgagaatggcatccctgtgaaggggtggtttcttgtggggcatgaaagcttatgcaggataggagagtatctatgctagaagtcacccagcataaatgtcagaccccaagtggggtgatgaggcgagatgagagattggttacatatggtagactgatccaataggcaagtaagtatattgagggtgagaggagccaagtttctgtcatagaagcaaattacaaatataaaaaaggagaaaattatggagttgaaggtactggtgtgaacttgtaatttgtaataaatgagctatattaatacatggagatgtaaatgtatgtgggtgtatgtgtgttttataatacctagctctgttcactgaaataggctggcaacatatccactgcgatagcaactagcacatttagcatccatatcttggcttctaaatactggtcttcaccagaaagagagagtttttcttgggaaaatgaccagatttcatagagggagtacattgtatagagggagtacaatatcaagcattttataccagaaagtaaggaagtcctttaaaaaaataatggagtcgtgtcaaaagggcgcaaaaatcatcctgaagaagctcccataagccaaattgggaataatttgaccatcaaagtaaacgatagtaatgtattaccgctcattaaagtacaaaaccgttaagtccatcattatcaaagtaagtgagtaaattgaaaatttggaatgaatgagatatttacatactttcaaatctatcccccacaaaatatttactaatcacaagggggaaaatgaatacattttgaatggagaaacatgccgatgccacctgaactgagtgatcaaagtgaacatcgtcagtgatagcataaatcaaaattacttgtcacccacctgatagaatgcaatgagaaacatctgtgatattcctgtcagatgcatcatctgaatcttatcatgagaaagcacaataaagccaaattgaggcatgttctaccgaataaatggatggtaattttcaaaagtcttagagttttgaaagccagggaaagactaatgaactaatgaaggcatctagagagacatgataactaattgcaatgtgtgtttctgaactggacacttattttgacaatcaaatctgaaaattagagagtagtaatatctcaacatatcaattgcttaataaatacccagagcagagtaagcactcagtttaactatgatgatgacaatgatgacactgacaatgattactgaaggaccgcatgaaaaaatacacctagcaggggtggggggagcggggagggatagcattaggagatatacctaatgtaaatgacaagttaatgggtgcagcacaccaacatggcacatgtatacatatgtaacaaacctgcacgttgtgcacatgtaccctagaacttaaagtataataaatatatatatatatatattaaaaaaaaagaaaaaatacacctatcatctatctactcaatatcctggaattctggaacaggagtgttctggattcatttgcaaaaaaactggttccccaggtctaatcaaattaaattgagaggtaaatttaaattatatgtattttttatccaacagagaaataaaaagcactttgccaaacagttaaacacttgcgacccagataactaaactcttcagacctaggaattctaaaattaaattgctttcatgaaagtaaaaaattcagtcttcttccaacaaccaaagaggaatgaatatgaaaagagaggctgaattgtcccaacactgaagagttgggagcaattcattgaattgtagaactggaagagatagtgtaagtgtgccaggatctttctataatgctagtttggaagactgatccctcattttccaagggaaaaataaatcccagtgtcatagctgcattcctgtgtagatctttgcttaggttttctaaaattcagagctcaaagtatatcatcctttgtatttaaggaagtcttatgggtatcctcacttactcatggtgcaataatattcctgcagattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaacatagtcaaaataaaacatagaaattatggtaaataatttaactggtaaaataatctaagtggtagttctcaggtaagtggaaattcgattagctgattgtttaggattcttggttataagtgacagagacctgactaaaagtacatgaagcacataactgagaaggttgtggtatggctcagcagaaatgggaaaatcttgggactggttcgtgttttatttacattatctttgttcccaggcagtctctgcatgtaagtggcaaagatgactgtctgaaaatatatacctacttttttaaagggctatctcaagccattctggagaagcaccaaaagccactttgcttatactgggagaatagtttgctttccctaatttgtgatgagtgaaacactgaacagagacatagaataatattctgtagttcagggttggtgtaatatggccagtgggcggaatctggtcctcagactgattttgcaaataatcttatagaaacacagcaacacccattcattacatgttgtttatggttgctttggggttacaatggcagagttgagtagttgtgacagagatcactaggctcaccacatctgagatatgtactgactgaccctgtacagaaagtttgctgctcttagaggaatgtgtgtttctagtgtcagcaataaacttcttggatttgttttgttttctcatctttacatgatagttgcagactagttgatccttgtgacctgtttttgaatgccactgtgtattctgtcagggccctctgattctgtttcttatggtgctgaatgcacaatttaatgccctggaatttccttctgtcttctgctaaactcatgcctcttcagatagttaaaatcctgttctaccttagaagtctccagagttattttcctaaattaagaagaactggctttgaagttactcattatgccacacacaatggttgaaaagagcatctcttatgtactgtgtatatttcagcatccactcagcttcttaggtagaaaaggaagagtcttccacagtgtattttatccatatttgggtcagaaactcttctttaccacggagcgtgatggaagaaagatatgggatggtaacagtaggccagggatgtaataatcacaaaatttgagatattttgtgactggtgactcacgcctgtgatcccagcattttgggaggccaaagcgggcggatcacctgaggtcaggagttcaagaccagcttggccaatgtagtgaaacctcatctctactaaaaaaatataaaaattagctgggtgtggtggtgcacacctgtaatcctagctactcaggaggctgaggcaggagaatagcttgaaccaaggaggtggaggttgcagtgagctgagattgtgccaccactgcattccagtctgggtgacagagcgagactctgtctcaaaaaaaaaaaaaaaaaaaatctagaaaaagatctccaagattcaatcatctaattatttcttttaaaaatgagaaaaatgactcctggtcagcttttaccttctttttccaactgtcttgacaatactttcatattgggcttttaaagtctcaagtaataggtttttaaaacctcagctgataaaagtataaaaataaagttaaaacatattaaagacaaaacccaagaatcagcttcctcttccttcattactcttgcatgggtgttggctctaatttctccatctagttaggcagtcctttgctttttattgcttgtttattgatgacatttgccatttgtagcaatagtaatagaatcatctatatatttgtggccttgttgaatgtagaaaaaggatagtggcattttctaattgtgtaaccctataacaccttgacgggggactacagttcatatgctggaccttttgtgtttgttcatggcgggtgggttgctttaatatacttagcacattgtcctaattgccatccttttggggagggctatatatccaagctaatatggtagcatttttgttttaacatagagctgacccaaggtagacgtaagtgttgttcatttttgcctaatactaataaaattacctaattgttgaagcttggagcttgaatctaggcattttatttcatttcaagtacaccctagtattttaaagcataaatatcctactatcctcaacaactttagaacaaaaataaatattttaacaagaaaaaagcatgccatgacaagctgtaacttagtaaagaaagacaaggaatggtctctatagaccgagaaaaaataggtcctcagatatatttataccaaaggaatgttatgaatgtaaaaaacagtttgactcccccccccccgccaaaaaaaaactccacaaccctatattttgttatcacaagactgttttagtgaataaaacagtatgaattggttttacctgtttccatttaatacttattaactttataatcgtatagcctgagggttttaacttcaagtacagcatgatgactataatagttttacacaaggcaaatgtgaaaaacagaagtaatttcttttaaaaagtgtgaaatatctaaaaggtatgacttcaatacatcaactcaggtgagacagacatgtaacttctttttccatgtttaaacctaatattgcttttgtgcctctgaaggctcggagtttccatgccttcttaggacatgccaccctctccacacctggatgtgttcaccaacccagaagctcttggaaccccatcatttggggtttttatggagtccccattaagtaggtatgactgattaaatcactggccattggtggttgactcaatctccagcctctcttccctctctgaaggtgaaggggtgggaaggtgaggctaagttccaaccctcggatcacagggttggttcctctgcaaccaggcttcatcgtgaaacaatacagggcccaccgagagtcaccccattagcaaactcagatgtgattgaaaggggcttattatgaatatcaaaagacatttctctttctcctattactcagacagttacaagggtttcagaagctcttgcaccaggaactgggaacaaagaccaaatatatatgtcttcttctattacaatgtcacaggtgtgacagagtaggtaaatggagtctcagagagtccccagagtattccatggagccacaaaatgaagaataaatggatggttctccccatgatcaaaagtggcctgaaaatacttgagaatgagtcataacttaaaaggctgtatagtagaaaagaatgcacagaggaccgaatgtaaaagaaggcaccccagtctcagctagtgtggatgcatgccagtgtagaaagatgctagtgtggctacattggtgcactgaagaccaaactcctgcatggccccacatccttgataccttagatctatatcatcccctaaaacttaggtgttatgacattcaggatatgctaccccatcattttttaggctgaaggaatttgagaaaacagaagcaggaatgtaattgcccagtgggttcttcctgccctgtgcacagacaaaaccagttcactgagaccatggtattgcagttaagaaagagtttaacaggaggctggccacatggaagaattacagttattacaaattagtctccctgaaggctcagaggtcagggtttttcatggatagttcggtgagcagtggattaggggtaagtgctgctgattggttggggatacaatcataggggtgtggaaaatggtccttgtgtgctgagtcacctctgggtgggaggccatgggacccattgagtcatgagtcacgaggctgggttgggtcagtgtgaaaaacatctcaaaagaccaatcttaggttcaaaataggtgatattacctgtaggagcaattgggaaagttataaattatatgacctcttggccccatgacttctgagcagtaagagatgatagaaactaaacctacattttatcagcactcaggcctcttccataatcctaatcttgtggcctttcgttagtcttataaaggtggtttggtaactgccctcaagcaaggaggggatcagttttagggaggtgctattatcatccttgcttcaaagttaagctgtaaactaaattcctcccataattagcttggcctacacccagaaatgagcaaagacagccagcctgtgatgttagaagcaagatggagttagtcatgttagatttctctcactgtcataatctttgcaagggaggttccaggaaggtcatcctacctttcccctcacccttctcatgtgacacaggtcataaagcctaggaaggattttccgacctttccctgaagcaggtcgtaagaccctcattggggaggtgccatttctagaccaagagaaaaggcacatccttatgtctgaagacacagggacacagagaagaatctgaacaaacaggtcttgctaagttccccccagtttgttttcattagatcatgcccctttattcaatgctgtttctccacaactatccatttcttcatcaagcctagcataaaaaatacaggtttcacggtttctttgggtcttcatttccttataaagtctcctgtaccatgtaaaacttaaataagtttctctgcttttctcttgttgattctgtcctttgttttataaccctcagacatgaacctagtgatgagtgaggggaagataatttattttcctctacagatgcaaaagggaaaagggaacaatccctaaacggaagttatgatccagggatcagaggctcaaaagcaagattaggtttaaatgtagaaaaatacattcctctttcattttagatatcccaaatgcccaaatcaacccagctatttctcagaagtctgtttcccctccaccctctgctcctctgtgtagtgaaactgtctcgtttgggagtaaaatggcctggctttccttactgagtatactctcaagactattgcctattacttttttccattccttcttgagaactacgctttttaaaacaagaattgactccatttatctttttcttttagccttctgctggggtatgccttctctaaagcaatgaataaaaaatgctttagctgaataaatggggcaaggatcaaggagtacaagctaatatttcacaatattatcctgccataaataaaagtatggtttaaatgacaatggtggggttaggagttacaggtcactgaaacaccaccttattcatgctaccagccccttggctttcctgatggcagcagggaagcaacacataggtagaattatgagccaacatcgtgactggagagggattgaaaatcttatttgttgtcttcctagactattacagttatctgttgaaattagactcaattctttggcgaaagtactcatttttaaggtccataataaattgtaactatgtagcctttgttgcatgagtttagtatgagctgattggtgggccacagtgaaaggcagagggaaatggatgttaactaagaggtagaagtccccttgaagttctgaccctgtcactaatgaagtctttatttccgtatttagtaattgccttttttttttttttttgagacagagtcttgctctgtcgccaggatggggtacagtggcacagtatctgctcactgcaacctccgcctcccaggttcaagcagttcccctgcctcagcttcctgaatagctgggactacaggtgtctgccgccatgcctggctaatttttgtatttttagtagagacggggtttcactatgttggccaggatggtctcgatctcctgacctcgtgatctgcccacctcagcctcccaaagctaggattacagacgtgagccaccatgcccggccaactgccttctttatatctcattttaaaaatttataacaaagaagtgggttgattttcaagacctagttgtgttagtttgaatgagatgcatacatttggcaagtctggggtctaagaaaagataaagatctgaatgctgaaaatctagagaattcaggttactgggggataacttaaagtcactagggaattcgggttactggggggataacttaaggtcactagggaattcgggttactggggggataacttaaggtcactagaacccaaatgcagggaagagttgggtgctctttggcaaataaacattcctgacttagcatttttcttaaacccgaacgtgccagctgtttttttgtttttttgtttttttgttttgtgacctcagccaggcttgcgtgtttattcatcacatattctaagctcatatacaactgtgacctgatccagccttcaaggaactcactcttgattttaggaatctttccaccacttcgatttcatcttactcctgaaacagtcagccagaactgtctaattcagtctatacttctgatacaaaactctacccagcaaccactatggttttgttgctttaggtacgtgttagaaagcacccacatcaatttacagaaaatccttaactgaatctctagtcccagaggagtcatattttattatatggtgctttttatttaaagagatcggtttaatagaaattactcaggcatttgaagtgatagctttaaaatgtgggactggggaaaataagaacacttgacctctctccataaaattgaattgttctttaggtttaaagttttgacagacaaagagaaagtgagagcaagtgagggtgaaaatatatccttatttggtaatgagtacccattaagaggacagtatattacatttcatcttcttacttcacattcctgttttaaggatttgtgagcaaagtgctgtgagacctctagagttaagaggctggagataggtagttttgatggtattttaaggagtgctccataatgtgtagtgtctgagtgctgaagcttaatcagcttcaattaaatccaaaacatactgaatagctcctatgtgtctggcattgagctgtgtgccaaagtggtggaaagatgtaagagccactgaggcttagagatgaaaaggatcttggagccactggtttcctgcctgctggagtttcaccatcaaggaccctttcgttattttccttctcccatgcattttattaaaatttttggtttagtaaaccaaattcactaatgggatgttattttcatatcaaagagtataattctgccaatcaaggcttctgatcagcataaaataattaggtttcatactgaatgcacaaattctagtcaaaagcaaagccatttgatgacatgtctgctatgttgccatttgctttaagagaggtaaaggtagcctgacttctgttcactctgtagtacagaatacattgttaacaagtcataggtatgttcttttaggtttctaattactgtcagcctctcatttcagacaggtgatgtgataaggtgaaatgattactatatttagactcaaaagtcctgagtttgagtcctcgtttaacgatctagtccatgagcttcagttttctcacctgttaaatggaaatgatgattatttcctggaaattgcatttccaggttgttttgaatgataaatgatatggtgtatatatcagctgtttgcaaaccagaaaaagctattctatggtaaacacatgcagtgggctgaattgtgtctcccaaaattcatatgttgaagtcctcacccccagggcctcagaatgtgactgtatttggatctagggtcttcaagagataactaagttagaatgaggtcatttgggttgatcctaatccaactgactgatatccttataagacgacgaaatttggatacagaaatacacagaagacagggagaagatggccatctacaagctaaggagagaggcctcagaagaaacacacctgccacaccttgaatttggacttctagccatcagaactgtgggaaaataaatttctgttgtttaagccaggagtcctcaacccccgggctgtggacctgtaccagtcggtggcatgttaaggactgggctccacagcaggaggtgagtggtgggcgagtgagcattactgcctgagctccacctcccgtcagatcagcagtggcattagattctcataggagcacaaaccctattgtaaactgagcacgcaagggatctaggttgtgcgctccttacgagaatctaatgcctgataatctgagattgaacagttttatccccaaaccatcccctccaccacccccgtggtctgtggaaaaattgtcttccacaaaactggtccctggtgccgaaaaggttagggaccagcggctcaagccacccagcctgtggtactttgttacggtagccctggcaaatgaatacaacacgttttagactatgatgttacacatgcagtgtgttgagagccaaagaacccaaatgattcgtggtatctgcccttgaagagtttttaatctttttgggcatgatgaaacatacacatggaaaataaaatagcatataaccaagtgcccaaatcagtaataaatacagttgactccataaacatttaggaaccttctatcccatgtttccacattctatcccagtggcttttgccactaaatttcttcacccactattagactgatgttttcatctttcagtatcagactcaagctttaatctagaaagagggggtggggggataaatgctatactttggaaccagtccggatattttaagtatgtttttaaaaagtataatcctcacaacatgaaagttattagttctatttttcaggtgagaagagttaaggtcaaacagacgaaagctagttagtggagggactggtattccaagcccattctggttaaactaaatcttgtgttctttccactagaaaactgctttttgtcttaattataattttgtgacaaggatgtatagtccattaaggaatatatacaacagaagaagcatttaagtggacttgaggtttgtgaatctgaactagtttctatcgactttcacatcagcagctcctattctggggaaagagaatggaggctgggagtgatcctgacaaaccttgatgtgcaggcttgtggagaaactggattcacacccaggctcgtggagtgtgggagaggctggcctgtcacaatatcaggacagcctctcttaataacactgcagaaggaatcgagggccctgtggtttgcggtcagtgtgcctcttgtgc

SEQ ID NO: 218 - DNA, 63359 bp, Homo sapiens
ttagctgtcattcctacacccattttctagatgaagaaactgaggggctgagaggtaaagtaagactgggattcaaacccagtactcagctaccgtgacatgagatcctatgagatagacatgaatgcctctctatacaaactgtaataatgcaaagaacagtgatgacaaaccagtcccagcagaaaggcatgatgatttcctctgcctttgtgtttggagagtaaacacgtcctcactccacatcgctctgggctggaggtggaggattatggtgcagtgttggggaaagaaaagcttctatgtctccacatcagactcaggcacaccgtcttctttgtgtcttaaataaataaataaataaaacgctggtgcctgtgatcccagcattttgggagcctaaggtcggagggtcacttgaggccaggagtttgagaccagcctgggaaacatggcaaaacctcatctccacaaaaaatacaagaattaacaggtgtggtgacacatgctggtcccagctacttgggaggctgaggtgggaggattacttgagtccaggaggtcaaggctgcagtgagctgtgatcgtgctactgcacctcagcctgggtgacacagcagaatcctgtttcaaaaaaaaaaaaatttttttttttaaatgctaggatatggcattctggaagtccctgccagctatcagccctggggaagagaaggtgggtttccagactgacttaatttcctctgaggggtcacttgttactagaattgtgagggcaggctacatatatattcatgtgtttatttttttttctaagatgtgcttgttataaaatgcaaacattacagaactatgaatgttcgaagtaaacagagactacatttcacccctcttagaagtctcgtgtatgttgaaggctgaggtttagattctctgccgagcactgtgtgactttgcctcttctaaagtggcccctgcctaagggtagggaacaaagtattagtgggtcatattccagaattaagaagatgggtgcttgagtagggaagggtttgtacagatctcatctcaggatggttattagaatcaccagggcagattttttttttctcggctcattgcaacctccgccttctgggttcaagcaattctcctgcctcagcctccagagtagctgggactacaggtgcgcaccaccacgactggctaatttttgtatttttagtagagacagggtttcaccgtgttagccaggatagtctcgatctcttgacctcgtgatctgcccgcctcggcctcccaaaatgctgagattacaggcgtgagccaccgcgccaaaccccagggcagatttttaaaatgcccatgcgctcccccggccaacacccagcaattccgatttaattggtttaaaatcaaacatcttcggcaggtcacagtggctcacgtccgtaatcccagcactttgggaggccgaggcgggtggatcacttgaggtcaggagttcgagaccagcccgaccaacatgatgaaacctcgtctctactaaaaatacaaaattacgccgggtacggtggctcacacctgtaatcccagcactttgggaggccaaggtgggcagatcacctgagttcaggagttcaaaaccagcctggcgaatatggtgaaaccccgtctctactaaaaatacaaaaattagccgggcatgatggcggatgcctgtaatcccagctactcaggaggctgaggcggaagaatagcttgaacccgggaggcggaggttgcagtgagccgagatcgcgccattgcactccagcctgggcaacaagagcgaaactctgtctcaaaaaagcaacaaaaacaacaacaaaaaatcaaacctcttcacgttggcatttgtatgcttttaaatctctctaggtgattctgtgtgcagtgaatgtaaacacactgggttggaggctcaggagagggttgtttctgttctgagtgggttaatatgagtggaagaaagtggcgttttgggtggcaggggtttggggtgaggaaggaaatggaatgtcagtgctcaggcaagaggctgtctggaaatgtggtcggagctgccccctagtgggtaacagaggctgcagcaagactccacttgtctgagccttaggctgggctgcacagagcgcgctgcaataaaccgcgggcgaagtgctgagtgggtgcagagtgtgaagcccttaagtcacgccagcgatgagcccaaattcatcagcttccagccagaggggaagaaagagactgggggaaagtgatggacgctcacctgatggcatgtggcaagatggcagggcagggcctgaggtagcgaggagaccagaatgtgcaaagggcatctgtcatgcacaatgtctccttcaggaggtatttaggagggcgatcctggaaggactgcagagggtctcctgggagatgattgagggatggaaccctgggcatgttttctggtggcgatgccagggcgggagcttgcaggacagcagctatgtgatgatgcagagacaagaggaggtgtgaggcatggcctcggctgttcctgctgattgcccacgtcgagaaagagctgacagggtttcctggcctgctagctgtgcctttgcatccacttggcaagaagtccttccctgggcccagtctttccttcgaggcacaggcacattctgtgcctgctgtggaggcacctgccagacaactgtggacagccacagtctttccacacaacctgggctttcttttctttcttttttttttttttgagatgcagtctccctctgttgcccaggctggagtgcaggggcacgatctcggctcactgcaacctctgcctcccgagttcaagcgattctcctgcctcatcctcctgagtagctgggactacaggcttgcaccacgacgctcacctaatttttgtatttttagtagagacggggttccaccatgttggccagggtggtctcgatatcttggccttgtgatccacccgactcggcctccaaaagtgctaggattacaggcatgagccactgcgcttggccaacctgggctttctgattgctgctggggtatcactgctgatacctctgaggagaaatgtatcaagaaacccaggcttgtccaggggtggtggctcacacctgtaatcccagcactttgggaggcctcggagggcggatcaccttgaggtcaggggttcgagaccagcctggccaacatggtgacaccctgtctctactaaaaatacaaaaataagccgggcatggtggcgggtgcctgtaatcccagctactcaggaggctgaggcaggagaattgctggaacctgggaggcagaggttgcagtgagccaggatcgtgccactgcaccccagcctgggtggcagagtgagactccatctcaaaaaaaaaaaaaaaaaaaggaaaagagaaacccagggtcattcccaaactggaaggccctcccaactcactttgtcctgggactccaaatctggtggccctgggtgtcactttgggccccttttcaggcacctggcaccctgactgaagtataaggcagggctctagtcctcgctggcaccttgacgcagggtcttctgaagagcttgggaccagactcccatgtgagaggagcagtctcttctagaaagtgagcggtcaggaaagtgagtgagagagggatcaaaggaatattgtgggtttgtcagaaccaacagtccacctagaaaaaggagcctaaatgctgagaagacatatcaaaggtgggagataaaatgatagggttttacgtgaaaggtatcctagaacatttgctagaaagcaaagcttgttgcacatctgtccacagaattcatcaagcatcaggccagtgtgtttcagttatcactatgtggcaggcatttcccacacgctgtttaatttccaccagaaacctgcagagaggtggtgtcacagggcaggtaaggaatgggaagctcagaaaggttaagaaatgcacttggctgggtgtggtggctcacgcctgtaatcccagcactttcggaggccgaggctggctgatcacctgaggttgggagctcaaaaccagcctggccaacatggtgaaaccctgtctctactaaaaatgcaaaattagccaggcatggtggcacaagcctgtagtcccagctactcaggaggctgaggcaggagaatcgctcgaatctgggaggtagaggttgcggtgagctgagatcgcgccattgcactccagcctgggcaacaagagcgaaaatccgtcaaaaaaagaaagtaaagaaaagaaaagaaaaagaaatgcactcatagccacaaaggcacctagaggcagagcagaaatccccagtctagggcttctagctgctgcaccacagtccactcacagggagtatgggcactgtgtaggtgttcccctgtactggagccttaagggcttgggatgtattagaaatgtggggagaggccaggcgtgggggctcacgccagtaattccagcaatttgggaggccaaggcgggcagatcacctgaggtcaggagttcaagaccagcctggccaacatggtgaaaccctgactctactaaaaatacaaaaaattagctgggcgtgctgccaggtgcctgtaatcccagctacttgggaggctgaggcaggagaatcacttgaacccaggaggtggaggtcgcagtgagccaagatcacgccagtgtactccagcctgggcgacagacagagcgagactctgtctcaaatttaaaaaaaaagaaagaaaaagaaaagaaatgtggggagagtttcaggaacacctgtttagctctccaaatgcctaagggggaagtagaggctatctgtattgaatatacagccaaaggctggatctttcttcccctcctcctggactgttgttattattatttgtaagtccagccttgaagggcatgtgaaggaggccagagggccaggcaatgccattgattaacttgccttccgggtaggctcccatttattttcagtgtctctaccgaaaactaacacttatcggacaccttctgtatgacaaacactgattttaggcactcacttatttcatgtaatcctccaaaaaccccgaaaagtggatttttttttttttgagacgcagtcttgctctgtcgcccaggctcgagtgcagtggcatgatctcggctcactgcaagctccacctcctgggttcacgccattctcctgcctcagcctcctgagtagctgggactacaggcgccccccaccacacccggctaatttttttgtgtttttagtagagtcggggtttcaccgtgttagccaggatggtctcgatctcctgaccttgtgatccacccacctcggcctcccaaagtgctgggattacaggcgtgaaccactatgcctggcctgaaaagtggatattcttatctttcatttggagagactgagactgagggaagtcaagtaacttgcccaaagtcacacagcaatttttcagagctgggaattccaggtcaggactggctggcctcaatgcttctggtaaatatttcagttctatatacaggctggtggcttccaggaagggaatagaaagggacatttacagagcagttagggttaattctaattccttgtccacttccctccaaggcaccattgccatagcatccttgccaactgtcttagaaagaaattgttttggccatccaggtttcctctataaattggagcagcatctggtcttcacagagagccaggcattccaggagcccataactgagggtctggatgacttctggtttgagcgaccagctggcactggctcccctgggagagagtctgtgggcaaagtctgatctacagatcagccagatattcatttgcccaaattaggagacccaggaaaatagttctgtttataggccccagagatgatcagaatcccgagtctgcacccccttctttagtaccctaaaaatgctgtttccatctgagaaactgcgccatctcaagcatgggtattcatggaactcctggggaagccagggcagtgcaccttgccaggtatccacactgggtgggtgggggcatctctgtctttctatattccacaatgccttctccagaaaccctaagtccaaactgcactgaaaacagaaccctcttttataaatttggcatcaaaactcagtgatggcaaaaaccggaccagaccttacagaatttatttatcgtttttagtgtgaacatgtacataaatgctttgctgagaaatcgaagctgatgggtttgatcatgaggtgctgctgctgcaggacattatgttactgtggtttatgcatcacatcttttttcttaaatccaaaacattctccagtctggctgcacagatgccagttgaggggttgtggccttgttttattaggttggtgcaaaagtcattgcggtttttgccattgaaagtaattacttttggccaggcacggtggctcacacctgtaatcccagcactttgggaggccaaggcgggtggatcacctgaggtcaggagttcgagaccagcctgaccaacaaggtgaaatctcgtccctactaaaaatacaaaaattagctcggtgtggtggcgggcacctgtagtcccagctacgctggaggctgagacaggagaattgcttgaatgcggaaggtggaggtggcagtgagccaatgtcacaccactgcactccagcctgggtgacagagcaagattccatctcaaacgaaagtaattactttcaatggcaaaaactgcaataagtttttgcaccaacctaatataatgcactgtattcaagcaggacagactgtcacccgaccaggaagtaggtggcttcttatattcatgaaccaaacctctccagccctctgtggtcacacttggtgtctggaattccatcaccaggggattcattctttgctgtcttctctgagaggtggataaaaccgggagtcatacttttttttttttttttttttttgagacagagtcttgctctgttgcacaggctggagtgcagtggcacgatctcggctcactgcaacctccacctcccaggttcaagcgattcttctgcttcagcctcctgagtagctgggattacaggtgtgcgccaccgtgcccggctaatttttgtatctttagtagagatggagtttccccatgttggccaggctggtctcaaactcctgacctcaggtgatccacccgcctcggcctcccaaactgctgggattacaggcatgagccactgcgccaggccgggagtcatacttttatgtagattagtccttttggatttttcctctgtgggagaaagcagcttgcagcaagcagatacgctaaggggaggatgatggggcaggattgaggccccagacaaaccgcaggccccgggtaacacagctagtcgggcacacatcctgcagcacaggcccgcggcgctggggagatctacatacggcatggagccaggccgggacgcaggcccgagttagcacggctggcattgctgccactcccttcagggcagggaggacagtcatctagcggccttcggattacacaaaccctttccttggcgggggtctcccagggtggtcaggtccggaccaggcagaggccttgcacctgtgcttcccagccccccagttttgcgcgggaactgcaggtgccaaacccggaggcagcaaaagtgctgcccaaacggggatggagccacccggggcgggagaggccgggggcatctaaggccgtgtagctcccatgtttagaggctcccagttatttacaaatgaataaaggccagaggacacgcgtttgggtcaacttaaaggtgcgcgtgcagtgttctgtgacctccgtgggatgcgaggctggcgggccggagcgcccctgccggggattggccggccgcgctccgccgcagactccgcgccgccgggcgctcacttcgccacctgacggcaacggcgggaaccgcaggagcgcgcggaccaccccccacccacttcccccgagccccgccggccccagctcccgctccccaggaagcgaagggttaagctgtcagcggcgcgatgttaaacaggtgtcaaaggcgccccatatatctgcagattgaaatcaaattcttcgccgtataaaaagataaattacccaggcgctgccgagcgtcccactcatcacgccagcgccagacggcaagcaatttttttttaatgtgctaacgacctaatcaagcaatcaagtcggaggagattgcagcgtgacccgggcagccatctgccgccgagcccgcatgcatttccgcgccgcgcggggcgggggccgcgaggggctgccggggggaagggggaaaatcctaaacaaattaacacccaattttccccgtctaattagttaaatgagaagagttgggggtccccggggaagcgggggcgctcgcgacgaggcgagtgctgcctccccagcattaattagtgcgggtcaatgccgcggctcccgggagagcagccgctttaatttcccgtggtatttcagtgcctgaggcccatcgattcaaactgaaattaacttatttttcaatcagcccagggctgcccctgggggtgactcttcttttgccgcctcctgaatagagctggagcaatttttcattaaaagctgatacctctgccgcgggggagggggcccggagggaagggcggcgccggcccagacccaggcaaggaaatcgggaggaaatgaacagatttcccaagcccgcctcggtcctcccctcccgactccctcgacttccctggggcgactcgctgcccccggggtctgagcctttaaggactgtgaggggcgagaagggaaccgccaggcttggggcgcaccattaccccgcgggcctggacctccttggcggacaatgcgaggggctcccggctctgtcagctgcgggaaatctccggaaagctgctctgggggaccaagaaatgttccctcctcaaacttggcagggattctgggatcctagaatgggctagagtgctgcagacaccccagggtaccccactgtcattcagaccctgcaccaatcagctttggggccagagacacattcgctagtgcttcctccgcccccactccctcccaggtccctcctcccatttgctcctcaaccctggagaatgttatcttcatccctggtccagctccccaaatactattcagagttaggctcggagctgtggggagcaggtacctggagggcacatgtggtttggcagagcttagctgggacagggtggaggaggcaggctgacccaggcctccgaggggagtctccctccctgagttcccagccttcctgatacctgggtgaagtgcccctaagactgtcccctgccctttgtccctgatccctcactcacctgcagccctcctggatggttgtgactctgggcttctggcagagaggaagccctgagccagagacactgctagtccagtgctgggaaaggaatttgtccctctgcaaatcagaaaaaaagatttatatgctggaggtgtgaacacatgcaagagagccatcagtggcagggcaggcttctcagctgcaaacagtcgatgacactgggtcctgcgcacctgcaagaccctgtccaggaagcatccataccccatctccctagaactacccatgatattctcataagactgatgtcctccttctgaatactccctgagcctggaggaacacagagggcaccatggagtaggcgagcttaggttaaggacgccctgctggagaaatcttcactccaagcctacaaggggtaagggccttgggcccagcacctctcagagcaagcctctgacctgttctgtgcacctgcaggtctggttccagaaccgtcgagccaagtggaggaagcgggagaagtgctggggccggagcagtgtcatggcggagtatgggctctacggggccatggtgcggcactccatccccctgcccgagtccatcctcaagtcagccaaggatggcatcatggactcctgtgccccgtggctactgggtaagagcccgcaccctccttggggtcctgccctgcggtgaggagagcgggctccttggaggaggggacagagccttgaggcaggggcacttgggccacagcagcctagcaggagagaaattcttcaaagcaaacctcttggtctatcctgggggactcagagcagggtgggcctggggcctggtgtctgtcacttgcactgggtgccaagaactctcatcatgaacgagtccctaactgtggattattttgtcctgtgagaacagtgtggctgttggcctggggtctgtaccctcctctccccttggccagaggtgggtttatattgaacaaaacagtcttccctgggggttgagagaacccctaggtccctctggctgccattctgcttagcccaaaggacttctgtcccccaaatctctctacttgctatcttccccacctgccaacttccccacctgccctctgggcctatatctgagaacagcaccagctcctcttggggttctaagatccggaatcccatgggggagggacaggggagcatgtgctgtggcctggaagggacagaacaggccacccgaggcccaggtgcccagggctttggcagggggaggtcctccacagggctggcgacccatctccccattccctgaccctggtccagccctgggacttgtgtgactgcggtgtggggagtaaggctttctgctcgtccttaattctggcctctctctatctttgccgttttcagttcaagatggctttcccaggcgcttttctaaacccgaataccaacaattctttctagggatgcacaaaaagtcgctggaggcagcagccgagtcggggaggaagcccgagggggaacgccaggccctgcccaagctcgacaagatggagcaggacgagcggggccccgacgctcaggcggccatctcccaggaggaactgagggagaacagcattgcggtgctccgggccaaagctcaggagcacagcaccaaagtgctggggactgtgtctgggccggacagcctggcccggagtaccgagaagccagaggaggaggaggccatggatgaagacaggccggcggagaggctcagtccaccgcagctggaggacatggcttaggtcaaggcgcgctcagatgccggagccccaagactctgctctcctcgggccctgtggtgctgggagatgctctctgaggcaaggcccagacctggcctctgccatcctccctgttccccacaggtcctccatcacccctggtggctgcaggcaccgctgggttctgactctggaccatgctgagacatccctcatctagtcttgacctctccagcatcccagcctcagaagccttcttgctgcccacaacgtcccctcaagccccttctctcaatccctttgcaacgctcactggttttggccaccccttgctctctgttctcttgctttaaagagtcctccttcccagctctacattctgctctgcccatgcctaaagcccattgctgcaaatgcattgtgaattgcctgccatggctgtgacacagacggaggactggaactgcaactccagcgtcctcagcaccccactcctcagtaaaagtcttctcccaactcagcctgttccttcctgcagacctggctgggcctgggcttccacagtgtgaagacactgtgcaggcccaggcaggcccagcctctgccccacccatcagtggagtccagatggcaggctacagttgggaagtctcagcctgggcccctcagccacccttggtctcatgccccgccatggtcaccctcaggaacccaccctctccacacccagcctgtcccactggctcctcccagcacaggcacctatgtggcatgtggtgatgtacgctgcgtgccatgagtccatgtcctatgcctcacaaatgctgtggttcactgcactgttcaggagtccaaaccttctaccctgggtcctcgggcccctgagcctgtgtcctgaagaatctcgactctcgtgatatgctgcttgtgaccttgacttgccatgaaggcacctgcccccacagctccttgcaaactatgagttcacatgtgccctgccttgaacaacccaatctggctggtaaatgacatctacgaagccacaggcctggcctcaactgagaagccaagcctggagtaggcctggggctatgcatacgcattaagggcctgctggagaaaccttcactccagacagacagggggctaaggggctagggctgagcacctctcagagcaagcctttgacctgttcagaaggatgggaaaaaggctggaaggaaagcaaggcagaaggccaggagtaagcccaagctaagctgcaggcacacacgccttcatgccagtgcatgccaggaagcacgttcactagactaaaacacggtaaccatgatggaataaggagctggggcttctttctgctggctgatgggtggacctgtgtatggtgacctctccggcctggccttttccattcgcatgaacaatgggagcacatagccctgttgacctgcccgatccagattcccaggccaggctcccgaccccatccacctatccaccaccccacccacctttgcagggaatacctcgttagagaatggcctgagacagtgcgttgcaactttttaattccatatcaaaagttgatttcttcttcattccatttatggaacttccctccccctagtccggttcttcttgtctttgtccctgttggtttgaagtgttagactatagcccctggtgtgtaaataatgtacatagagtgagaagaaagaaacttgatattgaggtgtttgaaatatggaactgtaataacttctaggtattcgaaacctgtgatttctgtgccattttctgtaaagatacaagtaagaataaaattgacttaaaaatagtaggggagaaatccaggagtccactgtgggtggggaatggtttgtgttccgtgtgtatgggtggcataaaaagtaaatctacggctgggtgcgatggctcatgcctgtaatctcagcactttgggaggcctaggtgggcagatcacttgaggtcaggagttcgagaccagcctggctaacatggtgaaaccctgtgtctactaaaaatataaaaagtagccaggggtggaggcacactcctgtaatcccagctactcaggaggctgaggcagggggattgcttaaacccgggaggttgagggtgcagtgagctgagatcatgccattgcactccaacctgggcaacagagcaagaccctgtctcgaaaaaaaaaagtaaatctacaagttgatattttaggtcaaaattactgggttccttttttaaaaaattactctaattgtagaggtacaagtggcctacgtctctccactgagccgataccacccttcaatgacattcgtcactgtgacatgggattggcctccatgatcgacacaacctaaatgtcccaacgatccatagttcttacctctgactccctcctactccccacatagtagtcggcatttgcctctctccttggtactgacttactgataaccctgtttcctactgccctctgcggaagctcacagcccaccttggcccccaagagaactcccttccttttgtgcacacctgtgcccttccacatcttaccctcaacctaaacaacaacaaacgaaagaggtaacagtatctggagttgaaagccagacagattatgctaaatccgtgtcaaagggaaggagagtcaaagagaaacagctcgaggaagaccatatgaaattgtctactgacagctgtgacccaccgacttgatgatgtgatggatggaattacgagatgagagagcggggtgagcagatgagataggctgtatttgagatttgggcccaagaaatctcgtaagattgtttcaaattggcttagatgtgaactccctcgtggatgaggtttctggcagcccatcagcgaaggagaatgacaggaggtcagcagtcctaataccctggattggacccagatgtggtcctcgcagaccaggaccctgaggggcacatgtgggaaatctccagctcctgtgtggggatgggaaagagccatgagcctggcttcaagtcctgccgtgccaggctgctcccaggccttccccggcatgtcagctcctgcaggattcatcctcggtctgggaatgtctttctccaaccctccaggaagtaaaccacttgtcaaccttccagtcccctcccctccgaagccctcctgaccttccaggaagagtgtatttatttgctgatttatttatttttgagacagggtcctgctgttgctcaggctggagtgcagtgttgtgatcatggctcactgcagccttgagctctcagatcaaggtgccctcccaactcagcctgccgagtagctgggactacaggtgtgcatcatgctggctgatttttagtagagatgaggtctcactatgttgcccaggctggtcttgaactcctgggcttaagcaatcctcccacttcagcctcccaaagtgctgggattacaggaatgagccactgcgcccagccagcaagtttataacctctgttctctgacagcacttgggacattcctgattatggcattttccacgttgtgttgtaatttttttttttttttggagatggagtctcactctgtcgcctaggccggagtgcagaggcaggatctcggctcactgcaacctccgcctgctgggttcaaggaattctcctgcctcagcctcctgagtagctgggattataggtgcgtgccaccatgctgagctaatttttgtatttttagtagggacagggtttcaccatgttggtcaggctggtcaggctggtcttgaactcctgacctcgtgatctgcctgccttagcctcccgaagtactgggattatgtaatttttttatttacaagtctatctttcccataagacggatttcttcaagggtggcactacatcttcttcttcttttatcccaggacccatcaaagggcctgaccctcaatccattattgaatgcacagatgaatgttctgcctataattcatcatttattcaataatttaaaaataatgactgagcatttaatatgtatcaggcagtggggcaaggcactggggatatagtagtaggcaaagcagtcccagattccctgttttttttttttctttttgagacagagtcttactctgtcacccaggccagagtgcagtggcacaatctcggctcactgcaaccttcgcctcctgggttcaagcaattctacttcagcctcctgagtagctgggattacaggcatatgccaccacatctggctaaatttttgtatttttcatagagatggggtctcgaactcctgacctcaaatgatctgcctgccttagccttccaaagtgctgggattataggtgtaagccaccgcgcctggccccaagttccctgttctcatggcacttacagtctggagggaaagacagcatttaagtaaccatacaaataaaatataaaattgcaaatgtcctgtgaacttggaggcatgctgtaagaaaccgtgaaagcatctaataggatgacctgaccatctgtgggccttgggccggggtgtttaccctctctctgtgttataaaatggaagagtaacatctgctccgcccgttgtggcgtagagtatccaggaagaagcgaggacgtggagaaaggcaccgtacagcacaaaggaaaggtggaggggccaacgcaagcctctcaagcccagggggcatccttggcagctgccccaccctcgggtaggcctaggggacaactgggacactcagagccttgggagatagcagaaatcctcttggacgatcacctcaggggatttgcccggaggagaagcaagcagctctctgcacaaggaaatgcaaataggtttacaagtaatcgatgaggggagaggctggacaggaaaggaaggcctggatggccaggcccaaatgaggcagaacaaagagagaagtcctgttaggtgggattgtaccccaggagtgtcttcttccctctgaccctgacacctggctcctggaagggagattttattccaggttctgctgggctaacaggctgccaagagatggctgcgtgccccaagaagagcagcagagagctacaggggcaggaggggctggttcatgaggattgcgggtgctggtgagcaggcctggcagggaaagatgaggaggagtctggctgggagtgggagagtggcaagcagggctggtgacagtgggggagtttctgaggccagtcctatggcctggagagagcagctgctgcaagaaagagggactcgatctcagggatcgctgggaccttggtcccagcctcctgctggccctccagcctcttgtgtctcctgcacccaacagctcactggggccttgaagtctttctcctactgcagtgccttccccacctctcttcagagtgtggagctgaggcagcctggcccatcaatttcaacagaggtaccatactaatatcgatgtcaataagaggcaacgctgggtgagggggtgtcttagtctattttgtgtggctataacagaataccatggactgagtaatttataaagaaaagagagactggtgtggtggctcacacctgtaatcccagcactttgggaggctgaggtgggtagatcacttgtggccaggagttcgagaccagcctggccaacatggtgaaaccccatttctaggaaaaatacaaaaattagcttggcgtggtgtatgcctatagtcccagctactcaggaggctgaggcacaagacttgagcttgggaggcagaggttgcagtgaaccaagattgcaccactgcactctagcctcggcaatggagccagaccccagctcaaaaaaaaaaaaaaagaaaagaaaagaaaagaaatttatttcttacagttctggaggctggaaagtccaaggttgagggactgcatctggtgagtgtcttcttgctgcgtcacaacatggtgggagataaaagggcacaagagcatgtgttagagaacaagagggggccgactttgcttttataacaggcctactaccatgataatgttaatccattctcccttatgacctcatcagctattaggacccacctactaacactgtcgcactgcagattgtgtttccaacacatgaacgtggaggaacacattcaaactacagcagggggttatgaggtctctgtactatggacctggaaactctgtactatcttcacaattttttttgtaaatctaaaattgtaaaaataaagcttacttttaggccgggtgtggtggttcacgcctgtaatcccagcactttggaaggctgaagcaggtggatcatttgaggtcaggagtttgagaccagcctgggcaacacggcaaaaccctgtctctactaaaaatacaaaaattagctgggcgtggtggccggtgcctgtaatcccaattatttgggaggctgaggcgggagaatcccttgaacccgggaggcagaggttgcagtgagccaagatcgtgctactgcactccagcctgggcgatggagtaagactctgtctcaaaaaaaaaagtttattttttaaaacaaactagtttgttttctagagggaaaacaacagagggcttctttgggttggaacaagtgccagggctctccctctccctgtctcttaccccccagtgctccatttaccaagtatcccagttggtcccccagggcccccaagacctaccctctggggaaccaagctggagtcaagagcccctggccctggccggccctgtctcctggagcttcctcccccccatttcttctttaggtctccctgttgtccccacctccctcctggctgctgctcaactcaggcagcaatgaagtcagggaagtctctgcttagtcacagctaagcaggcccagcagtgatttgctctattaattcctcactccagatcaatcccacccaatgctgactattttcattgattgttggcctcctcccctcccccactccttgctgctgagccaaggacccctcccatttatctccgtggctctgttcctcatgaggcagagcccggctgcggacctcagggagtctctgtcacaggaaggggtcaaagaatgaggaggtggccttctgttagttgcagaattgcttgagctgctcaccaggctgatattcactcacccctttgcttggtgttgaggccagagaaaaggtggttgaccagggggacaatagtgggctcagaggtgagaggaaagaggaggaaacattcaccatttcctccacacagcctcagtgagggtagaccagaacagtttttacccgctcagatgcagaaacaaattattaaaaggcaaatctatgctcagccaacaaagagcttcgcagccatcaaagagatgattacacgaattagattgatgaatatatttatgaaaaagaaaacattaaggctgagctgggaccagtggctcacacctgtaatcccagcactttgggaggccgaggtgggtggatcattttagcccaggagtttgagaccagcctggccaacgtggtgaaaccccctgtctcttctaaaaaataccaaaaatagccgggtgtggtggtgtgtgcctgtagtcccagttacttgcgaggctgaggctggggactcacttgaacccgggatgtggaggttgcagtgagctgagattgtgtcaccacactccatcctgggtgacagaacaagactgtgaaaaaagaaagaagaaaagaaggcaggcagaaaagaaaaagggaaaggggaaggggaagggaaggaaaggaagaaattaaggctgggcatggtgactcacaactgtaattccagcccactgggaggctgaggtgggaggatccctagagttcaggagtttgagaccagcctgggcaacatagggagactccgtctcaaaaagaaaaaaaaaaaaaaaaggaaaggaaagattaagacaagtctgagcttaacagcaacagatataggaggatgttcaaaggaccaaaggacaacagcattctctaacaggagcgcttctttctcctccaccccacatttctgtctcccacagtgtcccgtgattcaggagtcagtccatgcatggtttccatgcagaaggcacaagtttttaggaagggaggggcagagtaccgtgaaaggtgaagacttcccaatagccctccctcatccgggaccattcctatatggaaaagtgcaaggcgccgtggcccagggaagacaacccgtgatgagaagagtgtgacctaaaaatggaaagaacatcagagtggatctagaagacctgagtttaagtgcagtctccactgctctcttttttttttttttttttttttttttttgagacggagtctccctgtcacctaggctggagtgcaggggtgcgatctcggctcattgcaacatctgcctcctgggttcaagcaattctgccttagcctcccaagtagctgggaatacaagtgcatgctgccacttattttaatagagatgaggtttcaccgtgttgcccaggctggtcttgaactcctgagttcaggcaatctgtccgccttggcctcccaaagtgctaggatttcaggcgtgagccaccgtgcctggcctttactactttcttaacttcctcaagtattggtatgctcaggcataaaactgcagtcctaacagtcctgcacagcactgttgtgaagcccaatgagatgaggtggtttgcactaaactttatttctccttgagtcagttttattttgctgttatttaaaaaatttttcctaccttgtatcttttttgggggagagtgggcttttgctagcttcttaaacacttatctcattctttctaaatctttattatttactaatacagatattaaaaatcatacatttctttttttttttttttgagaacgtcttgctttgtcgcctaagctgcagtgcagtggtgtgaacatggctcactgcaatctccatctcccaggctcaagtgatcctcccacctcagcctgaccagtagctgggatcacaggtgtgcacaaccatgcctggctaatttttgtatttttttcagtagagacagggtttcaccacgttgcccaggctggtctcgaactcctgagctcaagcgatctgcctttcttggcctcccaaagtgctgggattacagctgtgaaccacagtgcctggccttaaaaatcatacatgtctaagttttattagagttgcatcccaaaagactgcacagagttttcacttattttctgtttcacatatttattaaatcccatttttaagcttctgaatgttttgaaatttccaagctctaggatttttgtgagggaagtgattctattattgccttctaattttttttttttttttttttttttggagacagagtctcactctgtcacccaggctggagtgcagtggcgtgatctcagctcactgcaacctccacctcccaggttcaagcgattctcatgcttcagcctcccgagcagctgggattacaggagcctgccaccacgcccagctaatttttgtatttttagtagagatgggttttgtcatgttcgccaggctggtcttgaactcctgacctcagatgattcacttgcctcggcttcccaaagtgctgggattacaggcgtgagtcactgtgcttggtctaattttattacactatgatcagagatcatggttcatcatcttgctcttttgatatactgagacttggttagggctagcatgtggttaattttcataaatattccatttgtgattaaacatgttttttctaattttgggaaattagagtttaaaatcttctgctttgtggatttgccaattttgccttgtaattttgctttttgtttgttgcatattttactctcatagcatactgtctgcttgtgtgttttgttattgaccacaacgagcttttctccttctctttttctgtgtgaatacttccattgtttaagtgttcgttccagtcctcaccatgaggtcggctcttttgtccccaagtggacatttaaaatgcaagtcccggccaggggtggtggctcatgcctgtaatcccaggactttgggaggccgaggcgggtggatcacctgaggtcaggagttcgagaccagcctgatcaacatggtgaaaccccatctctactaaaaatacaaaaaattagccaggcatggtggcgggtgcctgtaatcccagctactcaggaggctgagacaggacaactgcttgaacctgggaggcggaggttgcagtgagctgagatcatgccactgcactccagcttgggtgacagagagagactccatctcaaaaaaaaaaaaattaatttaaattaatttaaaaaataaaatgcaagtcctaagggctgggcacagtggctcacacctgtaatcctagcactttgggaggccaaagtgggtggatcacttgagccttggagtttgagagaagcctgagcaacatagcaaaactccaaatccacaaaaaatacaaaattacaaaatcacttgaacctaggaggttgaagctgcagtaagtcatgattgcaccactgtactccagcctgggcaacatagcaagaccccatctcataaataaataaaatgcaagtgctagtcaaccttctgactctgactgtcatacctgggattccctttcttgtttcctattccagtcatgcgtgaaacttgtttttgttatattttgttcacctctagatgttcttaatcagaattgtttaccagcccactccaccattgtcctagaagctcctttgtaaactataaagggctgtgaaatgggaacaacatgttaccactcaagcctttggcttcttggtatccttccctatggctggtggtcactgccccactcagttccctgttgggacatttcccccggtcctgacgtcagttatctttttggatttgttttgcctggttcttatcaatcccttctggccaagaggcttccgtaaacgctctggggtctctgaaccaaacatttagcctccctgggccatggttctgcgtctctcctgtaactggcaccttcctcttcatctctgccctctgcctttagaagcgtcaagtaagcattggaggagcgagcgagtgagtggttaggcagagagacaatgaaaattttttttttgtttgagacagagtctcgctctgttgcccaggatggagtgcagtggcgcgatctcggctcactgcagcctctgcctcccaggttcaagcgcccagccgaaaatattaaatgtattttcttccagtcttttgttccaggctaggtgcaatgatagctggaagaatgaaagttctcccaaaggcacatagaccatacagttggtaggatagtcagggagtcaggtagaaataaagggaaggactcttttagtagtactttaaaaaatacttgccgggtgcagtggcttacacctgtaatcccagcactttgtgaggctgaggcaggaggatcagttgaggtcaggagttcaagaccagcctggtcaacgtggtgaaaccccgtctctattaaaaataaaaaaattagttgagcgtagtggcgcatgcctgtaattccagctactcgggaggctgaagtaggagaatccctggaacctaggaggtggaggctgcagggagccaagatggtgccactgcactccagcctgggagacggagcaagactcttatctcaacaccaacaacaacaacacaaaactcttagccgggggtggtggctcacgcctataatcccagcactttgggcggccaaggcgggcagatcccctgaagttgggagttccagaccagcctgaccaacatggagaaaccctgtctctactaaaaatgcaaaattagccaggtgtggtggcgcatgcctgtaatcccagctactcgggaggctgaggcaggagaattgcttgaacccaggaggtggaggttgtggtgagccaagatcacgccattgcactccagcctgggcaacaagagtgaaactccgcctcaagacaaaaacaaaaacaaatccagttcactacattttattattcactctgtatctctactattacttttttttttttttgagatagggtcttcctctgtcacctggagtgcagtggtgtgatcatggctcactgtggcctcagcctcctgggttcaagtgatcctctcacctcagcctcccaagcacctgggactacagacgtgcaccaccatgcccagataatattttttaatttttttatagagacagggtctcactatgttgcccaggctggtctcaaactcctgggctcaagtgatcctcctaccttggcctcccaaagtgctgggattacaggcataacccccgcttgcctggcctatttttgcatttttttctaaaccatttgatagtaagttggggacatgataccccattaccacttaatacttctgtgtatatttccttaaaatgaggatactctcccacacaaccaaatacgactaacaaaatcaagaaattgacattgatttgtccagaagggtgttaaatactatcaactagtccacagaaccctgatcattccaaaaacgtcctttatcaactgtgatctgatccaggactgcacgctgaattgagtgacccagtctctgtagtctcctccaatccataactgccttctgtgaccttgacgttcttgatgatttctggccagttactttatagaatgtcctcaatttgggttttgatatttcctcataagactcaggttgcatacctgaatctgcatttttggagaaaattccatggaactggttctccattctcagtgcatcatatcaggaagcacaccatgttgttccattcctggtgatgttaatgtttatcattcgattaagatggtacctgctagccaggtgcagtggctcatgtgcctgtgatcccaggactttgggaggccaaggaggggcatatggcttgagctcgagaattcaagaccagcctgggcaacatggcaaaactctgtctctacaaaaaatacaaaaattagctgggtgcagtgatgtgtgcctgtagtcccagcttctcgggaggctgaggcaggagaatcgcttgagcccaggagggggaggttgcagtgagccaagattgtgtcattgcactctaacctgggcaatgggagtgaaaccctgtctcaaaaccaaaaccaaaacaaaaaaagatagtacctgcaggtttttccattgtaaagttaatgagtatcatgtacttattaacaagtattttgtgggatgatgctttgagactatataaatatcttattcctcatcaaactttaatccactacttttaacatctgttggttcctcttgtctggctttttagtggagaatggtatttaggtaccaaaatctaggcacaaggtatgcttactgttattgtggtacagttgcttctaggccttctcaggggacagagttgggaaaacacactgtatagtgcttacaggtgcactttattattctttttaaattttttaaaatgttactatttttttgagacagtctcttgtactgctcaggctgtagtgcagtggtgggatgaggcttactgcagcctcaacctcccaggctcaagtgatcctctcacctcagccctgccaagtagctgggactacaggtgtgtgccaccacacccagctaattttaaaattttttgtaggaaaagaaaaatatttaaattttttgtagctcaatatgttgcccagactagtcttgaactcttggcctcaagcaatcctcctgtcttagcctcccaaagtgctgggattacaggcatgagccactgtgcccggccacagatgcattttgaatatcctggcatgaaagacttcccagaccccttttctctgactggaggggtccagggtactttgatgtccccaagcacatgtagctaatacctcactcacacccctggaatgaacctttgaaataagcaagaattaggctttctctagtttcaagtccagcctgccccccactataagccacacacccttgcactagctactgcttttgtaaatgggtttgggacagtttttaataaaggcagcatgtgctagaaccctaaccaacgatttatcaacatggacactagactgtctactcttctaagtgctaggggtatagcagtagcagtctagatttcaaacacaatcaacttacagtgggggtggggggtatagttattccagaaaacctaggctaaagccagatgctgcaatagacagtaggatttggttttgatcctcccaggagactgggtgaagtggaagcatgctgatgacttagcatacttccaactgagtgctgagtaacagaaggcagagctatcagccagagagcattctgggcttctgcctatattagtccgtgactgcatagtggatgtgtgtccagagttaaccatagccctgtgaggccactggctgcatgtggctccctggccgtggtacatcaggattagaggggtgtgatgatggccacccccgtctgtaactaaagggaaaccagactcctctggtggttctatctgcctggtggggtgcagagagggctgtggttgagcttggtggcatggtgccaggtcccctgggacagcaccatcttttccactggaagggggagacagatggtaggaggagtgtactctgtggctatgctaggaatggaaagtgctcacccacctgaccacccctggcaaagctgggggccaggcccactcttctctggaagctgcggtttggctagcgagtagggacagatgtcaagaatgtggacagactggctgggcgcagtggctcacacctgtaatcccagcactttgggaggccgaggtgagcggatcacttgaggtgaggagttcaagaccagcctggccaacatagcgaaaccccatctctactaaaaacacaaaaattagctgggtgtggtggcgcctgcctgtaatcccagctacttgggaggctgaggtgagagaatcgcatgaacccgggaggtggatgttgcagtgagccaagatcatgccactgcactccagcctgaataatagagtgagactctgtatcaaaaaaaaaaaaaattacaggaagaatgtgggcagacagagtgagcagtgtgtgagaagacaccctgggctgggaggactggcgtcagggagaggccctggggtacctcctgagcagaagggcaagggtgatccatgtgtccctagatggggagggcctcccccagactctctaggcctgccttgggggagccggtcagaccattttgttttttttttttttgagacggagttttgcttttgttgcccaggctggagtgcaatggcgagatctcggctcaccacaatctccacctcccgaactcccgacctcaggtgatttgcctgcctcagcctcccaaagtgctggaattacaggcatgagccactgcgcccggctggtcagacatttattgagagctccctatgcctgaggctccttgctagccccatgtttgacgaccaggtctgctgctgccaggacagctagagtggggctggagtttggggtatagaagtgggcaagggcagacacgggagcctagacccctgcaggggtgccacaggagggtagcatgggaggaaaggccaggcctctgactccactgctcactcacctgtcccagcgccatctcctcattctgggctcctgtctggaccagtgcctggagaattctgtcagcctcaagactttccctgccagaggctgttggtggctacattcagcttaccatgctggcttggtacctggagtgctaggcctgacttcttcttgcccagttcaagcacctagaggccactggggtagagtaagaggatgaagaggactggggtgggtgtgcgggaatgtgtggggaggggcctggggctgggccaccctgggacgagcggtgttggacaggagcagagagtaagctcggagcactcatttggtgggctgcagactgagaagacttgctgggggcagagttcttgggctgggactgcttttttttttttttttttttttccgagacagagtcttgctctgttgcccaggctggtgtgcagtggcgtgatcccagctcactgcaacctccgcctcctgggttcaagcaattctcctgcctcagccttctgagtagctagaattacaggcacacgccaccatgcctagctaatttttgtgattttagtacagacggggtttcaccatgttggtcagaatggtctcgatctcctgaccttgtgatccacctgcctcggcctcccagaatgctgggagtacaggcgtgagccaccacaccgggccaggactgttcttaaagcagtaggatgctttttttttttttttgagatggagttccactcttgttgcccaggctagagtgcagtcgtgcaatctcggctcactgcaacttctgcctcccaggttcaagtgattctcctgcctcagcctctcaagtagctacaattacaggcatgcaccaccacgcctagttttgtatttttagtagatgggatttcaccatgttggtcaggctggtctcaaactgctaacctcaagtgatccacccgccttggcctcccaaagtgctgggattacaggcgtgagccaccatgtccagcctgcagtgggatgctttctgtctttgaaaaggcacatggaatccaatcatgctggcaaacctttctcctcttccagctccagtgccagttctgacaccaggtccagagctagggccagatccggtgtcagctctaccatcagcttcagcacaagctgtagagagtgagccagttctagcaccagctccagagctagaaccagttgttgtgccaactccagagctacattcaacttcaggagccagctccagatccagtgctatctccagagctagagtcagctctaaagctggagtcagctccaaagctagagcctgctccggctcctatgccagtgtcaacattagtaccagcactagctccagctctagagctacagacagctctgcacctactccagcaccaactctggcatccactcgtgagctatagccagatttagtgccagctccagagccagaagcaggttcagcaccaacgctggcactaaaggaagttctaggtccagagctagtgccagctccagcaccagcagcacagctagagccagctccatcactagctccagcaccagatgagaagctagagccagctctagcaccagctccagagcctaggccaggtgaagtgccagctttggcaccacctccagagctaaagccagtgctagctctagaactagctccatcacctgttccagagcttaagccagttgtagtgccagccacagagctatattcagctttggtgtcagctctagagctagagtcagctccaatggcagctttgaagctagagcctgctcctgctctagcaccagccctagatccagctccagagctagacagttctgacacctagtctagcactagcagtagagccagtgccagcaccagctacaaagcaggagctagctccagcacccaccacagcactcatccccaagctaaagccagaatgagtgccagctgcagagctagaagcggcttcagcaccaaatccagtgatagagccagtgccagttcatctgttgatggacatttttgagctgtttccactttctggttattgtgaatagtgctgttatgaacactcctataaaagtattggttggggtacccatccttggttcttttgagatatgcctgaatggaactgccaggtcatatggtagttattttactttttgaggaactaccagaatgttttccatagtggctgcaccattttacatttctgccagtaatgtacaaaggttccaatttttttttttttgagacggagtcttgctatgttgcccaggctggagtgcagtggtgcgatattggctcactgcaacctctgcctcccaggttcaagcgattctcatgcctcagtctcccgggtagctgggactacaggtgtgtgccaccactctgtgctaatttttgtatttttagtagagacagggtttcaccatgttggccagactggtcttgaactcctgaactcaggtgacccacccgtcttggcctcccaaagtgctgggattacagatgtgggccaccatgcccagatccaattttctatttcctcatcagcacttgttattttctgttttttaaattatagccaccctagtgggtatgaaatatctcactgtggtttttatttgcatttccctcatgactaatgatgttgatcatctttttgtatgcttgttggccatttatatatcttctttggagaaatgtccatttttaaattggattgtctttttattgttgagttgtaagagttctttaaatatttgggatactagactcttatcagatttctgatttgcaaatattttctacctttcactctcgagaagttctggctgttacttcctcaaatattcttccttccccttcctcttctcttcttccaagagtcccacagtctcaggatgttgttccacttgacggtgtctcacaatcacttagattctgcttactttctttcattctgctccttagactggagactttcaatcatcctgtcttcaggttcgctggttcttttttttccgcttgttctcatcggctgtagaacccctctagtgaattttttatttcagttgctatacttttcaggtccagctctactggattcctttattccttttgtttgtttgtttttttttttagatggagttttgcccaggctggagtgcagtggtgcgatcttggctcagtgcaacctctgccttccagattcaagcaattctccctcctcagcctcccgagtagctgggattacaggagcccaccaccacacccagctaactttttgtatttttagtagagacggggttttgccatgttggccaggctgatcttgaactactgacctcaggtgatccacccaccttggcctcccaaaatgctatgacttcaaacgtgagccactgtgtctggcctgaattcctttttataatttctgtctctttcttgatattcattttgtacctcatttttctgttttcctttagttctttgcccgtgctttccatgagctctttgagcacatttaaatgtctaggcttccttagaaacaggttctgtcaacttttttcctcttgaatggaccatcatttcttatttctttgtataatttgtgaggttctacttgttattgaaaactagacatttgaaggccaggcgtggtggctcatgcctgtaatcccagcactttgggaggccgaggtgggcagatcacctggggtcaggggttcaagaccagcctgggcaacatggtgaaaccccgtctctattaaaaatacaaaaattagctgggcgtggtggcacgcgcttgtaatcccagctacccgggaggctgaggcaggagaattgcttgaatctggaaggcagaggttgcactgagccgagatcacgccactgcactccagcctgggtgacagagcaagactccgtctcaaaaaaaaaaaaaaaaaaaagaaacctagacatttgaatattataatatggcaaccctagaaatcagtttctcctccttccccagtttactgtttttaattgctgaaggctgtagttgcctctttgtttggtgactttaccaaactatttttgcaaagtcagtaatccttgtcatgtgtggtctctgttcagctagtgccttgagagatttccttgaatgccaggagctaagaacaaatgaacccctctgtcctgccctgaacttgagccttccctgaggcttccgaccttcaagactctttcctacctacagatgaacaaatccactggcccaccctggccagcctcaccctgcttggaggctcaaggtcaatgttccctagcccatgtcctcctgcttgatgcccagggccagggtttagctaagcttctccccaccccctaggagggcattgctgcagcctcccacaagggtactggcccccctctcagctgacttgctctccaagggcaggctgtcccaacaattacatgtgcctccacagggtcctctctgtcccagggattagctcaggaacattcattgtcccaaaatccaagtacagcatcagccaggagctcctggcaccaacaggacagtgcttccagaaaggcagcatttacagagactaactggcattgtgtttctccggcttcctggaccgacaagctcagctctgttgtggacacagaacacacagcacagctctctctggcctatggcaggaacagaggcttattggtgaccttccagtctctgttaccctcaaaatgaccagagtggccagcccgagtctcttgggggctccttatcctctgcccatgagaagcatctccctccctccttcctctgcccagaggctttcccactctgcttccttctcaactggcctggtccgtgtggccaggttaccagctcaccttcctcagtccctgtctttcttccacacctagcagaacccccaggcattttgttttgcaaggactcaaggaccctacctctgacagccccatcagtgatagcccaagccctgcagccttccttgctgctaggtctgtggtgacaattaaatgaaaaaaatgggcagggcacagtggttcacgcatgtaatcccagcactttgggaggctgaggcaaaaggacggcttgagcccaggagttcaagaccagcttgggcaacatggtgagagccccgtctctacaaagaaaaaagaaaatggccgggcacagtggctcacgcctgtaatcccagcactttgggaggccgaggcaagaggactgcttgagcccaggagttcaagaccagcttgggcaacatggtgaaaccccatctccacaaaagaaaaaaaaaaaaaaatttagctgggcgtgctagcgcacacctatagttccagctacttaggaggctgaggcaggagaattgcttcagcccaggaggtcgaggctgcagtgagctatgattgtgctactacactccagcctgacgacagagaaagaccccatcactcatacatacacatatacataaatgaaaaaatgtctccaaaatgctggatgcaggggaggtgtggcagctgtttatgaggacttctgtttgcagtgcctgccccacagatgttgcattcatgaacttttgttcaaaagctaagatcacttccatcctccctggtctttcctgagataatctgtcccggaatccaagttgtcccctccagtacccaatcctttcggaggggttaaagggattgcaggggagatacaggagaaggagagaagacacaggctgctgtgtaagaagtgaaaccaagggaaagataatggggattttaaagatggtttgcaggccaggcgcagtggctcacacctgtaatcccagcactttgggaggctgaggcaggtggattgcctgagttcaggagttcgagcccagcctggccaacatggtgaaaccctgcctctactaaaaaaaaaaatacggccaagcgtggtggctcacgcctgtaattccagcactttgggaggctgaggcaggcaaatcatgaggtcaggagatcgagaccatcctggctaacacggtgaaaccccatctctactaaaaatacagaaaattagccaggtgtggtggtggacgcctgtagtcccagctacttgggaggctgaggcagaagaatggcgtgaacccgggaggcagagctggcagtgagctgagattgcgccagtgcactacagcctgtgggacagagcaactccgtctcaaaaaaaaaaaaaaaattagctgggcatggtggcacatgcctgtaatcccagctactaaggaggctgaggcgggagaattgcttgaacctgggaggcagaggttgcagtgagccgagattgcgccattgcactccagtttggacaacaagagtgaactccgtctcaaaaaaaaaaaaaaagatggtttgctttgcagcaggaaataggactccctacacactcacgaaccatctggtaacattctgtaatagtcttccatggttttgtatttgacttgatgttttgggtaatgctagaatgctcgagttctagaggcagctcaagaagacctgctacagtatcacaacagacatacgattttgtaaatgttttccacttgtagttgagcccagtgttttcctgctgctttctgccttcagacccaccatgtaccacatggaacacgcgagctccagcagaggtgccaggtccatcttgctccccactgtaaccctggaactgagaatggtgcctcagacatggctggtgtgcggcaaaccaaagtgccctcactttcaagaactgccccatagcccacagaatgccgtgccactggttactaacattcccctacgtggcaggctcaggctgcctcctgacacttctttttttcagagtccagctgccgtccaggctcctgttcctcgattctccttgtggtttttctcatttttctggctccctctgagctgcttctagctaggattcaagcaggtgagagaagtgaatggctggaagatttacttatggggtcagagcaacagcacctggtgatgtgctagatggacagtaacgccacttgccatcagaggagatgctagaaaaggctctggggaaagcttttttttgagacggagtctcgctctgtcgcccaggctggagtgccgtggcacaatctctgctcactgcaacctccgcctcctgggttcaaatgattctcctgcctcagcctcccgagtagctgggactacaggcgcctgccaccacacccggctaacttttgtatttttagtagagatggggttttaccatattggccaggctggtcctgaactcctgaccttgtgatctgcccacctcggcctcccaaagtgctgggattacaggcgtgagtgggaaagctttctttttttttgagacagagtcttgctttggcaccaggctggagtgcagtggcacgatctcggctcactgcaacccccgcctcctgggttcaagcgattctccagcctcagcctcccgagtagctgggattacaggcatgtgccaccacacccagctaatttttttatttttagtagagacggggtttcaccatgttggccaggatggtttcgatctcctgaccttgcaatccacccacctcagcctcccaaagtgctgggattacaggcatgagccactatgcccggccagggaaagctcttcttgttcagtttgggacatgttgggtttgagctgcctttactagacacacattgacatgttaagccaacgtggatagagatgacaaaagatggcttttctgcctgtcctgcagcccagaaccctccagaagagtgatgggaaacctatggctatctttatgtctcatccacatgggtcactgtagattcctgggtggccaaaatgggtcttaagtttgggaaactatttgcctggctgatgtacgatgcatttaaaacaaacattttgtccataatgtactatgaaggacacaagacctgattttcctccacgcatgtttatgtcgactcatctaagagtagtctccatctctgacatgagggagggatagaggtgcagagtgtgcccctaggagtagctttcttgggcagtttctgtgagggagaaggctaagtgttaagaacagaacagcactggaaaccagttagaggcagaggaagcagcaaatgcaaagaccctgagataggaatgaattggtctccaaaataatctggatgctgggcataggagctcctgcctgtggtcccagctacttgagaggctgtggtgggaggatcacttgagcccgggaagtcaaggctgcaataagctgtgattgtgccactagattacagcctgggctacagagtgaggtgtgagacactgtctcaaaaataaataataaaaaataaaaataaacaaaataacttggcagcggcagcagcgtctgtgaaaaaggcttaggagctgaagaagtcagtaaggatagagtaagtcatttttaagtggtaccaagaaagcgttaaataatcttatattttacagtgagaaaatacaattctcactccatctttctgattttattaaggagaaaaatctcagttgagtgccagtccgtctaactcctcacctctcttttttacaaaatgaacaagcctcaggcccagagtctatgcaggcaacagcatctagccgtaagttaataacaccgatggtttttcttgtatttatttttagttactttccatctatgttaagtgtaaaatttcacttaaaaatccatttaaacttaaaaggtttgtttttaaaaatattaagtaactcaagtactagaagtacagaagcctggcaaaaattatgaaggtaaggaaggtaatacatagacaactgaactggaggggcactggtctgagtgaggactttgggcacagtaactccacctcatgctttgtgctttctgggttttgtctaatttgctgttgttgttccctaatatagactatttttttagaaaacccaaccttattttggctaaggggaaagggatttactttcatttgggttaaggtagggcagaccaaaggcccctggaagttagtggttcaggttctaactacacaacactggcaagtggaaagggagatgtggggagaagtgaaaaaccctgggcataagattccagaacagcagagtgtgcttcccttcccaccaagctgtcaaatacaaatctggagattcaataaaaaagatcattccatgatagagaagacagaaagctgtaattctttttaatgtttaacttttctttgtaaaaaacttattaaaaaacttaaatggtcagttaaagttaaaaatctattgctgcacaatttaactgattaaaagatttccagatctcttgactccaagagtcatttctttcatttcttacagatctcacacttccagatttctctttagcaaacatgatctgaaatcatttgtaggtaatcagcacttcaagcatatggaggctctggctgaggcagcagagtcctgggagactgaacactgggagattcagtgtcccccacagaaacctagacctgggctcagcccaccactgctaggggtcctgcacaggacccatgtggctcctgcacgggatctatgtggcgaacctgagctcgatcttcgctgtcagtcctcctggtctctcctgagggccgccgacccgccacagtgtggctctccttccaaaagccagagcttcattccactttgattctcatcagctcccatcttcctcctccacagagtttcagaaccaaggaatgaaactacaagagaccaccaccacatggagatcaggctgccctggccgctggcagaggaggccactcggttctctctgctactgctactccccgttttgaggggcctctggccctggccaggctgagcctttgggttctttctcctcctcaggccatccttgtgagcacgggtaccttctcaaggctctgccgatgtcccacactgatgaacgtcatccccagctgctggccgatgcgatagagctcgctctccacttcctctgtcagggcactggtggcttcatcaagcactgagggggcagagcacagaggaagagatcaaagccctgccctctgccgccgctgcttctcctcccacccatactcaaccccagctgggacccaggggaggctgaaagctgctctggcttccagaagccctgcctcagggagaaggatgggccagaggagcagagggccagactctccaagggaatagcctgtgagcagctgcatgaaatctctcagcttctatagataagcaccagccactccctgggaccactcaatccagggaatcccagtcccccgcaagaatgtcagtctttggaaaagtccacacccatccacctgccaggcacagcttggtgggagaggaggatgggtgcccattcatttgatggtggagccagaggagcataaaattataacccttcaatgttggctcctggctccagctgctgccaggcaaaaagcttatgagctaggcatagtggttcatgcctgtaatcccagcactttgggaggccaacgtgggaggatggcctgagtccaggaactccagaccagcctgggcaacatagcatgaccctgtctctacaaaaataaaaataaaaaaattagcagggtgtggtggcacatgcttgtagtcccagctactcaggaggctgaggtgggaggatcacttaagcctgggagttccaggctgcactgagccatgactgtgcccctgtaccccagcctgggtgacagagtgagactgtctcaaaaaaaaaaaaaaaaaaagaaaagaaaaaagaaaacagaagaaaagcaagcttatgagctggcagtaccgcatattcagtgttaactctgacgatgccaggcactgtttacacgggcagggcctgctgtcctctccagcagggaatgcggagaagcccagccattcacaggtgtgcctgggtgcctgtgaacacatgctgctacacccgtgagtgcagacagcgcatggcatgtgcagccacaaggcgagacctcacctgcgtacttcggctgcaggtagaagagtcgggcaaaggagagccgttgcatctcccccggggacagaacatcatacctgaggaaaggtaggagagaggactgctagaggaggaagaatatagcttggcttttacctagaatggtctgggtaggaagaggtttctctgcacagaggtgagccccaggagacagaagccccttccctttcgaccataggcctacagccctcacagagtgaggcaaaactctgttcccaagggcataaacttgcacccgactgaccagccaaacatctggactttggggtcaggagccgttccattccttgacagggaccctgaaacccactgtctttatggtggggctatctctggagcacccaagctcttttcttaccagttccagtccacctgctggtccaggccctctgtccttgccaccaagttggactgtaacagacccagagggcaggatgtccatgaaatggccagccctgctacctgccatcatggggaacctccctcactccccagcatacacacacacctctaagacaaatatatgccccagtggcataccaaggcgggggactgtgggacagtctgccccaggcagagaggaatattctaccaatgacactgtttagacttgctggagcatgatgacagtaaaaagcaaaccgccttcatcaatcctattcttgttttaaaattctccaatgagagcactacccccttcgtgcctaaacctggccaacagcacacactgtcaactgatactcccattctccaccccaggttcagacttccagtcctgggcccaagcatagcagggccagcacctgcctacctgtagctggtgctcccaggtgggctcgggtcctgagggtccctctccccacttaccaggcctgccaattccaagaacctcaagatcctctcatcatcggcagaacctgcacaacaaagaagccttctgcaaaaagccagagcctcctggctggtcaaaatagacagggcaaggctgtgcacagtggctcacgcctgtaatcccaacactttgggaggccgaggcaggtggatcacaaggtcaggagatggagaccaccctggccaacatggtgaaacgctgtctctactaaatatacaaaaattaggcaggcaaggtggcgtgcacctgtagccccagctacggaagaggctgaggcaggggaattgcttgaacccgggaggtggaggttgcagtgagccgagatcacaccactgcactccagtctgggtgacagagtgaaactccatctcaaaaaaaaaaaaaaaaaaaaaaaaaaagaatagacagggcacatcatggatgatgcaggggtgggggcctcagaatgctgggcgaaggctttgaaaccacaggttgcagatcttcataagggaaggggtgggtgaaggaaggcatcactttccttgtcccagtgggcatctctccttaaggacagaaagaatgaggtgagatctgggtacagaccccaaaacagtcaaaggaagaggagaggagcccctcttccttgaatcagcggcctggctggagcctctccccaagggcacagatgaggccacagtcaggtagagcagggacaaccatgacagaaggagaggacatgacctaaggaggaccagctcacctgagtcggggtagacctccttcaggggatatatcacctgagaaaagaaaaaaaccacaccaacctaggagggcgagcaaaagacggagctgcacacagcccaccctccctccagaacccactggaacctcccaaggaggagaggtgggaacgcctggcctgggtcagatgggagaggctctggccggcagacagcagggcaaggtccctacaaccttcagaagtgtgtttagggggaacagtctgacagcctcctgagggcaggggccccagaatccgaccttgggtgtttgacatacgcgtgtggtatttggcgtgagtccttgccccatttacctgcctcaggagctgctatgagtagtgggcccaatccatggatgtgaatagaaggttcttagagccagcagttcccaggcccgggccacttcaccacctcaccttttgccctgactctaggacctgagacttgtcacagtgccagaggtcccagctgtgggtgggcggggttgaggagggaggagtgagccccctgaactagactgacctgctcccgaagggtcccgtcagtgaagaatggcttttgtggcaggaatagcaccccatggggcccaaagtccgtcagcatctgcactgagcctgcagagcccacagaaacctccattgtgagatctcccagaagaggcaactgcctgtctcctctcttccttgttccccaacagaaaagaatggattctaccacaccgtccccgccttcaccccacccctagggcccaggctgggtcagaggcagggagggcctggctctcaccccgtgtactcgtccagaggccacccagaacccggagcaaggaggtcttgccagtgcccgtgttgcctgtgatgagcaggctctgtccctcggagatctttaggctcagatccttgattaggggtttgtcagaggagggggcagagatggagacccgctcaaggagaaatgctgtgtctgctggctctgccgctggccaccctgggggtctgtgtcagagaagagagggggcgtgaggaagatgggcagggtcagtattgctgtgggggaggcactgctcccgggagccaccacctgtggattattatgggctgacttgcatcctcccaaaatcacatgctgaagtccagccccctagtgactcagaatgtaactgcattcggaggcagggtctttttttttttttttttttttgagagaaagtcttgctgtcacccaggcttgagtgcagtggagctatctcagctcactgcaacctccgcctcctgggttcaagcgattttcctgtcccagcctcctgagtagctggattacaggtgcccaccaccgtgcccatatttttagtagagacagggtttcactatgttggccagtctggtctcgaacttgtgacctcaggtgatctgcccacctcagcctcccaaagtggtgggattatagacgtgagcttccgtgcccagctggaggcagggtctttaaagagatgatgttaacatgaagttgttggggtgggaccctaatccaatatgactggtgtcctcttaagatagaggtggcaggggcacgcacatataaaggaaaggccacgtgaggacacagcaacaaggtggccatctacaagccaaggagtggcctaagaaaccaaccctgctgacaacttgatcgtggaccataagcatccagaattgtgaggaaattaatttctattgtttaagccagccggtttgtggttttctgtcatggcagcctgagcacattaatacaggggtaggggtggaacttctactctctgcctggctggacaaagccccttatgggactgatcttactcagtctaatgcccatgagtctcaaatatcatcacagatgaggacactaagaatcaggtggctaagtaactgcccaggttgcagagcggtattcaacaaattctaatgctggtgggtcttcatggcatcacagtgtgaccagagtactaataacaagaatgggagtggttaaagctaaatggttctggagtttctgcctctgcatggatgcctggctccccacagaacagcaattccagtttcctacagaccctccttcatgcccagcctctgcactcatggttgcatgaagctttcatttggaacagaagcaacagttaaggtattagctcctaagaaaagcaagttgagtgtaggccctggaattcagactgatttttgaaagcttatgatgtggccactgtccaagcactttccatggatgatgatatctaatccctacaacaagtgaaggaagttcattatgacctccttttcagacatgaagaaacagaacagttaggtaatctgcccaaggaaagtgtggagatcaagcaaatcctgaatgcacagaaatattacagatccacgcagacacacggatacagacatctctggggctgagtgaggtgggggaacaaagacagacatgccccaaggaaaggggcagggagaggaatcagcgggaggaggaagcacaggaaggggaggacactgcagattcctgttatctcaggcagaaggtgtgtgtactttgcttccactggccggggaatggtgtaaattaacacaacagatgccggaacagcaacatcgactgtgaacttacatgtgcctggcattccatttccatttactccttacaactctgctgcccagctgggaaagggcaggactccagggtaacccaagccaggtgatgccacagcctgcagcctcaactactgctctgccagcccgctactcacgtgtccaagccccactcgctctcgcccaggatctcgcagtcctgtgacttcagggacatgtccagaagcgtctcccgaagctgcccaattctgaacaagaaaagaaaatctgaggcagggtctgggagccaggtgaaggtgaactccttttcctatctcacacccacgagtacatggtatgtctctgttccttttttcactcagccacttctgccagcagcacacactttgctcaggagccagaggggtgggacacggcctcacctgtgcgtgtagccagccacatctgagagcgtcgtggacaggtcgatgagctgggtgaagcagctgatgaggtagatgcacacaaaggcattctggacaggatgggaagaggtcaagcaggtctcgactcgagcccacagacactgggccaaggacagagagggacagcatgtggggtgaccaagagggagtctcaccttgctgaccagggtgctaagctctgcgggactcaggtctccatagaccccgctgaaaatggggattgcgatgacaacgtaactcaggatgctgcccagatagtcaaaggtgttgatgccgactgtagaaaacacatctgtgagacacccaggaaccatccacatgccctacagcggacacaaccctaagacagggagcaggacgccaagtagggccacgtggactctctggatcctcattctcctgaggatactcacagaaaggcaacagccccccctcctcatccccggttaattccttcatcatggcacatttatccttgcagacaggaggtagagaggtgtgggaagggaagcagaccagtccaaccccatggttcccacttccctgggccccctcgcctactgtacagccagagctccttggacatcagctccctctgggtctgaaggagtctctgcagcctgcggtctgtcctcatgtgctccacatgcccagctctgacaaggaaaggctgggatgtccacagggctggagaggttcagccaggttggggggccgcctgtcccatatcacaccctcctttagaaaccaaggccattcaaatgatcttggtctcaggatctgtctactggtagcgcccattcacggcttcagtcatgccttaatggtattgtctgtgtgaagaacataaactctagagttgggcagacctagttcaaatcctggctctggccagttactagctgcgtgacacaggcaggctacttaagcctccaagcctcagtttttttaatctataaaatggagccaataatacctatgtaataggttagagttagaattaaaagtttctaaatataaagtgccaagcacataaggagccctcaataaataaaaactattgttaaataaacatacacagagcggtcactaggtgtaccaggcattgcactagttagctagtgcaataaagaaatgagaaaattatctctgtctttgaggagctctcagtccagagggcaggcaggcacactgcattcttcacttggaatcaggagtactaagtgtgccctcagggccatggcagcagataggcttagccattaagggagtctgggaaggctctccagaggaggtgatctggggtttcaaggatgggaagaaattcgctaggcagaaaaggtggagggagatttcagattttgcacagaggccacagaagaactcatctgaaactctacaaactaacctgccttccccagagcttcatgagcagaggctgcagaatccaaaagcaacttttttctttttttttttttgagacggagtcttgctctgtcacccaggctggagtgcaatggcaggatcttgccttactgcaacctctgcctcccggattcaagtgattctcctgcctcagcctccccagtagctgggattacaggtgcccgccaccatgctcagctaattttttgtatttttagtagagacagggtttcaccatgttggccatggctggtctcgaactcttgacctcaggcaatccacccgcctcggcctcccaaagtgctgggattacaggcatgagccaccatgcccggcctccaaaagcaacttttttacacacccagccctgcccacctcacaaccccaccccagcgcagattcccagtattcttggtgccctcaagtggtggaggttgcaaactgcagcagagactgaggagcaaaggtcccagggctatcacatccaccccaagtacagagccaaggagtagcttccacttcttaaacgcaaacctctgcctgcactatcaatcctaacgctgatttcagaggcctcacataaggcagagcacagggaccggttctggccctggagggaagggatgggatttcatgccgctgctgctgctcctgctgctgccgtcaggagaccagacgcttggctccattagacagcattgtggggagcaggtctcctggttttctgagaagctcccattccatcccacgctacggagacaaaggatcaggcttgaacctcaggcactggcaagaaagcttcttaacagacagaagagcagaggcagacggatgtcttacagtcaccagcaagaggatgaggcattcattcatttgacaatttcaggccccacgctaggccactaagactaaagctggccacagtaaggaaccaccagcttcagaagcaaacccctggacctaaggatgaggcaggcaagggcagggggaggtagagggagagggtcacagccaagtgtgacaacactcagcccctgagctcggtggtggtgggagggttgaggattcatctttccttctccactctcagctctggcaaggcagaaggggaaccatctctccagactcacctgtagaaagcagcaggctccgcattcacccgaatctgcatgtgcttgaacctgggcggaccaaagggaaatgtgtgctgacaacagggagtactggcctcactcttgttggagtcctggatcacaaagaccgcccaagcggagcccggctctgcctcaaaaccgtggctgcctcagtctgaccctttcctggactgttatggggtagaaaaccccagggctaggtggtgtggcaggagctctgcagagacagggctgcccctcagctttctgcagagaggacaggggtattcctgctcacagcatctcctcctcccagggcctggcccaaaggagggggacaagaagcacagggcaggcactggatccattggctgccacacccaactgatccaagacagggcggttatgccagggcagtgagaaggccaagagatgacaatgacgatggtgatggccaggcagacacggttctcagaccttctcaggtatgatttcattaatcctcctaatcctctcagtaggcaacggtaccatttccactttagagacaagaacattgaagcttggagaggttaaagacctctccaagatcacacagctagtaactggcacagctaggatttgaacttaggcagttttactccagatccccttccttaactattatgccccagcccagaaacctcaagtgagggagacacacctaaaatctccctccagcttctcctgatgcaccagcttcatcacaatggggcccatcaaagttttgttcaccacggtccccaggatgaaatacccgaagatgctcacaggcccgagccagcctgtgctgaaatagagagagagggagagaagggagagggtgtggggtgccacctatccccacatgcctcagccctgactcctgttccctctcaggtagcccctgtccaatctgagtggcccaatgggccctctgctcctatgtgggggcatctggtatgagctctcagagccaggatatctgtgacactgcaacacagggccaaaggaagggcaggggcctgagcacgtgggatgggtgagcacgtggtaaggtacggtgggagagaggggaaataagcttctcttggaccttgacctgggagagctgactgagggccctctggggaaacaccaggctggggaggagggaggcttcacctttggaagcactggtaagtgtagtagacgagggtgaacggggagatgatgagcttgctggccatgctgctgagctgccggcagaatcgctccacgtcctggctgatgcgctggtccctggagccaatgacacagagtagctggacccagggagatgggcccaaaggtagagagaacaagaaactttcacatcacctctgctcttgaccttgcctcacagtgctgtgaacactgaccctatgggaagagggaaccagacaaggctggtttcctaggggcaactaaatcccagggcctttaaacagggttctagagagttgcatcttacggtgccttagttaatcccctgaaaaagtgggaactgaaaggtccagtacccaggggcctgagccagctctgagcagagccaaagaaaaacttgaaggtagatgagctgttttggatgatcaagaagactatcccctttatctcaatcctcccaaatttctcttatataagccctagcctggcccctttagttatctggctgtgaaagctccaggctgtgaggcacacctgtagtcccagctactcagggggcagaggcaggatggaagccatagccatcagaaagaggcctagaagttaggcagcagcagcagcctcccacgcatctttgcaccaaagctaagcttgagctgagaggtaccccaaccaacaaagtgcttgctaggaaggtggtgagtgaggggatgggtgtgaaggagaccccctatgtctcatctcaccactagggccatactgattcctattcccaatgagtgacgtgaccttgggcaagtcacttgcaatctctgggcttcagcttcctcatctgtaaaataacaatagctaacttacactgaaacacttgctatgtgtcaagcactgtacatgtgcattacatgaatgatatttcatcctcactacaccctttgagataggaactattattgtcctcattttacagaaggggaacctggggcttggtgactttaagagttataacctgagtggtgatagaatggagatgtgaatcctagactgagtcctggatagtggtaattttttttactgatgaaaatctaagagctggtttttctagcaaggacattttctttagaaccctctaaagaaaccccttagtcttcttactggaagactaagatataaagtatgaaaaggacaaaagaaagctgctcctaacatttttcttttttttaagagatgggggtttctgctatgttgcccaggctagagtacagtggctattcccaagtgtgctcacggtgcactactcctgggctcaagtgatcctcctgcctcagcctcctgagttgttgggactacaggtgcatgccactgcacctggcaggcttcttctttttagctgcctattcacagccctgcagcttctccaggagtcctctgcagggcaccctcccccatgactctgggcagcagcatttgaaaacgactgcagatgatctccttggtgtctgccaccagcagtctccagggctaggccagaaggaaaggaccacacagagtgtagaaaggactgagttggggcgcctacgggttatcgatgtcatcccgcagcacgttgagggtgtagtacgcacggccccggaagtagaggcggtgaaggtgctcagtgaggtccttcctccagctcacatacagcaggttgcaggtgaactgatcaaagctcttcagctgtgcagtgggggaagcaaggggaagggagagatggcttcctgaaaatctcagctcaaagctcaaggctcgcaagagcctccgctgacccatcccagcccactctgactctgattactccgtccactcagcacttttcttttttaaatcatcgagtcatgggactttcccttcctcactcactcacgtgttcattccttcaccaaattttttttctctgagatggagttttactcttgttgcccaggctggagtgcaatggcgcgatcttggctcaccacaacctccgcctcccagtttcaagcgattctcctgcctcagcctcccgagtagctgggattacaggcatgcaccaccacgcccagctaattttgtatttttagtagagacggggtttctccatcttggtcaggctggtctggaactcccgacctcaggtgatccgcccgcctcggcctctcaaagtgctgggattacaggcgtgagccactgtacccagcctccttcaccaaatattaaagggcttaccagaggcaagaccctctttctacactgtcttattttgagagtagatgagcttctgaagattggagaccatattgtcgattccatttatgttcttactcctttgtcccccaagcttgggacagagatttgtatgcataggtgcttactgaccgaagacccaacaaaagtggccatggtacgatgagcagtggcttccccaagaaaacaggtggcacagcctggcagacagcattaggcttgagttctggtacagccctgagtctcatcatttaccatttccagggcacctatgtgctaagcactagggacattatgagctcacagtttagccagaaaacaattacaagcgtgtgaggagtgttacagcgaggtaaactcaaggaattcgttaagtacagaaaaagggcagagtttggtggaggagacacaaaggagaaagctgagaaagacttgaaagaggtgacaacggagggatgacgaagagtgagcaggtggtagcccccctactgaatgaggggtaggggaggaggccattctgcaagaaagcactgttcaaaggctgggaggtgtgacatggtgccagggtgagtcacagcctcggtcccgcagaggaggagcagcagctctggctgctgagccgttttaatgagctgccggaaataagagttctaggaaggaaaggggcaatgatcagttctgctaaatgctgaattaaaccagaacctgtggcctgggcccaggagtggaaacatctgaggaatcagtcccacgtgggccaatagcaagatcaacgtgcttaataaaggcaactatccctttagttcccagaaaagggaggaaacacacccccacagcttgcttcctgcttcctggaggctaagttccactaggcattacggtcacactggactggagaggacgagagacacagagagagggaaagatcttaccgtggagttcagaacaatgagcatgacagccaggaatgtcagagtcttaaacccttccaagtctttgtttcccaggaccccatagtactgactggggatcaagccaacctggtagatcacaaattgctctgaaaggagggagaggagtaagaaatcagtgatgaggggttaaaaagaagggaggcttcttcctgagtccctgcctcatcagcaccccaaagagatgaaaaggggccgggcgcggtggctcacgcctgtaatcccagcactttgggaggctgaggcgggtgtatcacctgaggtcatgagttcgagatcagcctggccaagatggtgaaaccctgtctttactgaaaaatacaaagtttagtcgggcgtggtggtgggtgcttgtaatcccagctactcaggaggcgaaggcaggagaatcacttgaaccagggaggcagaggttgcagtgagctgagattatgtcactgcactccagcctgggcaacaagagagaaactctgtctcaaaaaaaaaaaaaaaaaaaaaaaagatggaaagggaccccaaaccagagctcccctccctcctctagtctgggctcactcactcacccagtagggtcaggcacaaaagggtcaggaacatcaaggcattttgtgatgaccaagaaggaaacaaaaccttcagtatctgcaggaaccgctggagaaattgcagatctaacctgggcctgaagagaaggtggggaggcagagaaaagcccaagacaataattaagccttagggagtagttattaagctcatccacattgttctgtagagggtccaggccatgcagaaagaatggttttcaaatgctgaagatggtaggctgggaacagaccacggatacaaaggaaattctttggccaagcgtggtggctcatgcctgtaatcccagctactcgggaggctgagtcaggagaattgcttggacctgggaggcagaggttgcagtgagctgagattgcgccattgcaacaagagcctgggcaacaagagcaaaactccgtctcaaaaaaaaaaaaaaaaccaaaaacaaaaaacttaaaaaattacaaatggattaaaaatctaaacgtgaaaagtaacactatcatgttaatagaaggaaatgtagaaaaatgtcttaatgaagataccttaaaaacctatacaggggaaaactgatgaatttaacttcattagagttaaatgtttttattcaacacagtgccatagattaagttagaagacttggaggtggtatctgcagagtgcaaaaccaacaaggacttgaaatctttatttttttgagacggagttttgctcgttgcccaggctggaatgcaacggcgcaatctcggatcactgcaacctccgcctccctggttcaagtgattctcctgtgtcagcctcctgacaagctgcaattacaggtgcatgccaccacgcccggctaatttttgtatttttagtaggagacggggtttcatcatattggtcaggctggtctcgaactcctgacctccggtgatccacctgcctcggcctcccaaagtgctgggattacaggcgtgagccaccgcgcctggcctaaaatctttttttttttttttttgagacaaggtcttgctctgttgcccaggctggaatgcagtggtgcgatctcagctcagggcaacctctgcctcccgggttcaagcgactgtcccacctcagcctttttagtggctgggagtacgggcgtgcgtcaacacgctcagctaatttttgtatttttggtagagatggggtttcaccatgttgcccaggctgatcttgaactcctggactccagtggtccacctacctcagcctcccaaagtgataggatgacaggtgtgagccaccgggcatggccaggatctaaatctagagcctacaagaattcctgcaagccaggaacataggaaatccacagagaagtgggaagggatataaacaggcaattcaaaaaagggaaaacccacgtttaataaacacatgaaaatgtaggccgggagcagtggctcacgtctgtaattcctttatgcactgcccgtcgggaagtgtaatccctgcacttcgggaggccgaggcgggtggatcacctgaggtcaggagttcaagaccagactggccaacccccccatctttgctaaaaatacaaaaaattagctgggtgtggtggcgcgcgtctgtaatcccagctactcaggaggctgaggcagaagaatcgcttgaacccgaggcggaggttgcagtgagccgagatcatgccactgcattcctgcccgagcaacaagagcaaaactccgtctcaaaagaaagaaagaaagaaagaaagaaaatgtacacgatgggataccaccttacaccccccagactgataaacattacaaaaccagccgccactgaacgatggagggataccgggaaacaggaagctttatgcactgcccgtcgggaagtataaactagtgtgaccattccaaagaacaatccagcaaaattagatatgaccaggacccaactctggggtggatacccagagaaatgcaacaatatgcacaaggagacaactgccagaatattcgttacagtgtggcttgtgggggtgttaatactagaaaaaaatctatccaccactaggggaataagtctatgcacacagcacccctcatgcaagcactcagaagtgaaaacaagatgactagcatggatggactcaaaaacacaatgttgaggaaaaaggtttaaagaaaaatcacagcatattatattgaagaattcgaaaccgctatatagatttcaaagtaacacttgcacaaatttacccaaggtggaccgtaaagccacttatataacacaccagagtggctgtctgaaaaggggagtgaaaggggtctgggaataggaacgaagagaggaagtgataaaataaacaaggagccttgcattggcccacagggtgtcaagaactgagaaggatcaactcaattttgtgcacctgaggttcttcttttcaaaaaaagaatgccagttgcgagggtgagggtcccacaccgcaggagatggcacaagtccggccaagaacggagggggccgcggccggtgcggagcggcctagagcggcgggagggcggacgccccttcgagagctcctctttctctcagaagtcacgggggcgagacgggggcgccagggcggcggacgaggcacggagggcaggaaagcccattccctacagcccggaactcctgctcccaaacctcctccccgaccgccctgcttacctggcgccagctccgggcgcgggccccgcgaccgccatgacctgagacccgagggactctggagcccagctgcccctagttcagtactgggtagagtccgaggaggggcggggccccggctaccacagagacggcgtttgatagagaggaaggtgcgggagacgcggactctcccggaagcgaccgacgtctctaaaagtaccagagagtggactcggctgacccggcggctacagcgcccccatattttctgggagacttcccttttgacaataggtatccgagagtgtaactactttatggcaagtattttagattctgtgtataatagatgttttacatattctcccagagaagccagcatgatctttaaaaaagtataaattaggcttccagccgggcccggtgggttactcctgtaatcccagcactttggaaggccaaggcgggaggatcgcttgagcccaggaattcaagaccagcctgggcaacatggcaagaccccgcctttacaaaagacaaaagcattagccggggatggtggcgagcgcctgtggtccgagctactctggaggctgaggcaggagaatcacttgggcccggaaggtcaaggctgcagtgagccgtgactgtgccactgcactccagcctgggcgacaaagagagaccctgtctcaaaaacaaataaatagatgataatgatcgatagataagatagatagttgaatgaatgaaatgcttatcagttgactgattagtacccaaagggaggtgggaaatggctcaaaaaaaacccaaacagcatgatcccacaggtccctaaatttgaatctggatgtgtcttctcactttcctccaatccttattaagtttcaactgcaagccaaacactctacaacatgcatgtatcacttgtctttatgaaagttgcagtctagctgggtaggtcaatcagttgacaattacagatttttttttttttttttttttttttgatacggagtgttgcttttgttgccccggctagagtgcaatggcgcgatatcggctcacggcaacctcagcctcccggattgaagccatcctcctgcctcagcctcccgagtagctaggattacaggcatgtgccaccacgcccagctaatttagtatttttagtagagacagggtttctccatattggtcaggctggtcttgaactcctaacctcaggtgatctgcccgccttggctttccaaagtgttgggattacaagagtgagccaccgctcctggcctttttttgtttttgtttttgttttagacggagtttcgctcttgtggctcaggctggagtgcaatggtgctatcttggctcactgcaacctgtgcctcccgggttcaagcgattctcctgcctcagcctcccgagtagctgggattacaggcatgcaccactatacccggctaattttgtatttttagtagagacgtggtttctccatgttggtcaggctggtctcgaactcccgacctcaggtgatccacccaccttggcctctcaaaatgctgggattacaggtgtgaatcaccgtgcccggcctacagctgtctttatgaagtgctatgacaaacataccatacagcaggggttctcaactttggcgccattaagttttggggcctgatcattctttgctgtgtaggctttcctatgcaatgtaggatgtttagctgtatcccaggcctctacgcactagatgccggtggcattccttctgacctaggcatcccaaaatgtctctaaacattgccaaatgtcccttaggggagaaaggaccaaaattccagctttaccccaccccctagcattgagaaccactgccccagaaccaaagagaaaggcatttaactcagcatggggaaaagtggaatctagaaagactttgaagaggaaataactttattcaagtatgtctttcttattttgaaaaccaaaaaaataggatgcaatttttgaaaaattaataaggcaaccaaagtattaaagcaagcaacgtcacctctctagggtaatctaggtttacagatcttgtcccctttcagtctcaaaaatgtcctagtttggtattcggtggcattactgtcccagggtgcctcagcattgtctattactgtaaacttttaagaagtagcaggctgggcacggtggctcacgcctgtaatcccagcgcttttggaggccgaagcaggcaaatcacctgaggtcaggagttcaagaccagcctggccaacatgacaaaatcccgtctttactaaaagtacaaaaattagccaggtgtggtggcgggtgcatgtaatcccagctacttgggaggctgaggcaggagaattacttgaacccaggaggcggaggttgcattgaactgagattgtgccattgtactccagcctgggtgacaagagtgagactgtttcaaaaaaaaaaaaaaaaaagaagaagaagaagtaatacaccagagttaccagtgagcaagcgggaggctactggagtgcagcagagcagagtaatgcccaaatcaaaggaacttacttcttcaagctcttctggcagcggttctgacagtgatgttgacaaaaagttaaagaggaaaaagcaggttgctccagaaagacctgtaaagaagcaaaagactggtgaaacttgaagagctctatcatcttccaaagagaacagcagcagcagcacagatgataacatgatgtttcaggttaggaaaatgaggtacattagtgtttgggatttttttttagacttgtcccccaaggctggagcgcaatggcacgatcttggctcactgcaacctctgcctcccaggttcaagcaattctcctgcctcagcctcctgagtagctgagactgcaggcactcgccaccatgcctggctaagttctgtcttttatgtcgagacagggtttcaccatgttggccaggctggtcttgaactcctgacctcaagtgatctgcccaccttggcctcccaaagtactaggattacaagtgtgagccaccaagccgggccagtgtttgggattttaaagggtaattgatattaaataatattggatggatccagaaggtgaaatgaaaccaggaagagaaggtatttctttgaatttggagcaaagaagccagctgaaggaacagattttttaaaatttaaatttaaagattatatatatataatatatgtaaaaatatatatgtaaaatatatatatgtaaaaatatacatatatatatatatatatatatatatattttttttttttttttgagacagagtcttgctctgttgcccatgctggagtgcagtggtgggatcacagctgaccgcagcctccatctcctgggctcaagtgatccacctcagcctccttagtagctgggactgtaggtgctggcatcacacacagctaattaaaaaaaattttttttgtagagaaggcaggggttggggggaggtgtctcactgtgttgtccaggctagtcttaaattcctaggctcaagtgatcctccacctttgcctccctaagtgctaggattacagatgtgagccactgcacctggccaagaacagatttctgatactgatgatgcagttaagaaaactgtgaaattcaagccatataaaacctatactgttctagtgtagttggtttgtgtgtgtgtgtgtgtgtgtgtctgtgtatgtgtggtttttttttttttttttgacaggttcttgctctgtggtccaggtagagtgcagtgggataataatcacagctcactgcagtctccaactcctcccacctcaatctcctgagtagctggggctacaggtatgcgccaacatgcctagctaatttttaagtttttttttttttttaaatagagatgaggtctcactatattgcccaggctggtctagaactcctgagctcaagcgatgcttctgcctcagcctcccaaagtgttaggattacagggcggagccaccgctcctggcctctagttgttttaatctgtctttttacattggcttttgttttctaaatattgtcctccaagctattgtatgtttagattgcagaacaacttgtaaaatgaatacttgttttaatgtgcattatttaaaatgttctgagtgaagctaattgtcaactttataaggagaattgctctgtgcccaccacttagtatacaataaatcaagtaatacattcttaactgttgtggccctttttttttttttttttttttttgagatggagtttcactcttgttgcccaggctggattggggctcactgcaacccctgcctcccaagttcaagtgattctcctgcctcagcctcctgggtagttggattataggcacccgccaccacgcccggctaattttttatatttttagtagagatggagtttcaccatgttggctaggctggtctcaaactccttacctcagttgatccacgcgcctccacctccccaagtgctgagattacaggcgtgagccactgctcctggccctgttgtggccttttttgatcatgagagttggtgctcttgaaggccaaaaatgacagttttttatagatcttttaatttcaattcagctttcacaataaaaaagagtgtattgcattgaacaaaaaaagtattacaccaatactaaacttgatgtaaaatgtgatctcaactatgaaaatatatatagatgtaaatatctgcatagaaaaatcataatgaagcatagcaaaaggccatatatcatattggttgttaatatttgagtttatatttcagagttatcttttggataagatccaatttttttttcttttttttgagatggagtctcgctctgttgcccaggctggagtgcagtggcgcgatcttggctcactgcaacctccgcctcccgggttcaagcaattctcctgtttagcctcccaagcagctgggactacaggcgtccaccagcacgcctggctaatttttgtatttttagtagagacagggtttcaccatattggccaggctggtctcgaactcctgatcttgtgatctacctgcctcagcctcccaaagtgctgggattacaggtgtaagccaccgggtttagagccaacttaaaattagttcaaatttctaattagctcataactgtgatcgatgttttctttttattttatttttttcttttctaggtttttaaaaaattcacaatccacttgggcacagtggctcacacctgtggtctcagaactttgggaggccaaggccagaggtttgcttgagcccaggagttcaagaccagcctgggcaacatagctagacccccatctctacaaaaaaagaaaaaaattgggatccaaataaggtctacacattgcaattgatcatatgtcatttaacactcttttagtttataggttcctcttctacccctttagaccagctactattatctcattttcatgtccttctgcaaaaccttctaactggatttctacacttgaatttcctcctgctctaatccagtttctacaaagcagccagagaaatctgaacaaatgtaaaccagatcaacagtccacttaaagcccttcaaggcttctttttttttttgagatggagtttcgctcttgttgctcaggctggagggcagtggtgtgatctcggcccactgcaacctctgcctcccgggttcaagcgattttcctgcctcagcctcctatgtagctgggattacaggcacccgccaccacgcacagctaatttttgttatttttagtagagatggggttttgccatgttggccaagctactctcgaactcctaacctcaagtgatctgctggccttggcctcccaaagtgctgagattacaggcgcgagccactgcaccctgctcttcaaggcttcttatgccctggccttgcctattgctccaacttctgtttgttttttttttttttttgagacagtcttgctctgttgcccaggatggaatgcagtggtatgatctcaggtcacagcaacctctgcctcccaggttaaagtgattcttgtgcctcatcctctcgagtagctgggattacaggcttatgccaccatgcccagctaatttctgtttgaacctctttaggggctagaaaacaaaccttgttttcctctactcttccggtgatttttattcttccttccatccccgctgtgaatgtcccttccccagagagtcttttcctaaccaccctttattgtttccttccacagcaccccactttttcctgcttctagcatttattgcagctggttatattttcattttgtgcgtttacttcattcatgcctctctcgctccaccccaagaggacagggaccatgtctgttgtgttcacactactgtgtccccattttccagaagcactcgtaagagcacagtagctatttgtttaacaaatatttgcaaaatcttctaactgggtttatacacttgaatttcccccggctctaatccagtttttacaaagcagccagagaaatgtgcacaaatgtaaaccaaatcaacagcccacttaaagctcttaagtgattcttgtgctgtttgttgaacaaagataaacaagacaatccctaacctcaaaaaacacacagtgaggctagggctcactgcagcctcaacaacggaggctaaggcaggaggattgcttgagcccaggagttagaggctgcactgagctatgatcataccactgcactccagcctgggcaacacagcgagacctcgtttctaaaagtaaataaataaaattttaaaaaacccacaggtcactgtctctgcttatactgttttctaatgggaccaaacttcccttatttcagctcctagagtcctgtgctacttcctcactcttatacatagataaagggaagacaaattgatgttttttttaaaaaaggaaaataatttggtaataactgtcaaattttagatgatgccgtagtttcatttccaggaattctcttataaatatatttacccaaaagcacaaaggacaaagggtcaatcacaaggatgtttctacagcatagaaggtaatagcaaaatcctagaagcaaccagaatgcttatcaaaggaggagcagttaaacaaaatatgacaccctcactgtgtagaatatattttgcagctattaataagaaggagatggccgggtgccatggctcacgcctgtaatcccagcacttttggaggctgaggcgggtggatcacctgaggttgggagttcgagaccagcctgaccaacatggagaaaccccgtctctactaaaaatacaaaattagccaggcgtggtggcacattcctgtagtcccagctactcgggagactgaggcaggagactcacttgaacgtgggaggcagaggttgcagtgagccgagatcgcgccattgcactccagcctgggcaacaaacgcaaaactctgtctcaaaaaaaaaaaaaaaaaaaggagaagtagcattgccatagtgattcagaacatggacctcagagccggattgcatgggttcaaatccccactctatcacttggtatttgtgtgaccttgggggcatgctgcctctgtttttttttttttttttttttaaacacagagtcttgctctgtcacccaggctggagtgcagtggcacaatcccggctcactgcagcctccgcctcctgggttcaagtgattctcctgcctcagcctcccaagtagctgggaccacaggcatgtgccaccatgcctggctaaattttgtatttttagtagagatggggtttcaccatcttggccagtctggtctcaaactcctgacctgaagtgatccgcccaccttggcctcccgaagtggtgggattacaggcatgagccactgcacccggtgaggtttttaaatttttctttaaaaaaaatttgggggggtaaagacagggcctcactatgttgcctaggctgtcgaactcctggcctcaagcgttcctcctgccttgacctccaaaagtggtgggattacaggcatgagccactgcacctagcctcagttttttaaaatctgtaaatgagggtaataatagtttccacatcagagggttgtttcgaggaataaacaagttaatagatattaagacttaaacattacctggcaataataagagctgaatgtgacattaatattaaacattgaacaatgtccatgccctattgtttcatttaatcaactagttttttaattgaaaaattgaaaagcatgtggttaaaaaaaattttgcaaaagatgatagggcatataataaaaaataagtttgtcttccaccccagagccaagctgttcacagcttcttaggaatctttcccgaaatgttttatatatatgcaaacttatatgtattaatatatttcacacatacccacactcaaacacaaatactccttttccttttaaacactctgccttgcagcttgcatttttttttttttttctctttgagacagactctcattctgttgtccaagctggagtgcagtggcgtgatcttggctcactgcaacctctgcctcctggggtcaagctactccctcccaagtagctgggattacaggcatgctccaccacacctggctaatttttgtatttttagtaaagacggggtttcgccatgttggccaggctggtcttgaattcctgacctcgggtgatctgcctgcctcggccttccaaagtgctgggattataggggtgagccaccgctcccggccgcagctttctttttacactttgtaatatatcttggaagttgttccatatcagcatatacagactttttttttttttgagatggagtttcgctcttgtcacccaggctggagcacagtggtgcgatcttggctcactgtcacctctgctttcctggttcaagcaattctcctgcctcaggctcctgagtagctggtattacaggcatccgccaccatgcctggataattttttgtatttttagtagagacagggtttcaccatgttggccaggctggtcttgaactcctgacctcaggtgatccacctgccttggcctcccaaagtgctggggttacaggcatgagccaccgcgcccagccagcatacacagatttaagtaattacttttttccactgttaagtttgtgacaaacccattgtcaaattgtgccatcataagtcagggactgtctctacagaggaactatatatctagtttcctattgacagacattttagtgggttatagtctcttgctattacatataatgctgcaattaacatctttggatatatcccaaatatagctaagtttaaaagaagataggctccatattttgttttttaaaagcatgtttgtgtgtgcataactgtgcacccactgaagttgattgcaatctgtaggaattcagaatgcaaggattggagagagcaaaaggcagtttgactaaagagcccatatgcttaagtgttttgttttttaatctctcttttttttcaagagaaagtctcactctgtagtccaggctggagtgcagtgatgtagttttggttcactgcagcctcgacctcccaggctcgagtgatccttccacctcagcctcccgagtagctgggactacaggcacatgccaccacacccagctgatttttgtattttttgtagagacggggtttcaccatgttgcccaggctggtctcaaactcctgggctgaagtgatctgccttcttcactctccctaagcgctggggttacaagcacgcaccaccgcacctggcctgtgtttttttttttttttttgaggcagagtctcgctctggcgcccaggctggagtacagtggctcactgcaaccttcgcctcccaggttcaagttattctcctgtctcagcctcctgagtagctgggattacaggctcactccaccacgcctggctaagttttatatttttagtagggacagggttccaccatgttggtcaggctggtctcga

SEQ ID NO: 219 - DNA, 46348 bp, Homo sapiens
ttaattggaatgaaaggaatggaggtgattttgcttagtgaatggtcatggagactgatgtttatgattataattagcaccaacttaattccagtagcagtgagaatcactgttgtactgatagataatgctgatggaattcttttgcttctatgaatagttggaggccagaagagagttcataattgctgaatttaaaaatcatggcgcctagatctcatcggaattaaaaacttttgctctatgaaagcccatgtgaagatgaatagacgtgccatagtgtgggagaaaagaatttcaaaccacatatatgacaaaggactagtgtttagaatatataaactcaacagaaaaataaataatccaattagaaagtgggcaaaagacataagcagacatttcatttcagagaggacataaacatagcaaagcagcacatgaaaaggtgtttaatatcattagttgttagggaaatgcaaattgaaaccacaatgaaatatcactatacatttaacaggatagctaaaataaaaaatagtgacaccaccaaatactggcaaggatgcagagaaaccagatctctcatacattggtggtgggagtgtaaaatggtacagccactctagaaaacagtttaacagtttcttacgaaactaaacatgcaactaccatatgacctagaaattgtgctgttgggcatttatccaagataaatgaaaacttaactctcacacaaaaaatctctaggcatatgttcatggcagctttatgtttagtagtcaaaacctagaaacagcccagaagttgttcagcaggtgagtgactaaacaactgtggtacatctgtaccaggaaacactactcagtcatacaaaggaacaaataattgatacacacagactggatgaatctccagggaatcatgctgagtgaaaagcagccaattagaaaagattacatacagtgtgattctatttataaaaaattttgaaatgaaaaacattttagaaatggaggcagattagtggtggtcagagggcagggatagaactatggatggggagaccaggggaggggtcgggaaggaggaggttatgtctataaaacggcaacacaggatctttgtgctagtggaattaagttggtgtctcgactgtggtagcaaatacatgaacctatgcaggtgataaaattgtatagaacttaatatacacacagacacacaaaggaatacaagtaaaacttggcaaagctgaataacatcagtggagcgtatcaatggctttcgcaccaaagtggtaaggatgtcctggaagatcaccagtaaaacagttttggggaacaatacagttgttggaaatagaaagatgggaaatatccagttacaaattgcaaatggcagcaaagttttaaatttttcaaattaaattatacaagtaacacataaagatatctccttgtaaaaaggtaaaagagtacatacaaggagcaaatttgtgttctttccaatttcctatgcctttacacacatgtgtatatagtgtaaaaaaactatttgctttaatgtaattatgtgttcagtctatatcattttggaatttcccctttttattcaatataccctattattcagtaccttttaattcaatataccaatataccttagtagtttttccatattaatgctgtatgtgggtctatttcttattttaactgttggatagtgttacagagcatggctatgcatagtaattaatgcactgttcaccactgatgaatattttggttgtaggtcaatttttcactgataacaaattatactgcagtgtgaaatccttaatacagtaccagtttgcaggtgtttctagggcaaacactaccaaaaactggaattactggttaataggatatagatacaggtataggtatagggtgtggagaatgagagttacagtttacccattactctttgcctcctcttctttcagtactagaatctgtcccagtgaccttgctatgctgggtagggtaaatttttatggtgactatattaaggagagggaaaatgagtgatccgagatgtatacctttgttagtgtcatttcttttattggtggagtttgtaatattttaatcattgcagtcatttgtggtaaaacttgctattttaggatctcctcctgttcctgaaaatgacattggaaagcttcatgcccactcacctatggagttgtggaaaaaagtgtatgaaaagctctttccaccaaaggtacatatttctaatttttttaaaagcaagacttttagcactgtctaacagttataggaaatgtgtcaaagggcttattatgataactttgttttcatcttttatgctcaaaaatcaattaaacatttgctgaaaatgtaaataggcactgtgggggttaaaaaaaaaaaaaggtaagacatggttcctgctccactttcaaagagagttatctggctgttagagaagggagagacaactgaaaggggacctggcagaattggaagtgggcctcagtggtgatgagaaaagctagaaagatcatagagagcctttgtggcaggctgaggaatgggagcttggtttattaggcagatggtagccattgaattttggtttatgggcgtgaagtgattttgagatttgtaatttcagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattcttaccttgctgctggagagacattttcttaatagtctttggtttgtggaattacatgaagagctttgtttttgattaggacattcagacatacctatactttccttgtactagaaaacgtatcttgcccagttaaggactgaaagcacgatctgaaagcacacagacatacctgacataacccaggttctctcaggaaaatgcttaaaagtggacaccaccatcccatgtatcactagatagccccatttgaacacacaagtctgatgtaagaatgttaagagttggcaaattcaccatcactcaaatacttagatttttcttttctttttctttttcttttttttttaagacgagtctcacactgtcgcccaggctggagtgcagtggcatgacctcggctcactacaacctccgcctcccgggttcaagcaattctctgcttcagcctcctgagtggctgggattacaggtgcctgccaccacacctggctaattttttttgcttttttagtagaaacggggtttcaccatcttggccaggctggtcttgaactcctgacctcgtgatccatccgccttggcctcccaaagtgctgggattacaggcatgagccagtgcgcctggcctagatttttctaaaaacaaacaagcaaacttagattttagttttatttgataaaatgagacgttgtacagaatctgtccttatatgagtaaacttatatatgctaagcactagatcgaaagccccagcaacttctcaggtggcagtcacgttgttgcgagggtaacctgaaaacagctgtcagctgggagtaggagccagggtttttttctcagtattcaccttcgggggctgttggagaagtaagcaaaacattttatgtaaacggtccagaagacttttgaaaaatatgccatgaatatttagaggttttatagctgtagcaaagtgagaggcatgttgtagaaacaggaaaatgaccttatgtaacccttattatgtttgcagcctggctataaggattagttggaagtcatccctgattaatatttatctaggagtcaatgattaactgttgttgttgataagaatatctgtttatattgtataatgatcacttttattaagttcatatacatcagtattattaaaggattagggtatttgtgagcatcatgagttttcacattcaaatctgtcttctctaaatgacttaaaaccataagaattttgtgtggaaaaggaaggcagccccacagtacccatatcacccttcattcatctcttgtatctcactgccagcagatcaccaattcctgtcatctcttggttcgagatttttttttaacctacctgaaaagttatgctgtcctaagtttgcctctaaaccacttttatttgtgtggttttagacgaattgattccagattgcacacacaggaccttaacataattttatgctttagctgtaaagataccctaacaattaccagtgttgttgctgttatttcattgataatccgaatctaaattttgacattctactatataaaatttttaatttgaatattatttcatactatttcatgagtagttgtgagaccttaagttgtttccaattgtgtgctgtgaagtcagtcctcaaggatctgaggattggtaggaagacccctttcatctttcctgcagacttagggtctttcgtgattagccctctttaattatttaaagttctgtcttttgccagacttcacatgggcaccagaaaatacttaagtagtattttctgttttttaaaagtcctctagctttagagcattcccgattttaagggaatgcgaatgtggaaagcacttgctgagcccttctacctcttttgtgtttttttctttttctttgatactgtgtcttgctctggcatccaggctggagtgcaatggggagatcatggctcactgcaaccttgaactccagggctcaagggatcctcccatctcagcctctcaagtagctgggactacaggcacacatcaccatgcccgggtaatttttttgttttttgttgcccaggctggtcttcaactcctcgcctaaagcaatcctcctgagttggcctcccaaagtgctgggattacaggcatgagccactgtgcccagcttcttttctattatttttgttaaagcaaaaaaaaaaaaaaaaaaaaaaaaaaaaaaggttacagttaacatttatttttaaggtcttcttggccaaccacagttatcttcggaaaactttacttgctatccctttaaaacatcaatgcattattttgaggccgtatcattgtcatgttgaagatctagtggacttggtggtttttgtctcatattggttattcctttttctccctctggcatggcctgtgtgatagccctagttttctcacagtctgctgtctgcaaaagggagatactaccagcaaagaatctcaaaacaacattttcacctttgtcattggtaaaaataatttaacttccagttaaagacaaagtttgcagtaaacaatttgtttattctttatgagttaatctttaaaaccgcaagtggtagataactggtgaactgaattagctttattagaaaaaaataaaacaagctgtaaagactacatatgattattaccatgaaaattcttcctagaatccaatgaggaagttaaaggaaaaaaaaaaacacacaaggaaaaattcttcctaagtctatataccattttgaaacatttaacatttaaattttagtaacttagggtataggtatgaaaggtacgctctgcaatttttctgaaaattagaatggattttcttttcatagcaactgtgaacttcagttatgttagccaaagggcattgattgcctcatcttgcagagtaaccacgttttatttgaagtagtgacaacctttgtacagttatttagacattgaacaacatgtaggaggccaagaggcatccccttagatggtcccttttacatgtcagttgccttgtgcaggatagccacctccactaaaatttatttatgaattgtaaaggtaagatatactccttgtgaaaaaattcaagagctatagatagatgtatataaaatagaaaatggaagtatcctgccctctccctatctgtgtgcttttttcatgtggcacacattatgttttcatgtggccactgttatttttgctggctgccttggaagccacctgtgaatgaacgctaattatttaatcagtccttactgggggacatcaaagttgtttccagttgtgctgagacagagcaatgggtttccttcttttacatccttgtgcattgctctattgttatggatgataaatttctaaaagtaaaatcactgggacaaaggatacacacacacacacacacacacacacacacacacacttttttgtgacaggatctcactctgtcacccaggctggagtgcagtggcgcaatcacagtttactgcagccttggcctcccaggttcaagcgatcctcccacctcagactcccaagtagctgggaccacagcgcacaccaccatgcctggataattatttttctcagtttttgtagagacacggtctccctatgttgcccaggctggtctcaaattcctgggctcaagcaattctcctgccccagcctcccaaagtgctgggactataggaatgagccaccgcacccagcctgggtatgtattttttaaatattttgctaacttcaaccaagtttttgattagagctgaacagcaaacaattaaaataagatcacttttgaatacttgaaggatgacagatgtctagttcattagttgaaagacaattcatatgtattatgtagtttatgtacataattttgtctgaaagtttaataaattcatctctgagtgctgcttagccacacagaaactctgaagacagtatttctagaaaataagtcctaagcataatcatttacaaaataattggcaagaaatatttagaatgataatgctactaaggattcattgatatatctaaaaaatgagaaggcagttttaaggtgcctccttgaattagtaaagttgatttttcttaaagtgatacatatttttgttttaggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactacctacctctaacatgtttaagtggtatatactcaattcagcatgtataagtttctgcttatatgtttttaggaatataaaagtaagagtatttggttacagttttaaatgcaaggttaagtgcccacgttagacacattctttctaaaaggcattctcagctgtagctgggaggaaaccggaattgggttcacagatgtcaaaattttactcttaacagtgaggcgcaagaagcacctgaaataggagatgcacattcccaggtccccacacctagagtgtcgccatcagtggtctggaatggggcatttttaatcagcaccaatttcaccctgctgtgagactgacacatttattttaaataccactttttgaagaacaggcacatctaaggagatatcctatcaagaagcaggacaaaacatcatgtgttgcggataaccaggattatttccaaggtgggatagcctttaagaagccattccaatctgtagatgtgtgtacctgctagccaagttcattttgagtaagtataattgctatgattaaaaatgatttattctatgttcttccatgtccacatacaaaatatattgactcccagcttcagataagcacatttactaccccaagggagtactgtctgagcagatagcaagccatctgcttattgcaatgaactaggacttcataaattatttgcagtacgtatggttctgacacccttgagaacagaattttcagcatgtttccaaggaacctcagtctttagcacacgtttcttgctgagtgctatggaaaaagaaatccctttaaatttacagtgaacattatgatctcagaaacatcactgacttggtgggaagaaacagcctattccacaagagtaataggaattgttattatgtaatttgattttcttacacatcactgtccatttttgacttgagacacaaactgtcacatgttgaaagccattgtgtttttctaaggtgctatcactaacatttaatagcttgaagtcacgtgtgatgtcagttttccaaatgtttctgagctagaatgaaattcatctgcatatgaatagtagaaaatgtttccacttatgttgtacacccatatctttagtaagttgaaatcagtgatttcaaaagaggttcctgtgggactctctttgaactactttaatagattatcatctccagaattgtctataactgatgtgacatatataatctgtaagacattgtgtaactattacaccataatcatccatgtcaaagaccttttataaaaattgacaatactagtctgataatttaccaatgcctccacatccttaaatactgttctaagaaatagaattttactgtggtttccttaatgaaatgatctttcctatttcagtgtgagacatttcaaatgctataatttatctttcttcacaagttaggtcacagtcagtgaacaagttcatgcgctctctaccatattctcacccaaagttaccatagtaacactgagacagtttcatttcaggtttgtacatggaattacttgaagatcaatcagaaagagaatcagtaattttaatacagaacctttttttttttttgagacagagtcttgctctgtcgccaggctggagtgcagtggtgcattctcggctcactgcaacctccacctcccaggttcaagcgattctcctgcctcagcctcccaagtagctgggactacaggcgcctgccaccatgcccagctaatttttgtattttttagtagagacggggtttcaccatgttggccaggatggtctcaatctcttgacctcgtgatccacccgcctcggcctcccaaagtgctgggattacaggcatgagccaccgcgcctggccagaacccatttttaataacctatttacattattttatccttgaaaatatgtaatacaggtgtctgtatttatacatatcagcaccctttacagttcaagaatgtgaatttctagtatgtaccctgttctttgtaaacaatatgtcagcactttttttctttcttttttagagacagggtcttgctctgtctctgttgcccaggctggagtgcagtggttccatcatagctcactgcagcccctgcctcctaggtttaagcgatccttccacatcagcctcctgagcagctgggattacagatgtgagacaccatgtctagctatgtcagcatttttttctatatggactttaaataacagctgatctccagccttaatggggttatttctcagtgcatatactttagtaaagtttacttgtaattcttttttttttttttcggtaggtttttttttttttatactttaagttttagggtacatgtgcacaatgtgcctataagtaaactcagctgaaagtgaaaaatagcaaacgaatctttaaaaacataaccagaggtttgtctggtgtgctttgttcactgttgagcccattcctacggttttttattttaatcctcagtaaaatcactgggtgctctgtagcagtggtgctcaccatccatctgcccagcactctctcgatgtgatcaggtaactccgacccctcgtgtggacatctgcatttaactctgggtcttccaggaacagaagcattcttacccaattctgcatgataaccttgcttcatctaaacccacaactctctttctctgtcacttatggtcaggaatccttgaaacattttatttttgcctaatcctttatccaatgtaaacatatttttaagctgacctatttttttctgtgcctagaacaaggaaaaaaaatagtcacacgagtctcccataggtttatgaatattatttacattcttgggtccgctcagtcacaatttccaaataaccacatgtccctgcaagttgtaagagcaagggactataaaccacttccattgcattcaaggcctgcttggatccaagaggcacaaatggagtcttaatggttaaaagacttgagatgtcctgtcaagaaagaaatacatggcactctcatttcagacgttcagagcagtcatgcacagtcggcagcttcacttccattttcccagccatggctttcactacctgctaatgagatgatcccttattttgaaaacaactattcctaggatgacaagagctggaataaatgaatacaaaatcagaaagttcattgtgaatctagatgttgcacctgggcaggttttctcaatgaattgaattccttgagtgaaggcacacattggattagttgtcacagaaacatttgagctgcctgtcaaggaaaagattgacagtgtcaggtgtggtttatctcaggtaatttaatcaacaagtatttaccaagcgcttgctaagtacccttaatgaaaaatacaggacactttagcaagcccagagtttacaatttgatgaagcaagagtgagcagttctggcctttggcttcatttgaagatggacatgcttttgtttctattttgggtatagattcattaccatatttgtgataaaaatcatgatcccttagcacagactatcctaaagttactgacattatcacttaaaattatttaaaacactactaaattcagccatattctttggttgtctttggagtggccctgagatttttttggttgttttttttttgttttttttggggttttttttttcgttttttttttttttttttttttttttgagacacagtttcactctgccgcccaggctggagtgcagtggctcgatctgggctcactgcaacctcagcctcccagattcaagtgattctcatgcttcagcctcctgtgtagctgggatttacaggcacgcaccaccacgcctggctaatttttgtatttttagtagagacaggtttttgccacgtcggccaggctggtctcgaactcttgacctcaagtgatccaacctccgactcccaaagtgctgggattacaggcgtgagccactgtgcccggccaccctgagatttctaatggccatgaggtccttgtcttggttctacttccatctggtgggattgaggaatagacttttgccaaaagtagctttatttagctatgtacgatgtacattttggggaacaagaagccacttcagcctgcttgaatgtgttcagtagatacaggaactgagtctatccagaatattctggagtttacctcagtgtacataaggtctgtcattttctaacaacatccaagtgtcccttacctgttgacctttgacaggagactaacttgactactgcttattttctttcatcttaaaaatcagagaaaatgttggactgtatttcaaaacagagttttaaattgaattattataaaacacagtttttatttcaaaaatacatttcctccaagaaattgcttcctcagagtaacatgcaaaaataatatccccaaatagaatacttaccacaagtgaaattcagtccgtagaactcattgactacaagaatctcactgcaatatttttggaatgtaaaataactgatgattttaaaaggaatgggcatttcttgtatgtttcttaagaaaaagaaaacaaaaatgaaattcagtaggctctggcaatagtcctaccaaatgaaaagaaaggcaatccttatattttccaacaggaatatagttttctatctccttattataaaaatgatgctcactataaaaaaaccttcaaacaacattgaacaatataaagaaataccgttgcctagaaataactattgttaacattttggtaatatatataacatgtgtgtttaaaagttttatataaatggaattaaactcttcatgctctttcctaacttactctttttctgccaaacatatgtctcagacatccttccaagtcagtaagcatagcactttgtcatttttaggcacagcttggtggcctgttatagtgaagaccttaatttaacagttctctcaagtagacgattactgtctacttattttggtaagcactactgatataaacgtacaagaaaatacagacctaacacataccaattggaggaggagatttgtgattaaacagaaagttgaaggtaccaacgtagaaagttagaactaacctagaatacaaaggaaaaaggaaggagagaccgaaccaacattcattgtgaaaatgaaatatgtctcctctccaatctatttcaggtgaaactgtgtgctgacactgtggtcttcttagtccactgtatattttctgtcaatcaaaaggtataaaattctttctgtttgcaaggcactagttctaggagcttgagaacttcaaaagatgtatcctatccctaaagaactcataatgtagttggagatatagaatatatccttaaaactataaaaatatacagtagtgaactatttgtgccaagaaagtataaaaaaatgtgtaccacacatccatgatgttcttgtatttagtatttatggtttcacctatttgcaaggtgtcctcaacctttcagtttcctaaggcacaacattgaattaaccacattgagaggttgctaattgaaaaggatacgtgggactctgggaaggaattaggggaagaggatggaaattctaggaaggcagaaatggtatgagtacaggtatgccaagggctgcatatgggactgactggaccagaaacactggaagagaggatgtgaaggaacagtgggaggggagctcggaacaatagccagcaacagccatttcagggccttgctgtgagttgaggttgaatgaccatgaatgagacaggtcacgttgaaatcagcattctgagaaaattaacgtgactccagcaagaaggatggctagaatgagggcagagtaagaacaggaaaagaaaaaaaaaaaaaaaaaggaccagactacaaaaaaagttcaactatgagatgacaaaggcctggagtaggatgatggccatgagatggtggctgcctagtggctagggtgctatctttctgaggtaggaactgtgaacctttgtttctccctgtaccacacagagtcaaacacaaaatgttccacatgcacctatggtttgatatcagaaaagaaaaccaacatgatttggtgagtgatgcagtgtgtatacagttcaaagacagagtcatttacttattcactcaacaaataatgtttgcaggcctaattggtccaaggcctaattgggctggctgctgagagggtctaaaatgatgaatgagacacagctgctgccttcaaggggtggataatctattacagcaaaggaagaccgtgacaggaagtagtgtgtgataggctgagagagaaaacaaaaggggccttcaaagagagtgcgcctctagccttgggaacaaccaacagactttgtgcaggtggcggagagagagaaatggatcagtgaaaggcacagacagaaggagaagcagcgggaggaaccatagatctggatgtattgacatgacattgtccacattaggttggtttgtgctttgtcttttttattttttgaacggagtcttgttctgtcacctaggctggagtgcagtggcatgattttggctcactgcagcctccgcctcccaggttcaggtgattctcctgcctcagcctcctgagtagctgaaattacaggcacgtgacaccacacccacctaattcatattatgttgttaaatgggaaaaaaagtatgcatattttatatcttatacaacaggatgatttcatctttgttaaaaattatataaaattctagcaagaactacaacaaaatttaactctaggctctgatacttcaggtaacttttactttcttccacatccacatttatattgtgagcacttcttcccccaagaacttgcatgattttgtaagcagaaaacacagcaaagctaatttcctttgtgtttaaaagagaagggagccaacagcacaaatgccttaggcagttcacccagaaagatgatgactggggagaaaaatgggtaaatggaatgactagcaggttgatgtggcctttaagagtggagttttaattttcagcgatggaagtggaattcatatgaagccttgggttgttaagattttgcaactaatctgagaacatttagtattctttgcaactgcctaccttttaagagcaattaaccaccaggtatagtggctcacgcctgtaatcccagcaccttgggaggccgaggcagggaaatcacttgaagtcaggagtttgagaccagcctgaccaacttggtgaaacctcatctctaccaaaaatacaaaaattagctgggcgtggtggtgcgcacctgtaatcccagctattcaggaggctaaggcaggagaattgcttgaacctgagagacggaggttgcagtgagccgagatcgtgccattgcattccagcctgggtgacagagtgagtgagactctgcgtcaagaaacaaacaaaaataaaaataaagagcaactaacctccttttcctaaaaccctaatacaaatgcttcttatgatggggttacttccagataaacccatcataagttgaaaatattctaagttaaaaatgcatttaaggccagacgcggtggctcacgtctataatcccagcactttgggaggccaaggcaggcagatcacctgaggtcaggagtttgagaccaacctggccaaaatggtgaaaccacgtctctactaaaaatacaaaaattagccaggtgtaatggcaggcacctgtaatcccagctactcgggaggctgaggcaggaaaatcgcttgaacatgggaggcggaggttacagtgagccgagatcgcgccactgcattccagcctgggtgacagagcgcgattccctctcaaaacaaacaaacaaacaaaaaaacacatgtaagacacctagcccaccaaacattacagcttagcctggtctaccttaaatgtgctcagaaagcttaacgttaacctacagttgggaaaaatcatctaacacaaagcctattttataataaattgttgaatatttaatgtaatttgttgaatatttaatgtaatttattgaatcctgttctgaaagtaaaaaacaggatgattgtatggctactcaaaatacagtttctaggttggctgcggtggctcacacctgtaatcctagcactttgggaggccgaggtgggcgaatcacttgaggtcgagactagcctggccaacatggcgaaaccccatctctactaaaaatacaaaaattagccgagcatggtggcgcacacctgtaatcccagctattcaggagactgaggcacaagaatcacttgaacccaggaggcagaggttgcagtgagctgagatcgcgccattgcacttcagcctgggcggcagagtgaaactgtgtttcaaaaaaacaaaaacaaaaacaaaatacggtttctacagaacgagtatcactttctcaaaaaatcataagtcggggatcatctgtacatgaaatggcaccagattaactgaaacaatgattcaaataatataaaagaggaaatgctgcccaaggttggctctgtacattgctggcttgattctgtactcttggtgtgatttgatttctgcatttttcataaatattaacaatccacttaagcaacacggacaaatacaatatcatggtcttcgtgtgaaaaaatatcctccttgatttatcaaagcctaattcactttgctttataatatctcacttcgtataactcactgcaatttataatgtgttttcatattgattatttccgttccttctcatgatcccttgaggcaggtggggctgaaatagtgatctcttttttataaatgaggaaactaatttagatagaaaagagactggcaagtggtagaggaagtttctgactcataggtcagcctctctccacgaagtcacgtgcgtcacagccttcatagtggtgtgacttgagcaaagtcaagtctgagcttcattttcttatctgaaaatggattgctctgagagttaaataattaaacacacacatatacttttatatagtagatgctcagtaatgcttttgctttttgacttgatttttacatttttaagtcaaagaaacagccttcatgtttccttggggacccagagattacttactagatcccactcacaccacctgcctgggatcatttttagccttttaaaattttctgccctttttgctgctgctttttaaaaatgtgtgtggatacattttttcctggttataaaatgatacttgtccattacagaacattgataaaatacagaaatatgaagaaaaaaattaaaatcaatatcactattgatattgattttagagatagagataattactgctatcatttggtgcatatcctttaagccttgatactctttggagcagtcttttatcctgcaggcttttttttttttgtctgactagtcttaattcctaagaataactgggaattgagaactgcagttcacactcaacagtaccaggtcagaaatgaactaatgcatgcaatttatttagcctatcatgtgggctgtgagtttttcctggaacatccgggctggttttcttctcttggtataatggtttattacatgtgaatcatatcataacataaacttgttagttcctgattcccgataaaaaagacattttattgaacaaatgaacagttcaaggtctaaggcaatgattaacgagcagtataaatgctctagactataaggtaatatccataaccactatcagttctctggtattcctttacttcagtcattattaggtgatcattaataacagattatcccaatctaaattttttgaattatgatatcttacctgaggaatccagatccaacaagcacccccgcaatggacagcagagccactacactgttgactatatttggattttggacgataccaagtagcacaagagttagaaattcaccaattaagtggggggccaagagagcagcagaaaaatatccaaatcgggcaacctcaggatgtaagcccagcgtcctagaaaagcataagctctttagtttcctctccaagggctatcatttaagaaaaatactgcacttgcctctgtgaataaatcctttgtggtgagtgggtgggagaagtttgcagggcaagccacactcccctttgaaaggccgttttggaaaggagtcaacatgagactatttattatatcaaattgttcccattggctgcaactcattgggagccaccttttccctttcacggctccttcagctctcataggaaaacattaaattacttagacaatggtcacaactaaccgcagtaagcaggcttgttgaactctacaggcatcttcataaataaccatgttctgcctagccaacaccacacctacctaatgttaaagggctcacccaacccgcttcccagcacccccttccctgaacctcatctctgttatatgggattattgcctacgtgaaaatccctcacttcttttgtcctcgatcaggttagccctccccagccctactccattccattcttgtcttttattctaccaaccccttccactgatttgaccttcgttttcttttttgagacggagttgcactctgttgatcagactggagtgcagtggcgtgatcttggctcattgcaacctctgcttcccaggttccagtgattctcctgcctcagcctcccaagtagctgggattacaggtgcgcaccaccacacccagctaatttttttgtatttagtagagatggggttttgccatattggccaggctggtcttgaactcctggcctcaagtgatctgcccatctcagcctcccaaagtgctaggattacaggcatgagctaccatgcctggcctgaccttcattttcttgtaaacaaaccaccctatatccatgcacctttcctcttatattcctttctccaaattacatttccctggtgatagcgtatcttcaatgaccattaggcatggctgctctttatcccatttgtagagtaagcaaaaaatgttggcatgtcttatactcgcccctccttaccacttactcttcaaggccatctacttttcctctgtacaaatcatgaagtttgcttatgctatcaatgccgttcctcattgttgtcttctgtgatgtttaaaacatcctcttgcctttgatgattttatagcatctggaccagagtcattctttttgctcctctcccctatcattttcctcaagctctttaaccttcttgatgagccatccacatcagtggttcctaattagcgaatctcaattccaatggctccagctacctaatctgcatcactcaccatgtcttggacttaaatattactcaaaatggtttcgctcccaggatttcagagtctgaggacaccctctctgagcacagcctcctgcctctcacttccccagtgccctcactgccgcagatgctggaccccttctgccattctttgccttatcagttcccacatctggggaccctattctcccttaagcaatggaaggtgtgctggacaatgcctattgccgcactaactggatcccctctgccactttgcctcagctggcccctggacccctaagatttccttgttgtgtcttgaattctaatagcatgtcccatgatgactgatataaacctctactttaaaatttcccccttcccaatttcaatctctctccccagtgctcagcagctgaattcacctcccattttatgaatttcttgatatcttcatcatctctatttttcattctctctctctccccctctcttcccgcaccccatctttgaaagtgtgaccctagctgcttgcatccttgatcccatgttattctgattcccctatccctaccttggtctactctgggaacttcctctttgacttatccaaattttggctgcattttcatctactctcaatctgatgttttttgatggtcttatttaccacatcctaaaataaccattttttgaacttgatcatcatttaagtaactgcccctcttcatcctaccctgtaacaccaagtttctcaaaacagaatctgcttcctccatcttacaccttcccttcttgtaaacctgacttgcacccccatgactctaccgaagctcttttttgggaaattgcaatggccttctccctttatgcttcacctcctttaacccctgcaatattgaagtgtttatgacacttccttgaaactctctccttcctcatcctctctgatgctgcccaatcctgcttctctttctacctccctgatcaccctctgcctcctctgttggttgctgtcctcttcccaccctctgaatgtgtctgttttaaggttttacattcaggctgctttctcccctcccccaggcccccccccatgcacctgggtcctagctacttcagagtcctctcttctctggcccaggccctgccgtgaatgtgggacaggtcattcccaggcacatgtcatcttgttggtttgttctcaggtctcctgcaacccacagttgggctatttacaataaaattaatgtcctggaagatacgacattgcactagacactgatgggcaaagtgtagatcctccagagcagagaacttcaccctggagctctccctgcacgagtcccactagctccatgactccatgggagcccggccctgggtgaactgaacaacccctcaccagtagcacacactgctgaaaatcatggtggcaacaacgctgaaggggaggacgtgcagtgcataggccagcatcatctgccacttctggtagaggccgtcctgactctcctggtcgctgacagctcgcagcacgggaactggggatggaaggcaggtttcagaacagtcagtcaccacccagctgaaaaagggagggctagcccaagctgaatgtgaggtctgtcagggctggatggtgaggaccagctaggggggttccctagtcatagaaggaggggacctgccatccacaggacaataaatccccaccccggaaatctacactctaccagaattgcaatacaattgcaaaagatgtcatttatttccttctctctaaagtggggagttgtcaccaattcacgaaaagtacatgcaaaaggggcatgaataagtgatttgaagcactttgtcttctttctgtgcaggattccccccaccccaccccgcccccaccaccagcagcctgcattttagacttgctctcggaaggccaggcaaaccccacagatgcagacacttagcattgcccctcatgtcaagctctagagcaacttcacaatagcgaagtccttccctcttattccctaacagtgttgcctttggggaatccctctaacacctgcttcctgcaacgttaggcaaccaggttttgtctctggaattccactgaatttgaaaattaggtgctggctgtcctaaaatcagctccaaagagaagctaacggtacaaagttggcctggtcgctgagcaccccatgggctgtgcatctgagatggccaagatgagataggaggaatgatcttttgaaaaactcctcaaactctccccaccagtacattgtcacttcatgtttccctggatccttagccctcagagagatccacctggtgagctcattcatattaacgtgttggtaactcaatagttgcctttccccagagagggaacctggagagggctgggtttagctcagagaaaaacccttataatggtagacttttgtaaggttacagctggagaagggaggtatttagggagaaagaggtgcacctccagcacgtgggcacttacacagattcacagcgttcagcatgcctgtgtacggggtggcgcccacaaactggtaaaggagacctacgcggtcctggatagcaccctttagcacattgcttcggacccgcagaacgaagaaaaggaggaacaaacccatgatcagattctgaaggagacgcgtaatcactgccagcttatttctcaccaagtttcttgtcactctcctgaaaacaaacaaccctgttttaattccttttcagaattgttattgggggatggctaaagacctctaacaggcatttctcacatttgtgagcctcttacctcaggagaacacccagtttagagaaaactccaggagaatctttggttttgaaaggaaccattggtaacgttttcaggtgtttcattctttcaatattcttcaaagttttatgacaaattgctgatttcttgtaggcagattctatcatctggactctcttggaggtttctatttcccgttccttgctttgggtatccactgacgtcaggtccactaaaagtttttcccaaaagatgtcacccatgtgtttttaaatgcatgtatgtacatggatatacaattggtacaggagtactggccataatacctcatcccatcaagataaaatttgtggttaatgcccacctataaaatcagaatactttaaagcatcccagcagggccttgaggatcccattgggattgtctgggagaattcagaagctcagctaattatgctctgataaagtagtagcagtgcgccagtttgtttgagagagatccctgacctcattctgatagtcatctctggcaagttcattgacccggccaaattgattccttgaagagtataaaacacaaaaacaaaagcaaaaatcaaatccactagactggtgtcatccaggcagaagtctgagatgagaaagtttaaaaaacattcatgatggggaatgtgaaagaaaaacttactatagaagtcaaaagggtttgaatgttcaggacaagggtaaccgcagtcattgaagaaatcaagcatttccgctggcgtgccacagaaaatcagctctccgaagctcaggatggcaattttgtcaaagagctgaccagacaacagacgtagttagtgtgtgatcacaagggtagcgatgcactttgaatgtctctgggaacactgatgcagggccaaggtcaggtattccttatggtcaccaagtccttatgggaaatgcatttcccataagcagtcagtccttcgatgaccttggccctgcatcagtattcttggagacattcgaaatgcatccctacccttgtgagcctaggctaccactgtgggtcatgctgcctcccatcctgacgcccagcttcatatctgggatagacaagcatgactggacctgggcgtaagtcccagccaagccaagtgagtgacctcgggcgagcaggggtgggtcttagtttgtttttttgttttcattttaaatctcagctcctcctctgtaaaaagcaaataatagctaactaaagggatactgggcggagaaagtgagtttttttggaaggaaatcagtatgatttcgtggaaaaacacagcctttgaagccaacttggctgtgaaaggctaatgctagctttttactattaacaactgtgtgatcttggcttaatttgttgttgttttgttgttattgttgttgttgttgttgtttctgagaccgaatctcactctgtcacccaggctggagtgcagtggcacaatcccagctctctgcaacctcctgggttcaagcgattctcctgcctcagcttcccgaatagctgggattacaggcgcacaccaccacgcccaactatcaattttgaatcattgctaagtttcactcttttcctctgtaaggtgaatacactgaaacacacctcataggagtgttgtgcagatgaaatgagctatgtacagaaagtatttggaacatggtaggtgctgaaagaagtgagttttcatcctttgctcttcccctctcaggagctgttggctccaattctctagcactaacggttttttgtttgtttgtttgagatgaggtcttcctctgtcacccaggctagagtgcaatggcatgatcacgactccctgcagccttgacctactgggctcaagcgatcctctcacctcagccttccaagtagctgggaccacagatatgcaccaccatgcctggctaatttttctttttctttctttctttcttttttttttttttagagatggggagtctcactttattgctcaggatggactcaaactcctggcctcaagtgctcctcctgcctcagcctcccaaagtgctggaattacaagtgtgagccactgtgcctggccactggtacaaatcttgcccctgcccctgtgattcccagctcaacacaccatagacccggcctttacgagttgaacctcttacctgaaaaagctcagaacggggctggtgaatggtgagaaccacaattcggttcctgcgagccagttccaccaggaggacgacaatctgattagcagtcatgcagtccaggcctgtggttggctcatcaaacagcatgacctctgccagcaaagaagggccagacttctaaggtagtgcagagcccaggctctgtgcttaaaactcagagttctgaactgttccttattgagtttgtaccccattcaaacagtgtgcggtgggaagtaaacatgtaaactggctttcagcctgagctcaggagaaaggacctgatgtggaagggcctagttcccagctctggagcacatgtgggctcaaatcctccagggcacagggagtaaggagatcaggcctcttacgggccatctgggctctgctcagggcaccctgtcagggaacaagggctggcaggctggcatcaagttgttttaaaacaagactgagagaaggctggtcaaaaagacaaccccatttcatgtctgtaacactttccaacaccagcagggtctttgcacagaaaagaaaaaaatctgacgaataaaacaaggcctgaagtgtggcaggcatttgggttctttagagggtttaaagtaacttatttcttcctaaaaagtgacaagggggccgggcgcggtggctcacgcctgtaatgccaacactttgggaggtcaaggcaggcagatcacctgaggtcaggagttcgagaccaccctggccaacatggtgaaaccctgtctctactaaaagaacaaaaattagccgggtgtggtggcaggcgcctgtaatcccagctactcaggaggctgaggcaggagaatcgcttcaacctgggaggtggaggttgcagtgagccaagatcgcaccactgcactccagcctgggcaacaagagcgaaactctgtctcaaaaaaaaaaaaaaaaagtgacaagagctgttaaaaacatctctcttatttgccttctagtgaccaagcaccatttgaagaacaggccgtcctggtctaccacagtgcaaagaaaggatccagatgcagtttgtcctctccagctgcatgagtggcgaggtttccccaggtgatggggaaaatgaccaaacctggcagaggactgactactctgttttgatactcccttccccacaacatatacacttttgagtttatcattcaaattcctattttaattcctgccatttcatgaacacctgtggtcatatcaaaactcattggctttccccagcccacacagtggtattgccctggtgagaagaaatgattggcagggcaaggctccatattcaaggaaaaccccaatggaacacttcaacaccaatgcaacgcttccgggtccaggagctgttttgtttggatgatggaatcgcatcaggaaatgaactgtacagcatttccaaaaaaactgggtcctcagtttgaaaaacctgtgatttcagttgtacacaaacccctttccaaatgaggaccgtgaagaaagggcccaaagtatctgcacacacacagaagatgcccagacagcagctagtaacagttctgggtgccacttactaggatcctggagcagctgggctgcgatggagacccggcgccgctcacccgtggaaatgccccccaagctgtagttgccaatcagtcggtctgccacatggctcagactcagctctgccatgacggcctccacctgcaggagacacaaattacaggaaggctgggagtctctgtggctgctatttcaattcatgggctggggaggacatgaaagaggcagcacaccgcccaagaatccaagggccacttccagactcaccacaccctggggaaagcatgtctttgataataatatgatccaattcggcttaaatcgtaatacatgtgtcagatttaaataaataatatgaattttttaaaacgtccccagaggctgggtgcagtggctcatgcctgtaatcccaatactttggaaggctgaggagggagaattgcttgaggccaggagtttgagaccagcttgggcaacaaagagagaccctgtctctacaaaaaaaaaaaaaaaaaaaaagaaagaaaaaaacaataaattagccgggtatgctggcacgtgcctgtagtcccagctactcaggatgcttaggcaggaggatcgcttgatcccaggacgttgagaccacagttagccatgatggcaccactgcactccagcctaggtgacagagcaagaccctgtctctaaaataaaataaaataaaatgggcctggcatggcggcttatgcctgtaatcccagcactttgggaggtcgaggtgggtggatcacttgaggtcaggagttcgagactagcctagccaacacggtgaaaccctgtctgttctaaaaatacagaaatgagctgggagtggtggcaggcactggtaatcccagctactcggaggctaaggcaggagaattgcttgaacccgggaggccaaggttgcagtgaggcaagatggcaccactgcactccaacctgggtgacagagcgagactccgattcaaaaaaaataataataaataaataaacaaataaaataaaataagattccctagaacacaaactgcttacacttgcttcaggaaaattaaccaggaaacaacagatacttcattaaactcctatttgcaggagccatagtcactgcagcccatacagaaaaatcccccaaattcatgattacaatatcgcttactttcataagtgtttgggttttgaaattttattatcataaatgctttatgtgtttacaaaaatccaacctgatttgaactaaacctgtttcccactgtataacccaaataagtgctggggtcccatgtggtacaatctcagtgtgagtccacatcaaagacatataatccagccttcagaagtaattaaaaataattccaatctttacttgaatttctttaaggactttaatggggacccaatttataacccccagccacatttaaaattccctttcttccaattctcttcgctgtacttaaagcctgtaactccctgaaaccgtttttcctcctcattctcaactctcccaaaacaataacgactaaaaaaaattctttactgaatttctaatcaagaagcttggcttttttcctccctcactgtctttccttcctcagcttatctcctctccagagacctgttcacaaatctgtttctgtccccctgtactgattacctctaactgcagaaaccccagggggaaagcagaaagagacagaagatactcatatggtaataagttttgtttccagacacccctaataaggccgtgttatgaaaatggaaacaaaaccattgcattaaaaaacaataagctagattgcagaagaagagggaatgacttgtggaccaacattcaagaggagtcagggagtggggttgacggcatagatgtagctttgacccacccaaagaatggacatatctgaaataggtacaaaggaataatgagaaggtaaaaatgcataaataaactagatatagatatattctggaacaaaagaaagctcttctcttgccatcagggtagaaggatcctagaattaagctttgcttgacacagtgagatttctgtgctgaccagccagggtagattcccgagcctccttctcatctctgtaacatcataaggagtaagcttgcccctcctggcttggaagagatggacagagaagacatttacttaatttgtctcagaggtttcacaccccagcaggaatgctctcccacattttggaaacaaattttggaaatggaattcagagtccctggaaggactattgggatgagcaagtccaaccctccatgctctgtgctttcacgtaatctgatgtattcttcacatcaaacccaggagaaatgcattcttattgtattttttatagaggagaaaacaaagttccataacttgcccaagataatgccattagcaaatggcagggccaggattgagaggactctctgggctctctgaagtggtccaggaagcctgagccttagccaacagccccgcagacatagcctgctcacattggccttgctttatttccaggttcttccaaggacagaagcagatctgccatgctatctcctttattatcatcagcacttccttcccactgaattacttatcaggattttacacgctgtgggctggatttgctcagaaatgactctcaattggagagaactctgctatcgggagttctcctgctcccagggagctgtgccccttgaaggaggcatgtccacctgtcattggttccctgggtgcttgtgggccttcccagtctagagagaaatgaagcagtttccaggtaaggtccccggtgggtttacctgtggctacttccaaactggagacaattaagaaagagattggaacctagaaggagttgacaattcaatcatttcttccttcattaactcagtccagtttggatgaggcacattcaagatgcctccaagcaagctgagaaaaatcagtggcaaaaataactatgtctgttcaaacagggaacttgtagaacagcatggtcccagagaagggtaatgcaagccacagacagaagtgaaattttagtagccaaattttgaaaagtaaaaagaaacaggtgaaattaattttaataacatattatttacagccaaaaataccatttcaacctgtaatcaatactttttgaaatttatttatttatttggttgggagagacagagtctctttttgtccttcaggctggagtgcaatggtgcaatcatggctcgctgcagcctcgacctcctgggttcaagagatcctcctgcctcagcctccttagcagctgggagtgcaggcgcacatcaccacgtccaactaatttttgtattttttatagagactgagtctcgctatgttgcccaggctggtctcaaacttctagactcaagcaatcctcccatcttggccttccaaagtgctgggattacaggtatgagccaccctgcccgacctaaaaattcttaatgggctttttcacgttctgttttcctcagactaagagtctgaaatttgatgtgtattttgcgctcagagcacgtttcagtctggactagtgacatttcaagtctccaaaggcacatgtgactaggggcagcacagggtgcacggtgcaggacgcagggcgcgctctagagtgaaggagtgacgagcaaagggaaggaatgggcaagcgtaggcgaagagaggagggcagcggggggtgcaaaggtactcagtttgccctctgtgagcggggggctgcacccaccttcttctggaaggagccgggattgccgcggcggatggccagcagcgcggtgtagtgcagcgtctcgcgcacggtgaggctgctcagcagggtgtcgctctgcaggagactcgggcgtcagtgtagcctaagcccccggggcgggcgggggggccaggggtgtgggggacgcgcccacctgcaggacgtaggagaagcagtcctggaactgctcccggcgcagcgcccggccgttcacatacacctcccccaggaaggtccccgcgcgccccagcctcccggacatggcgtccagcagcgtggttttcccggagcctgcggggcgacaacagaaggccctagaggaaccactctgtgccggccttggaggagcttcccgagaccctctgtgcaggcatgaccccgcgggccatgagtgctacatgacggaccctgttctaggtgttaaggacacagcaggatacaggccctgccctatggaacgcgcactgtgcgtgcagcagtctcacgcgcaagtgagtctctggattgtcccctgagtgagaggggacatgccatttctctcatctgggtcaagaccgaacgtgctttctctgcttgtttatttgtctttaaaactgttttggattgaaaaacaaaatacttataggtatcagaataagaggaaagccaagactcttggaaacgtttggatcctaggacggatttctttttgtgcccccctggggtggtctggttgtacctggatgtaggtgacattgtctagagccttgctcacaaagcaagcagcatcagcaacccctgagagcttgccagaaatgcagagcctcaagccgcacccaagacctgctgagtcagctctgcttcagtcgagtttgagaagcactggcttggtaagtcctttggtaagaccaagttggccacagcctgcactagagcctggggcatagcctagctggatgtcactaggaagttcccacagaggggttgtggtgaactaactgcctgctggaggtgactgggggatgatgcttcccttggtttgcttttttcttgagtgagactgagtgtcactctgtcacccaggctggagtgcagtggcacaatctcagcacactgcaacctccgcctctcaggttcaagccattctcctgcctcagcctcctgagtagctgggattacaggcatgcaccactacacccggctaattttcgtatttttagtagagatgaggtttcaccatgttggccaggctggtctcgacctcctgacctcaggtgatcctcccgcctcagcctcccaaagtgctgggattacaggcgtgagccactgcttttttctaaggttaaaggttaggtgatgcctttaggacaagaacctgatggcccctcagtcatattggacacaagtttaccataggcccagagttcatggagacagaatagacctcccaggcctttcctatccaaggaggctgagaagttgggactcataacagagaaataggcaggaagttctgaactatctgggaagatagcaagagaaatctactgatgagatggcttgtgcagagccaaagagatcttttgttgaaatattattattattattattattattattattattattgagacgaagtatcgctctgttgcccaggctggagtgcagtggcgcagtctcggctcactgcaacctccacctcccaggttcatgccattatcctgcctcagcttcctgagtagctgggactgcaggcgccggccaccatgcccaactaattttttttgtatttttagtagagatggggtttcactgcattagccaggatggtcacaatctcctgacctcgtgatctgcccgcctcaacctcccaaagtgctgggattacaggcgtgagccaccgggcccagccctttatttatttatttattgagatggagtctcactctattgcccaggctggagtacagtggcaagatctcagctcactgcaaccgctgtctcccaggttcaaacaattatcttgcctcagtctcccgaatagctggaattacaggcgtgtgccaccacacctggctaatttttgtatttttgtagagacggggtttcaccacgttggccaggctggtcttgaactcctgaccacaggtgatccgcccgcctcggcctcccaaggtgctgggattacaggtgtgagcgaccgcacctggcccttgttgaaatattttaaagaaacttgcttgttgctgtgagaggtacaaagatgaatcaactcccttagcagttgtcttcttttctaatgcatcattgacaaaactcagaaatagcccctgcgtgttcaggaggtggacagagtggggaaagagaggaaaacccattataaagaaacaaaatgtgacttcattgggattgtctttcaaaatgtgccctgtaatttcccagtcgtgtggttcttctaaccagagccatcctggctttacattttttggatccaatctgaactctggcagaagctgcaaatatcctgcagcctgggtcccagccccaccacttcatcaaaactggcctccccagggatattaaagccactttattgttgccaaatccagtgtatacttctctgggagggatcccaagacaggactacccaaccaagtcacttccagagttctgatccatagacattctgagagatcatgaatggtgttgttttaagccactaaattttgggatacttttttttttataataatgaatttagttttttaaaaaaatgtgtcaagtatttgttaactcattaatgagggaaccagcaagatgacaaagctcattcaaaagaggatatgagaggctgggcgtggtggctcatgcctgtaatcccagcactttgggaggccaaggcggatggatcataaggttaatgccctaaagggcgataaaactatgacatttgcaactaaataatctgcaaagaagcatctaacccagagtctacgccctcctcaacagcaaataacaattcaaataagttggagttcccctggagttggatggctctgtgcaggcttgctttagactatactctagtgagactttgaacgtatatgtcatcatcttttgcctcgctaatgaagatttgatagataatactgcttgagataagacaccaatgaaattgtcattttatgcaatactatggagtaattcataaaattattttactcctttattcaacaaatatttattaagcacccactacgtgaccgaccctgttctaggtgataaggatacagtagaatacagtccctgcccttgtagaacttgcagcccactgtggattcatttcagtataaagtgtaggcattgtcccaaagccgtaattaggcatctcatcagaaatcagcccactcccccaccccaatcaagagcccctcctgctgtcctgctgtatgtgcatgaaacacaacattggcctttggggtgcacttctgagcattggcctttggggtgcacttctgagatggggggttccatttcttgttgttcttagaagtgggacacacttctgagaagggtgctaaatgccaccttgtttacttctttataaggactgcaacaggtgaaaatttgttaaaggagaagaggcagttttttttctttttaaagaagcacactgtatttatcaaaaggaagctgagaatgaccctggatgttacggtacatgtgtatagctagatgttggttaaaaatggaaataagaactgacaaagtctttgaaaagtgtaacagctttagtcagtgctatagtctcaatgtttatgtctccctaaaattcatatgttgaaatcttcacacccaagattatgatattacgaggtggggcatgcaaggaggtgatattgggagatgattaggttatggagagctcttacaattcagatgaatgcctcagagacccctccccacttctgccatgcaaggttagggtgagaaaatggctgtctaggaggaagtctccctcaccagacactgaatctgttgacccccttgatctcggacttcccagcccctagaactgtgagaaaaaaatttctgctttttataagccacccagtctatggtattttgttgtagcagcctgagtggactgagacagtctgggaattcctcttcttttttttttttaagatggagtctcactgctgcccaggctagagtgcagtggcacaatcttggctcactacaacctccacctcccaggttcaagggattctcctgcctcagcctcccgagtagctgggattacaggcacctgccaccaggcctggctaattttttttttgcatttttagtagagacgggttttgccatgttagccaggctggtctcgaattcctgacctcaagtgatccgcccgcctctgcctcccaaagtgctgggattacaagcatgagccaccgtgcccggcctgggaattcctcttaacaacactactgttggcatctggttgtgcacctgctgtagcaggtgaatagccatggattcaattccctgagtctaaggaggctgaccatgcctacatttggtcatagacttcaatggagtccccatctccattgaagagaataacacaagtagagagtggcagtgaatgtcaacaatttgcaagcaatagctcaatcaagaggcttctgtggagccaatttgtcagaagcttttaaccttaaaatgtagatggtaatccagtgtagcagacactgtggtgtgccacacagaacccctcttcagggccaatgcagccatcccccagctgctgagaacgtcagctgcagaagattcaccacagggaccctcccagggaattgccctcggccacaaggagctgtctcaccaaaggctagactctctggggcaatgactggctgatgcaggggcacaaacaccgactgtaggctcaaatgcagctaccctgggaaagaggaggagaaggatgatgtggagaacgggcagtggatgacctcagtgcaatttgtaatgtttaattccttaaaaaagaaaaagagtctgggaaacatagcaagaacgctgtctctacaaaaaaagataaaaataaaaataaattagccggacatggtggtgtgcacctgtagtcccagctgaggtgggaggatcacttgagctcaggaggttaaggatgcagtgagccaagatcgcaccactgcactccagcctaagtgacagagtgagactctgtctcaaaaaagaaaaaaaaagaaaagaaaaacgaccagataagatctgataaggcccgatgttaatacatgaacttttaaatattattctccagtctttttttttttttttttgagacagggtcttgctctgttgcccaggctagagtgcagtggcactatctcagctcactgaagtcttaatctcctgggctcaagcaatcctcccacctcagcctcccaagtagctgggaccgcagacatgcaccaccatgcctggctaacttttgtatgtttttgtagagatggggtcccactatgttgcttaggttgctctcgaactcctgggctcaagcaatcctctcacctcagcctctcaagctgctgggattacagtcataagccactgtgaccagcctattctctattcttgattgtatgtccaaaatataccatcataaaaaagcaccactggaatcaaagataggggcttaatgggcatttttgtgcttatttaatccttttcctgtctctaggcagtgtacagataggggaaattgtgtttcctgagtacttttatatgccatggaactgtgggggctttttatattttgaaatatgaattcacgtacatgttaggcagaattttatactctttcaaggatctttctaaagatttcacattggtagcagttccattcacagtcagatatcaatagaattcattctaatatcaaacctgtggctttcttgttacaacttaatctgtttcttcaatgtggagtttaactcaagccaaatcctttttagaatcctccttcccaagcttacctgagcttcctaggatgcacatgatctgcccgctctccacgtacaaggagacatctttgaggatctgcctggtccactgctgccggcaagatgtgatgtcccaccagggcctcacgcggtggctttaaaggaaaccccaggaaggcaaaggcagcttggggccctggaaggggccacacccaggtccccagcattgatcctacctgtgccccaccccagtagtctccggacaggctcctaacgtgtttcagtctctgcgccctcctctgtagaacctggcagatagcgactgaggctgtctgccacgtagggagggggcctgtgctggagttgctctgaatgtcctgtccgtttggctgcgaggtggctgtccctgcattctttcaccaggtttcaagactccttgcattcgcagtacccccattcccatccacagagggcaggccgtagacactgggttggcagggcactgctgccactttgtttatgcccaggcccttccctgggcagggggaggggccattcactgtcgctccatgtttcccagcacagcccttctccctctcctctctccacccgatccactaaagagggagcccgaagtgcccagactggcacttaaagagtgaagaaaggcagcagaggggtgagcgccgggccccgcactcctgggggagcagcagcagcaagggctctgccttacctgacgctgtaggaggcatggaggatgcccaggctgtgaggctccggggcggtggcaggagccccctccagggagctctgggagcctctgtttacttggagacccatggaccctccgggggtcaaagatgagaggtcacccatggccaacaggcagcaaagctgggcaaattttctggtggccggaccctccccagagtggcttcagttggggagcccgtggcagactgccctgcctgctccacctgaccccggagtcccttgggacagcaggactgggacttggccacggagaccattatctgatgtacctttagccagcgcgtccttatcttgacagtgggcagaacacacacgtttgtaggtgggcttgccagcaaggaatgctgggagagacgggcccagggcaggaggccgaggtgtccctgctccaggaaacagagtgaagacactggccctggcaggcagcagctgggtctaagagagctgcagcccagggtcacagacctgtgggccccatggccgggaaggcggcagaggagagagggctgccgaaaggggccactccccaggatacctcggtgagtgagcaatgggaagtcggcccaggcctggtgggcgggtaggagaaatcaaacctttctctcttccctcaggagccttctgtcctagcaccacccggacatcaagcagtgtgaggacatggccgcaggactgtttcctgcatgtcaaagggcggaggggaacagattcagggtcccagaggcctctgaggtcacttcctgccctaagaaatgctcttttagggaaatgatgttcttttgtgtgatgtgggacaatttcactttttcttttttcttttcttctctttttttttttttttttttttttttttttttttttttttttgagacggagtctcgctctgttgcccaggctggagtgcagtggcgtgatctcggctcactgcaagctctgcctcctaggttcaagtgattctcctgcctcagcctcccaagtagctgagattacaggcacctgccaccacacctggcaaattttgtattttttagtagagacagtgtttcaccatgttggtcaggctcaaactcctgacctcaggttacccaccctcctcggcctcccaaagtgctgggattacaggcatgagccaccgtgcctggccagtttcgctttttccgaatgagactccatcatagaaatgtgctcacacatgccagggactccactggtgtctcctccatccatgtggctgtcaggttggtctcagtaatgaagtgatgggtgagacagggtgacagacggcttttgtgggaacatcagcatgtgtggctctaacaggcaatcgtaagttctgcgagaaagctggaaggagtagaagcagccaggtggcaggaggtggaggtatgtttccttcctcattttacctgagaagtgtttactcaagaaatagcctttgactgaattcgggatgtggcaggatttgaagcaggaggctaaactggaagacaagcgagaagcagatccccactcccaccacctcaccccatcctacctttccatctttgcctgttgtgggtaggagggaggagagaaagacaagcatgatcgaggattccacacccaatggggaaaacaacctggactggccttgagtttccaggacttgactcggccagacccaaggagcccaccatttctagtcagttctgcaaccaccacatctgaccagctctgctctctgaataccctgtggggcccaccacttcgggaaatgtttaaagcctgaatagaatagaaagtcagcgggactttgggaacacttcctgcctgggagggctgacgattcagccaccacagcttgagaggcaaagaaatgctaggaccacaccagaaatgcacgcaggccctgccatttctgcttcccttctgtccgatcctgtcactccaggtgctgagtgacggtctgcccgtaacacctgtgggtcttggaacaagaggatgagggtcacatttcctatgtctagatatataaaagtcatcagtcaagctataagaacagttaaataaaatagtttctatcctcttatcttgacatatcttcctcacaacctgaaaggccatgtgtaaattgagaaattctaaggcaacttggctagaatgcgctggtacgggggagccacttccagcccgagccacaacctgtcccccttttctggccccctcagctccatcccactccatggggccctcaacaccctggatggtcaccctcctgcctacctgcattgcagccctgccctgcacagacatatacttctctggcctaaaagtcctcaggaggttgggcctgggaagaggtgtacagaccctggggatggacttggggccatttgcacagagaatatctggcatcttgggcacctggagtggcaagtgcccttaacccacaaactcctcatgccatgggcaggagcagcaacagagaaggacaagagaaaccctggcagcaggcagagctgtgtgtgacctaggctgaatgtttcgataaaatttcttcagccaggaacaagtcctgcgtgtcctcttgccaaccctccagccgtgagtgtcagcacatcactccccccggggcataggctcctcatctcagaactagaaacatgtgctctgtgagtttccttcttgcctaggcatctgactcaggaatttgatcagaagttaatacgaggagaaattacaatgtagcccagcatgagcagagctggttacctacaaataaacctgcttttgcttttttgggtgtcacctgtcagaaattcaagtgatgttctgacagtcgtactgattaagatgtcagccgaatagatacttaagtatttgaaaaatacagagagtttgtcaaaacctcaggaagagtctaacaaatccttcctgggagccaaggaaaatattttaaaatggaacagaggtcgtccccaacccaggcacgaattttcttcctccgaaagatgagctgcctgtgcaactcctggaaggcacaatccctcaatggtggttggagtcagggctggcccacacctgccttcccaggccacagtgaaggggcttggggtgagccttggaacaagcaaccaggcacctctccccttcctcttacccagtttctgctctgcctcctctgtctgccagctccctccccttctcaaagcaccacacagtggaacccagttgggctgcaggttacctccacacattgctccagactccaaatgtctgaccttccttcctcagcgcctcctccatgcctaaatccgacctggggatgttttggccagcagaagtaatttctcagctcatttacattgtctaatatccctcctgcagatatttgttttaaaaacaacaacagcaagatgcatgttagcccacatgagtctcttagaaatggataagatttttttttttttgacagagtctcacgctgtggcccaggctggagtgcagaggcacgatctcggctccctgcacctccacctgccggttcaagtgattctcctgcctcaacctcttgagtagggtagctgggactataggggtgtgccaccatgcccggcaatttttttttgtatttttagtagagacagggtttcactgttttggccaagctggtcttgaactcctggcctcaggtgatctgccctcctcagcttcccaaagtgctgggattacaggcatgagccactgcgcacagctggcaatggctaagattttttgatgattcaacaacaacaacaaaaatgggacaatgaagcaatgtgcacagtgacagcggagagggcgagtgaggggcaaggccgaagggctgatctgccaggagtccagcatctgtccgagctgctttcaatctcctcaggagcttggggcacagaccttcttacctcctctccctcaacctccctcctgcttgggggctttggcaactggggttgaggtgggaatggaactctggagttctactcactggcttgctctctcaatttgacaacatattgtgaaatatcgtacacaaatcagcttaaagaactctcatgtacacaccaccaattaccaaaagctttgaagcttgatccccgcactcctactgtgtcccctttctcctttcatctctccccgctccccagagataacccctctcctgaattaggtgtttatctttcccatttttttctgtataattttgggtctttatggtgataattcaaacattaagcaatggaagtcactttcgtctgctgtttttcatactctcccagaactctaagggttccccacagcacgcctgcggcatactgtcaccgaatttctttccctccacctccactgacctggaatgttctttccgagaacttctggcccccatcattgcaggggtactttgacaagaagactgctgtatgttatttgttattttcacgtaaggcataagtcatgttagtttcacctacagcatgtgcgtgcattgtgtacatagtgaaaataaaccctggtcagatgcttgaggtcagcctccctctctgcctggtctgtctcgctccatcgtaatcacctgtctcatctgccaaaatctaagcttttcaacggccttttcattgtcacatcccaaattccaagcctgaagggtgttctgggctccccataagtgtttgttgggtgcatggttgattgaaggaatgtatagtgtgagaatggtagcttgaggaggaaagtctatgggaacttgttaatgaaagtgtacttgttcctgcctgacagaaatgtaagaaaaattgaatgcagtaaaaaatggaggtcagacgaggtggttcacccttgtaatcacagcactttgggatgctgaggtgggtggatcacttgagcccaggagtttgagaccaacatggtgaaaccctgtctctacaaaaaatacaaaaattagctgggtgtggtggggaggctgaggtgggaggattgcttgagcctgagaggttgaggatgcagtgagctgtgatcatgtcactgcactccatcctgggtgatagagcgagacccaatccaaagaaaaagaaatgatgggggacttcctgttgcttctttgtttgggcctcaatggtttaaatgattgaattgtcaaaataggaggaattgagatctgcagatggttaataccattcaaaggtatcagccgacaccatgaaacattgattttttaatgtacattcaaatataccaccacttcgacaataacaacaacatgatgatgatgatgagagggacttcctctcaaagctcccagcagcattttccatcactttgttgcatgaactcttcatcaaaatcagatatgaggagaagtatgccagatgttagtgaggactaagatgttggttagaatttttctcagggtggtatcttcatgaatattgggcattaactctcaacagctgcttccctctcacatgctgcaagtgtcatgtctgtttggcctcaggagatattaagccagctgcagggaagagaaagttaaaggcaaagagtttgcccactccagtcaggtcttctcagagcacagaggtttttttatagaactctctccggtccagagtctgggtctctttaccagaagctgcttggcttcaggctccaccagcctgaggttgaggttctctgggaaggtgccccgggagaagccccaaacctctctctgaagggaagaggagatgggcccttgtcagcactcctattttcccaaagccctgaggttccacctgtgcaatcccatctgttgccaatttgagatttaaccacgtcggctctaagaagttgctctcacctgttggtttccttcttgtcttctcctatgttctcagcagcttctaaaggagcccctcatctctcctgtctcccacagggcctccaggatagattgttctcctctgaaagtgacaacagcctgtacttcacctacagtggccagcccaacaccctggaggtcagagacctcaactaccaggtagaggcacgcctgggttcaaggggagaggagcaggcagggacagccaggaaattccccgggtggaaataaaagggtgggcccaacttgcaggccctctgcccgcaaggacagagtccagtccacattgatgcctcacgtgtcaggtgcaataggtgtcatcaatggcatatatcagagctggaggttgagaggcttgaaaagagaataaaactgttgtataaacataaaacaaaatgcgtgaacctatagaaaaatgtctctgggactctttttaaactatattttgaaataactttagattttggaaaaaattgcaaaaataacacagtgtttccatatacccattgtccagcttcccctaatgttaacatcttgcatacccatagtataattatgaacactaagaaatgaacaatgtacaatgctattaactacagactttattcagatttcattagttatatatatatgtgtgtgtgtgtgtgtgtatatatatatatatatatataattttttttttgtaaaatgtactatccctggagcttataaaacatccagagtgcaaagacaatgactgacctttcagaggcacccaggaaccccctggtcagattcaaggatccatattcccacagctccccagggacccagatgggacatggtggggtctgggatggtgaacttcagaggcctgagtctggcttcctgtgggtgtgagttgggacaagccaatgagcctttctctgctctgccacttaccagctgtgtgaccttgagcaagttgcttaactgccctgagcctcatctgtaaaacaaggattctgagcatatctatgttatagatttgcagtgaggattgaataaggtgatggatgttaagtgattaacacaatgtcttgcacatagtaaacatctgataaattattagtaaattactagtatcaagtgaagacattttgcttcgtgttttatttttatttctgtaccactattgcacatgattttcttttttccttacttttttttttgagatggagtctcattctgtcacccaggctgggatgcagtggtgcaatcttggctgactgcaatctctgcctcccaaattcaagtgattctcctgcctcagcctcccaagtagctgggattacaggcaaccaccaccatgcctggctaatttttgtatttttagtagaggcggggttttaccatgttggccaggctggtctcaaactcctgacctcaggtgatccacctgcctcagccttccaaagtgctgagattacaggcatgagccaccatgcctggcctgtacatgcttttcattcttcttatcttcagacctagaaacagcagctacaggttctcagcatgggtcctgcttccgtgtttggtagaacctgggttggggcctattgtgtgtaggtgaggacatatcctctgtggagaggggccacctggggaacgaagatgctgaacagaagttgctgaagccctctgaaccattcagctctctaaggaaccttctgatatctccccacaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggtaccggaaaggcaaatcgctgggcaatggtttctctcctgggatacagaatggtcctttggacaaatggatgcttcttatggagctctttgctgactagtagaataatacagcagaatggctgagaacacaggttctgggtcagacagacctgggctcaaatcctggctcctccatttgctggcttgagggtaggtgctgttgttaagagtcatgagtgcgcctcttgtccacccgaggctgtggccagagcatctgactttggctaacacctggacggagagatcagcaaacagctccagcatgtaatgttcttttcagactcctccagccatgaggggcattggttcaggttgttcctccacaatcacattctgattatggccagacagcccctgccacactctcacctctcagacagcctctccagtgtcttacttagcacaactttcactcatctgcaaagagccaggttcttggagtgcctcaaattgtcatttccatggccaaatttaaaatgagagaatgtctgagctgaaagggggcttggggaacagaggtcattctcatcatgttccacctttctttctccctaccagtttggaagcattttcagaggaaggtgttcaaactccctactcctcagtgtgtctagagtatcctcctgcacgcgcgcgtgcacacacacacacacacacacacacacacacacactcccctccatttgacagatgaggagactcaaatccaaagaaattgagggattctcgtaaggacacatatttaatgcagagctagaactagaactttggtttcatcattctcggatcaagacatttctccctgggacacccttacatagtgctggagagagcattttatatcttttaattaatcatttccagaggtagagattactcaattttttaaacattctgctccaaacttttacacccgtctggtagataagttctgtttaccgtataaccaaagatcaaatgaaatcttatgtataaatgcactttgtaactgaaacagcatcacagtcatgaagtccctctcactctgtccctgtccctgcaatcctgacctaaataagaaaaaagtagatcccggccaggcacagtggctcatacctgtaatcctagcactttgggaggccgaggcgggcagatcacgaggtcaggagatcgagaccgtcctggctatcacggtgaaaccccgtctctactaaaaatacaaaaaattagctgggtgtcgtggtgggtgcctgtagtcccagctacttgggaggttgaggcaggagaatggcgtgaacctgggaggtggagcttgcagtgagtcgagatcgcgccactgcactccagcctgggcaacagagcacgatcccgtctcttagaaaggaatgaataaattacactgaatagtctcctgttttgttttttttgttgttgttgttttgtttttttgaggcagtctctctctgttgcctaggctggattgcagtggtgtgatctcggctcactgcaacccgctcctcctgggttcaagcgagtctcatgtctcagcctcccaagtagctgggattacaggtgggtgccactatgcctggctcatttttttttgtattttttgtagagatatggttttgccatggtggccaggctgatctccaactcctggcctcaggtgatctgcttgccttggcctctcaaagtgctgggattacaggcatgagtcactgcaccgagcatctcctggttgtttatagattcagtgttgtttggcttcaggtttacttgcctgtgtaaaaaaaacaaaaacaaaaaacaaaacaacaacaaacaactttagacaaataaatagtagagttgtctgagcaaatagtgattaatgaatctggcagcactcaaaaacaggaccagttcagaggctcccccaagcaatttggtcaggcagtatttatagacagaaaaaggaagtgccctacagaaatagctgattggttacagttgggtgttcaccttatttatttgagggtgatgtgatcaggtgttgggtatggacaggagctcatcagtcggtagcctgtgattggctgatgcttggctgccatgattggctgagactcagcaacttgtctcagccagtctctgtcttaagagaatatactgctaagataagttgcagtttgtttacatactaagtttgcttgcagtttgctctgtgggaactcaaagtatgcaggcagcctcaggccaaatttagtttaactgagcagctgaaattattaaaatgatttattagaaaggttcatcaactacacttcctgtgacttttactgccatccccctctccccctgcccaacatacacacaaaagaacgctggccataatttttaaaatacaaagaaaacagccaggctgggcacggtggctcatgcctgtaatcccagcactttgggaggctgaggcaagtggatcacctgaggtcaggagttcgagacc

SEQ ID NO: 220 - DNA, 196373 bp, Homo sapiens
ccctcacataatccaccctcacataatccacctcacataatccaccctcacataatccaccctcacataatccactctcacataatccgcctcacataatccaccctcaaataatccaccctcgcataatccacactcacataatccacctcacataatccacctcgcataatccacctcgcataatccacccaccctcacataatccacctcgcataatccaccctcacataatccaccctcacataatccacactcacataatccacctcacataatccacctcacataatccacctcacataatccaccctcacataatccacctcacataatccaccctcacataatccacctcacataatccacccctcacataatccacctcacataatccacctcacataatccacccctcacataacccaccctcacataatccacctcacataatccgccctcacataatccaccctcacataatccaccctcacgtaatccacctcacataatccacctcgcataatccacccaccctcacataatccacactcacataatccacctcacataatccacctcacataatccaccctcacataatccacctcacataatccaccctcacataatccacctcacataatccaccctcacataattcaccctcacataatccacctcacataatccaccctcacataatccaccctcacataatccaccctcacataatccaccctcacataatccacccacattcacataatccacctcacataatccacctcacataatccaccctcacataatccacccctcacataatccaccctcacataatccacctcacataatccaccctcacataagactgtgcagctgtctggtctccatttctgccgggtggggtattccatcctcatctcgggcaacatgtcccaaaagtatggtttccagtatggctccttaggtcccacccatttcttctctgggaccccaaagacccaacccccaccttttttttcttttttttgacacggagtctccgtctgtctccaggccggagtacagtggcaccatctcggctcactgcaagctccgcctcgtgggttcaagcgattctgctgcctcagcctcctgagtagctgggactacaggggtgcagccactatgcctagctaatttttgtatttttagcagagacagggtttcatcatgttggccaggatggtctcgatctcttgaccttgcttcagcctcccaaagtgctgagattacaggtgtgagccaccgcgcccagccaagacccttaaaagaaggacacttcacttcctcttacaactcagacatacctgtgaggctcctgggctatggaacaccccagccctttcgcagcccttgatggaaattgtttttcagccctctgaataaaatgaccactgtttacttaatcttttttttttcttttttttgagacagggtctcgttccctcgtccatgctggagtgcagtggcacgatcatgactcactgcagtctcaacttcccagactcaagcaattttcctgcctcagcctcccaaagtgctgggattacaggtgtgagccaccatgcccagcagaggaatcttttccgatcaacatcttctgagagtccctggcccaagtaggcagatgcttgctacggcactgccttcaggccattagcaaaaagtgtgcttaaatgcccagaggtgttcccaggccacgttttgttcatacgaggagtacaaaatgatgccaaagtgttagcattcttgggactgaaaacctctctccaacatcccctaggattttcctggatatgaccagaaatccattcccaatttctctgcctccaggccccaattctggtttcctcaaagaggaggaagtgttcttggttcccaaaatatgcttgcagtgcagtggtataatggtaaatgtttaacaacaataacaaaaaggccctaactggccgggcgcagtgactcacgcctggaatccaagcactttgggaggccgaggtgggtgggtcacctgaggtcaggagtttgagaccagcctggccaacatggtgaaaccttgtctctactaaaaatacaaaaattagccgggcatggtggcatgtgcctgtaatcccagctagtcgggaggctgaggcaggagaatcgctcaaacccgggaggtgcaggttgcagtgagcggagattgcaccactgcactccaacctgggtgacagagcaagactctgtctcaaaagagtaattttaaaaagtaaggcaacaaattatcaggagtttttgagctggttgttaagcacagttattattaaaaattacattctatacatttataataaattacactaaaaataggtaatatgtgctcaaaactcatcccctcctaaaaattttactacactgtactcctatctatgctgttgaggttatttccatagattgtatctgtgtgatagaaacaccatgtaaccacatgctgctgtacgtcttcccaattctgactgatgacctcgcttggtagtttgaaatcagccatgatggggatattaacaccacacaagtcagcaaatgctgtcagttaggatttttttttttttttttttttttttgagacggagtcttgctcttgtcgcccaggctggagtgcgatggtgcgatcttggctcactgcaacctccacctcccgggtttaagagattctcctgtctcagcctcccgagtaactgagattacaggcgcctgccgccacctggctaatttttatatttttagtagagacggggtttcctgcttcagcctcctaagtagctgagaatacaggcgtgcaccaccatgcccagctaatttttttattttttatttttttaatttttagtagagatggggtttcaccatgtttgtcagactggtctcgaactcctgacctcgtgatccaccggcctcggcctcccacagtgctggatgacaggcgtgagcccccgcgcccggtccgtgcatttacagcacaagttcacgcttatctacaaagcatccacctctcaccgcaccttccgggaccacgggatttaacgcctcaccgcccgatgacagcacgaggtggaaagggcagcgacaatgctcgcgcgtcccctcccggcgatccggagcacggcagccccggagcgcgcggccactcctcgctcccctcaggagctcgtaagagccccgcgcggggccgaggcgcgagagcacgcgcaacgcttcctgggaaatgtagttgggtgtcggattagaactacaaatcccggtactcaccgcgctgcagccccgaccgtgagggcgctttctggtgaatctgaatctcgtttgtctgtgacatggggaaagctgtccaagcccaattccattttcacaagaggctttctttttggaaacatgatagcggtctcgctggtgtgcgcaccaggagcgttgcggccgcggcttcctcctgcggcgaatctgccgttgcatcacagtggctagtctcagggcccgcaacgtgacgcttgtcgaatctgctgcggggagaaggacgcgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggtgaggccgggcgatgggacccttgggaggctgagggcctggacggcagtggggatctctgccgagaagaccacgcgcctgggaggcgagggactgcgggccttgaccttgaccacaccctcgcctcgttcgtgaatcgggcgtcacctctcctgccccctcaggccggctttcctgatgaaaattgggttagagaatcggtgctgtggttggggcctgaaagttattacatgacatcctggctaacacggtgaaaccccgtctctactaaaaatacaaaaaattagctggacgtggtggtgggcgcctgtagtcccagctattcgggaggttgaggcaggagaatcgcttgaacccaggaggcggagcttgcagtgagccgagatgtgccactgctctccagcctgggcgacagagcgagactccgtctcaaaaacaacaacaaaaagttattacgtgggtgacttcattcatccgttcattcccttaaattcattctcttaaataattctttcaacaaattgttcctaagcaatatcacgtgccaggtgaaagagacaagagcctggtcttcatggggcctgtattatactatgtggagaagaatgttgagcaggaacactgcagaggaaggatgcagacatatggaaatgcacatgcagacgactctagggcagcagttgtttgaggtttgaaaaactgaaagaccattgtgactagacagccccgagcaaggagagacgaagtctgcacttgtccttctgtttttcccttaagttgaaggggaggtgcccatgattttattaaactcatattgaccatgaggtcatgagagggcatccatctggacatgtccagccggctcaggaaggacagatgtggcagcagtgtgggatttgccattaggtagctgtgtggccttgggagaagttgcttaacctctctgagcctcagtttatagaaaggagaggctaatagcatctgtctcactggattattgtgaagaatgaatgaggctgtggcatactggcatgtgctcagtaaagcattactgtgaatgtcacagtggccaagagagtgatttgcaaagttgatagctgaagttgagggtggctggtttacatatgagagaatgtagagagaatagagggttaaagatggaatcttgagaaatgttagggaatgacaggaggaagaaatcttagagacggagaagatgatgtcagtaacatagaccctggattgcaagtctccaggcaagtggagagtttgagtggcaagaggggggtgtcctctgcaccggtggtcatccaaaagcatggtcccttccaggatgatcccaatagagtaatgcagaaaacatgccaaagacaccttcatctctgtgtttgcttctaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatctgtaagtgtctctgccttctaagaaatccttgctggggccaccatttcattacttttaaagagaaattgctctttaaaagtcatttgaaagttgttactagaaagcaaatcagaagcatcagatacattctaggttgaacttccataaaatagtccctgtggcagactttgtgtgtgtttacagtatgggcttgcattattttttactttttgtaggctagaagttagctaatgattttaaacgagacttattggagagccccttgaagaaattttgattacattccaaatgctgggcttggtttcagcactctggtgccacctgcaggaagcatctatgaacgcatactatatatatatatatatatatatatatatatatatacacgctgtatacttaggaactatattttcaagaaagattaggtttcctttgggtagggactgaatgagctaacgagcaaccctgtgtattcctccttaatggtctgccttggcttgtttctttggctctaacgtgtacttccctgcccacagtaccggggaacatcagactggaagaacagtgtcatcagtggctgcatcacgggaggagctattggtttcagaggttagtaaacggctctcgaatgctttttctttgtggccttggacaacgtgctgaggttgtcatttccaaacacacgagtgttccagggacacttgatcttcttccctctgacaaataaatcatgtttgtttctgtggtaactcggttttggaaacttgtaggatctagatgagggtttcccatcgttggcactactgacatttcgaccagacgaatctttgtcgggattgggtctgttttgtgcattctaagacgttgagcagtatccctggcctctacccacgagatgcaagtagcacccccgtccgttgtaacaacttttttttttttaaagagaccgaatctcactctgtcgcccaggctggagtgcagtggcacgatgtcagctcactgcaacctccacctcctgggttcaagcgattcccctgcctcagcttcccaggtagctgggattacaggcacccgccaccatgctcagctaatttttatttttttagtagagatcaatttcacctggtctcgaactcctgacctcgtgatctgcctgcctcagcctcccaaagtgctgggattacaggcatgagccaccacgtgtggccaacatttttctcagtaattctagacaattgtcttttaattttagatataaattataatggtaatatctttctgcccttggggattctgatttctacccattgaatgctaagtacagatattctagaaatattagattatcagctgcaaaaaaaaaaaaaaaaagaaaaccaatttgctgcctcttctccccgttggcatgtccattcagagcgtggtggagggccttggtgacttgactttcctagaagcagcagtgttttatcactgggccactttccatctgtcatgccctaacttacccagagcaaaaagccagttttctcatcttctgagagacaggatgatttgctgtcatgaaacctggttttgctcctcaagcaccatttatgatgacggactgacttctccgccggtcgtcccattgttcagcttcaccagggcctctttgagaagctctgctgtctccagtactgctttgatcaccttcccaggaatgtattccataaacaaatcagggtcaaggccatatgctttcatttgattccgagggctgcttctctcaaccagtttcctgcctgcgaggggctatttccctaagactagaaataccctttgaaggagaaaagctaaacaaatgtagttagataaagcgcactggattagatcatatacactgcttcattgatgtcttccagagctatgatcgtttgaatgacttacagtgcttaagctcatttcatgacactgagggtgtgccaactttccgtgagtgcctcgtgacccagcagctgtcaccacaggtcatgttctttctgtttgtttgacagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggaggcccgagtgtttgtacatgagtgatgatgtcaaacccagctggtaacaccttccttgggtcatgtttgccattttcttggaatgaatgtgagttcctgctcagggctcatgtccttttacagtgaattctatataacgcccctcccagtctcacagctaggaggcttcatcactgctaggccagttggagcgttccctagagctcagaacaaattgtttcctctgctgtccctaaatataggacacctacaagcactctgaagcaagggcagacattcccacctggtacctgtcaaagtcctaggatgcctgggatcttccatctttcagtctagcacgtgggaccaaatacaagagatgctgccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagttgcttcggctggtgggagccaatattcacgccactgactctctcaaagggagggtgggccctcggagacccagcttctctgacaagcagattagaccaaaaggctgcctcaaagatatgccactttgaaggaaagcgtagagaagcgtttacataaaagaagacgcttcctgttcagtggacaacttcatgccactttcaaggcacaccgatggccaggtgggacatttgtactgtagcagcacatggcaaaggtgagccagaagcagcctggatgctggctgatccggaggcctttgtgaagagcaaggagagggctccagcccacctccccgcagctctgccccagcccccgtgggccacagggaggctcaaggggagtgaactaggtaaacagattcctggaaactcacatctggatgcagctggaagagttaaatatttacattggtggcttccctggaccaccgcgaacacaaacatccacaccacagggctgagttttgtgcaaatgatggggctttgcattttttattaacattttcctctcacgtggtttacatcaatttataataatctacataagttgaaacagaacatagacaaaaaaatatatccttaccaacttattaaagtcagatattcatgaagggtcccatcctacctgtgtatcagcagaaactggcagccatcagccattgcccagcaagaacaggcagacctggcgtttcttagcctgactcctgctgggcacagcccaccctgctgggcacagtgactggaggttccaggctgcacagtccctggctcctgactcctgccgggcgcagtgactggaggtttcgggctgcatggtccccggctcacaggagaccctgctgggtgtttccttggtgcagtttagtccaggtctggcacctgaccctccccactctgggggtgggatttataaatatgagcctttgcatttctcagcctttgcagccttcccatagcctgttctcacgttgcctcagcgagcttggggctgtggggctccctgaggctgagacgcgaaggtgcccagtctgggccgtgactcactctgccccttcctgtccatcactttggaagcaagcaggagccttctgtgccacacaccgacactcggatgccaggcagggaccttaggaagggccaggcactgcatctttagactcaagttcaccgcctttcccagggagcaagggctccttgctaagctgctcacaggcagccgatggtcagtacttccttcctcttgggcatgtctttcctccgtgcacagagtatttactgttctgcccaaggccacaggagtaaacaggctcaaaaagggcctctcaccgcgcacgcgctgcagcgttagggccggcaaacccttctttaagactcagccctgagcacaagcaatgggaactgagctccccagccctgagggcccggaaacgacgctctgccacacagaagagccggggagctgtaactggctataagtcgagcccctggagctgcatctgctctcctaggctgatggcccgaggctggcagccgcagctcgtgtgggaagtgtacggtgggaacacacctcactccttcctagtaccgggcaatgcgtctgcaagtcgggtccctgctccctggcgggtgcctacagcaccaacaaggaggccccagcagaacccagcccctagaggcggctgtctgattccccactctccccacaacttctggagttcccagtgtttacccaaaaggctgtatccagaagctggggcggcaccacaatggctggccaccgtgggcctgtgcctttgcttcccaggtcctggaggaccgtggcagtgcttggctgtggagtgtgtgtaaaatctaaggcaagagtaccacgaggtcctgcggtgccagggagctcctggctgcagcctacctgcctggacacctgcttcggccacatcagtcaccctccaggaagcctggcccctcttgaaaagcccccacaacttgctcctaagagctgagctgcctccccgcgacccgggacacccagcgtggcatgtgcattcctcccccgttcagcctgtggtgtttcctcagcagcctgaccgcctcctcccccattctctcctgaccctctggctatctcgatagcaggtcacctgtgagtctttacactcaaaggaaatagaacagcagggaagggaactgaaaagcagtagaagaaacagtcagagatgcctcactgatagacaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggcctcttcagagctttcaaggcgatggagcgaagaccaagggtgcacatgcatgcaggcaggctgggaaggaagagcgggtggaggaagactgaggggaggctgccaggagaccgccatctgggagcagggccaagagagaagctggcagcagttacacagcgcaaaataaaaggccttgggctggactcaggcggaaagaaagtgctggaggaaatgaaagaacaaagcgggctgtctgtgtgcccacgccgggccggtcactaccttttctgcctgacaagtgtacataaaacaattcccgaacagcacggagcatcagacacaactagaggtatggagggcaggaggtgggatgcggtggtgaggctggggctgggcagccggctttgtacaaggtggcacaaaagacgtacgcattccagttcttggaagctggcttccctcgagtctggagtgctgggtttgggagttttctattgcagtctttcaagtctgagttggaccccaggctggaggggctggttccaccacccgcccgcagccaccctgcctcgggctacacgtcggtggagaagtacagtgtgttccgcttgagttctgcgaaggaaatgggggggtgctgcaggtagtagaggaggacctggacctgtggggagacaggaaggcggaggctgggctccctgtcctaggcctcgtccttgctgactccagcctgtgttgcccctcccactccctagactggctccggccaccgccccttcctggggagcccaggtgtgtttgcctttctgcagccgtggaaggtgctacggggcagagggtcgggggcctagggccacttccccaacctggccataagcttctgctctgtcctgaggcggccacagtccggcccctgctctgggtcttgcaggaatcccagggaagcctcccgcccttggaagcaacctcagagcttccacccatgaggacaagggcccagcatctccccacccctgggcttgctttctgagactgaggccctcctgagaatgcagccagcatctctgggccctggtctaggctcacatgtttgttttggcctgggaggggcagaagtgtctacagtcctgcctccctggtgacaccccatagcccatcaacccagcttcccacgagggaagaggtgtggggactctgagctgttctctctcctcctaaggggctggtctcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctacgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccagatgtccgcagccgaggtgaggtgtgctttgctctccacttctgagggtctcagtaacgtgggtccaaacacggtagccaggttgtgaagtgacattttgttgatgggctccttctcggcaaccctaagaaggagaagatggggaggaaagaagcccttcctcagcagccactcggagctccaggacccttggccttcgctgtgggaactcctgaaggactcctggaaggggtcacctcgtctctgtctcctaggagtggggacctcccccgggggaaggggactcatccaggagagcagggccccagccatgtgccagtgttctgtgctaacatctccagctgctgggtccccctgaactgatggtgaactgccagagccagggagcccacagatgccaactccagctcccttgcctgagagcagatactgttctgaaaactccctggaacaactcacactcgccgcagtcctttgaggtaaatatgattatcgtcacccccatcgtgtagatgaagaaaccgaagtacagaggggttaagtgacttgcccaaggtcacacagccagcaactggtagagctgggatttgaaccccggtagctgcctccaggacctaccgctctgttgctttctcatgtgctaagtggcccaaaagaagagttaaggtgggtggggcaggggagaaaggcaggcagggcctggagcccagcaggagtcactagctagacccggggctctgccagctgtgctggggcaggagcagccctacttccagatgagcccggggactgtccccccgtgcctgtccggaaaggtcggcctcgtgggacccagggcttcctcttgtgcctctccggaagggtctgcctcatgggacccagggctgcctcctatgcctctccgtctgcctcgtgggacccaggattgtcctccctctggatcctctcctgcttctcttactcaacaggccagatgctctgcgatgcttccctggggtaacagcaggagctgccatcagggctggtgtccaggcaggcccagggtcagcaaacatatcagagggcctctggttctccttcagtctcaaaaaatgtttctgggctgagacccacccaccctaagcagcgcctctcaccctcaataccatcattcccaccctccaggcaggagctgtggctgcgcctgctttggaaacaggcaaacaaacactgtgatgccaacaggcagctgtgcagcggggccagcccctcaccacacgcgcgcacacggtccagccaggggcccagatgtgggaacagactgtgcccagttcccagggtggaagccgaatgaattttcccttcccactcctccccacaaggcttgccaaatgctttcggaattggttggggctctagtcctggccaaaccagaggaaaaatgtttcatgatgggaaaaacaagacaccagccccgggcgcgtccaggtctccactggctctcccgagcctggcgtggctgagctgcagcggggggcctggccctgagctggggctgagctcagggaagaattgttccgcagagcagtctgagggggctccccggtcctggcgtgcaggtgggtttaagggacgcccagggaccacctccccacgcaagcctgaggacctctgaactttgctacaagtacaaccaactttagccactcttggttggacctgactagaaagggtggtgggaaggcaagaagggtctgaatttaggatctggaagttgagggctctaaggacaggtctgctactaacccaagcaagtctccgcctggtgtggggactcagtttccctatgtctagtgaggtgtgggccaagaccagtgggtttcaccttttttgactgtggcccacaatacaacccatgctgtaacacagtccacacgtctctatgtaactgaaaagcagcacctgcatcaaggcttacaatgtatcctcctgctgtctgtcccccactgctgtccatccccactgctgtccattcccccactgctgtccatccccactactgtccattccccactgctgtccaccccccactgctgtccaccccccactgctgtccaccccccactgcatctagaaatggctacattcgttgaatgaaccaccagtaggttgggacccactgattataaaacctgcctgtagtcctgggctctcaccctgccattctgagcattctatggtcaatatttgaggttactactggttacgggacccaaatatttctcaaaacagaaaaacatgagtgcaagaacttggaaagcaaactctcactccccacagacagcccgatggaggccagcgcccacgaggagggactgaggaggtggggttggggccactccccgttaccttttcacgaggagggactgaggaggtggggttggggcccctccccgttaccttttcatgaggagggactgaggaggtggggttggggccgctccccgttaccttttcaagtgttccagcaggaagaggaaggtgatgaggttggggtcgggcagggagcggagcaggtgcatcatgcagttttccttggcagcagggtctgacagggctgtgggagagaagggccagtgtggcgtttggctcctggggctccccgccagggcccctgtggtcgtgaggctgtgggcccctgcgggagagagcccaggcttccaggcctttggggagcagaccccacaggggagggcctggtgtctgggtgggctgtcagcagctgcttcctccaggaggccccaccacgactggtaactcagccaggaggccggctggtgggagcagacccccttcctgcagctgactgcataggccttgggtgctggggcatcccctgtctcgtaacaggacaccccctggtctgtgtggctaaggttaagccagtagggacatatcctgccagcggtggattctctttctccaccccttctgctgctggagcgtgggtgcaagcagccttccgtgggggctgaagctccagtctgccccaggagcagagaaggctgaagggattccttggggctgggtttggcccaggtgggtggaggcggaaggcctgctggccggggccctccgcagaggtgacgggacggtgtgtggtcccgctggaaggctcagcacaacccatctcgagtgccctatggcttaagccagcctcctccttggttctgggatgctggcttctggccactcacctcagggcagtcttccctggatgctcgagcttccaagcaagaggccaacgtccaaataggaagcagaaggggctgcccatggggacatcaggggcaagaggcaggcgagaaagggcccagtgtctgcaccaggtcccagcaggccacacctcaccctcggacccctcagccacaggccccagtgcactgggaaggtcagccagcaaaggaagccacagatatttctcctgctggttacttctccgggcagggagtcctggctcagtctggcccagcccagtcctaggagccctcagggcctcaccgatgccctccatgaaggctgggtagagtcggtccgtgaggagcggctcgggcagttcccggaagtacagcttgagcgtcccggcgatggcgttgatgtccatgtcactcagcatcagcaggatgtccttgttatctgcaggggtggggccgaggtcaggcagccttagctgggccagcagccccgttccacccccgacccatcctgacacagcccccacccactccagctctggttctggtctcccctggaagagcaggatgtagagagggcccacaggtgtctgtgactcggctctgtgggtcggggttgggggaacagggagagatagcctgggggccatctgctgtggctgcttgggaaagggtgtttggggagtgaaatccatcacccagagttcagagccacattcataccatgtggcctgcagcttccttccgactggaacctctccatcgctaagcccctctctggaaggcattgcacacttttcacacgtaaaagcatgttccgacaaagcctcagcttctaggctgcacagaggcaccaacgccggccagttcccaggccccaccccgtcctccactccaggctccccacggattcatccctgcctggccagtgcaggtttcttgacagtggggtatgtggctgctgcacctgaaccagcaggagcagggaggagaaaccagaaaggtcaggcctcaccatggtgggcttcacgcagaggcagcactgccccagaggggacctggggccctggagacagcaggtgcaggctcaaagctctttccctgcggctcaccaggcacccaggaactagcaagaaagacactggagtcagatctgagttttaagtccagaaccaaaacctacaagttgggtcatcctgggcaagtgagtcggcccttgtgagtttctgcagttgcttacctgcagcaagggacaagagattggaggggaggggattacaagagaaagcacttgccacggggactctgaagcagagcaagcctcctctccagggaggctcctggttcccccgagctctcctgtccatcccaccagcctgctcagacacagccacacctgccccggctgggcctcccagactcactggcatcgaagacggccttgagcgcctggatgtccgtggccacgcccgatatcctgtagatgccaacctcctcgatacccctcttctccacctcctccacacactgccggacgatgtagggcaccttggagcgctcccgcctggggtggagcgtgaggatgggtggagggcagcccccacgacagctctcccgtagcaacccccacccagcacacacacaccctggagagcttctagcatttgggatggagagctggggcgggggcaggggcagggcagagaaagaggccaccgcaccccaccccagccagcccacccgaggcctgccgaaggggcatcgacggacgtgggcaggagaagccttgggaacttgggaaggtaaggccgagactctagggaaagaacgtcccccagattcagatgcttgtaggaggcccagcaggcagcccacatgaggaggtgggtcaggcctgagacaaggggccagggtggtggtgaaccgggggacacgtgccctttcccgaggggccgccagtccccgttggtgccgagcccaaacgtaggcccccggctgacagagcttcccgcttgttacgaggagcagacgatctgggatctcacaagagaccttccagcgtttaggtgctggctcgcgtgcttctgaagtgtcctgtgagcgcctctgcggccactctagatccacaccggccatctgccaccgccgagcggggggtaactgattaggtgccaggatgggcaccggcggggagggctggggggcccgggctgggggggacccggggcaccgacgccaggactgggagacccgaggcagcacctacttcgtcaccacgctgatcttcacaccgaagacgccggtctgctttttggacggggtcctcttcaggctcatatctcggctggtgaatttcatggaaaattccactttgatctggttggggggtgaggcaggtaaagattccccagggtgtgagtgcccgaggaatgcccccaaaacacaggggtcccctccccaagactgcaaatgagggctagctcacacccaggtctccctcaacacaacacctgcaggacagcagcgggcagggtgtgggcaggaggggagagggggctgggctgcggggaggtcgaggcggcacagcggccccaggagcagccacagggccgggctgcccacctgctgcacagacgttccacctcccggctcacgccactgatcattcccatccccggctcaccccgttcatctcaatcacgtccgtgtgccagttcttggtctccacggtttgtgggtccagctgcagagagagaatgtgggtgagagaggtgccagctcggaggccaagccagagatctccccgtgggtcagcactgctcagagccagctacacagtcaggaaggcggaagtgagcagctgggataagctgatgtttacctggaaatcaaccctttggggggaccctagcccccaggcccctgtggccgccgtgggggaggcagggcacaccctgttacccgccgtgggggaggcagggcacaccctgttacccgccgtgggggaggcagggcacactctgttacccaccgtgggggaggcagggcacaccctgttaggcactcctggctgccagcccgggacatgggtattattaccccatttcacagatgcagaaactgaggctcacaaaaggtaagcacctgattaggaggcgctcaagtccatcaggagggaaccagcccatccacgtggaggtgttgaagagtcaggagcccgcgcacaggaggctgcctgggtttgaatcctggcaagttttaaactcactaagcctcagttattccatctgcaacagaacctgcctccctgggattgctgggaagattcagggagaaaacttgggtcaagccattggctcccaaataagcaaatcctccacaggggaagtccccaggctcgggctggagcccagggaggtgcggaccccaggggaggtcagaggcaaccctcacacaggactgttccacgttctgtttctgtaactcgggggccttcgcgcccgtctgcctgtgcacctgcgaactaattctgagcaactgtgcgctccctggcactttctgaagtcaaaatctgaacatttccaagtttaaatagttgcaaagagtatgatttccaaaatcatgtcaatattgccatcctaaaataaaagtgtgacatcattccttctcatggattcagtgggatctaaataccccagcgacgtgatacccacactcatccatttaaaaactacacgaggccaggcgtggcggctcacgcctgtaatcccagcactttgagaggccaaggcaggcagatcacgagctcaggagatcgagaccatcctggctaacacggtgaaaccccgtctctactaaaaatacaaaaaattagccgggcgtggtggcgggcgcctgtagtcccagctacttgggaggctgaggcaggagaatagcgtgaacccgggaggcagagcttgcagtgagccgagatcgcgccactgcactccagcctgggcgacagagcgagactccgtctcaaaaaaaaagaaaaaacatctaaacaatgttgaaaaagaacacagctatagggctaatattacccaatttcagggcttattatataaaactctcaaaattcaatattaagaaaacaggccaggcacggtggctcatgcctgtaatcccagcactttgggaggccgagggaggcggatcacgaggtcaggagatcgagaccatcctggctaacacggtgaaaccccgtctctactaaaaaaaaaaaaatacaaaaaattagccgggcgcggtggtgggcgcctgtagtcccagctgctggggaggctgaggcaggagaatggcatgaacccagtaggtggaggttgcagtgagcggagatcacaccactgcactccagcctgggcgacagagtgagactccgtctcaaaaaaaacaacaacaacaaaaaactacacaaacaagctcttctttccctcacagagctcctggatcttctctccttgaatttgtttctattccatttctcctaaagaatgttgtcctagtttatatttttatattttcaagtcctttattcaccattacattttgcttccacaaaaaaaatctgtatacattgaaaacaaaaatttccagagaccacaaggctccaaatattcaaaatatattcaggattagttagtaccatgattggcagtacataattaaaaagacagccaggcacggtggctcacgcctgtaatcccagcactttgggaggctgaggctggtggatcacctgaggtcaggaattcgagaccagcctggccaacatgacaaaaccctgtctctactaaaaatacaaaagtgagccgggtgtggtggcgggcactgtagtccaagctactacttgggaggctgagatggaagaatcgcttgaacccaggaggtggaggttgcattgagccaagatcacaccactgcactccagcctggcgacagagtgagaccctgtctcaagaaaaaaaaaaaaaaagtaagccgacacattatatacattttatttatttttttgagacagagtttcgctcttattgtccaggccggagtgcaatggtgcgatcttggctcacagcaacctccgcctcctgggttcaagcgattctcctgcctcagcctcccgagtagctggaattacagacacacacaaccacacccggctaattttttgtatttttagtagagatggggtttctccatgttggtcaggctgatctcgaactcccgacctcaggtgatccacccgcctcggtctcccaaagtgctgggattacaggcgtgagccaccgcgcctggcctcattatacattttaataaatattaagtagcagagtaactttttggtggaatgctctctcaatgagatgggcggaacattttttgctttagttcgcgtatctatagggtattattttttgctagagtgaaacgaggctcagcatcaatttggttcatgtttctggttttgttgtaaagatgtgcaggtgctgtggctcccagccacaggaccacttgagcccaggagttcgagaccagcctgggcaatgtaggaccatgtctctaaaatgaacaagaaatatgtgaacaatgaaacattttgttcacataaagaagtagatgaggtcgaaaagagttttatcacagccgcgttacaccattctttaacctctctccatgctatccgccttaaatcgcatatatacctattactgaaaattacttgaaatgatctctcagttgaaaattgagtcctccatcagttttgtggaaggcaaagaactggataccacctgacttttgaaaggttctaagtggccactagagtcttttactttctgaacactgaccccaacgtttctttttttttttttttttgagacggagtctcgctctgtcgcccaggctggagtgcagtggtgcagtctcggctcactgcaagctccacctcccgggttcaagtgattctcctgcctcagcctcccgagtagctgggattacaggtgcctgccaccacgcccagctaattttttatttgtagtggagatggggtttcaccatgttggccaggctggtctcgagctcctgacctcaggcgatccacctgcctcggcctcccaaagtgctgggattacaggtgtgacccaccatgcctggcccctaccccaacatttctaaaagcccctctgttccccacccaggaggtctgcgcaccccgggccaagccccgacagccagcctcaggcctctcctctgcagaggacaggatggcgagatgctggctctcaggcagatggctttctggcaatagcacctatggcagctgagaatctgcaaactgatttcctgaaaactctcctgcccacgtcgccctcagaacgtctctgtgcactctgaggtgtgcgtgccacggtttgaacgcagttgctataacaggccactgtcatcacggaagggaaactggatctgggtcagccttgggcttcctgcagctcgatgtaggtccttcccacatctatcacccacacaccggctgggggcaggtggtacccaagcctccgacggggtctgggtctgcactgggttcgccctgcccagagaagggatggaacccagaacaggagacagaagttgggtgtgtgcagagaaccaagtgcccctcagggagaaccactgctccgggcacctcttcacacacgggaagcgtgaggccatcaccagcccggctggaggcaggggtcctacagggtctcaaaggaagccccagctctggccttactttcccgaaacctctctcccctctaagctgcttctgttctttgcaaaccctcctggatcacacaggctgtccctcgtagttccttcatctcgtctggacacggagccgggcctgggtctgtccccagctctgtcccccagcagtagccacacagggtggaggaatcaaatgctctttgtcaactgagatgctacccttggaagaaacattctggagcggccatgccctcttttttttttttttttttttttgagacagagtttcactcttgttgcccaggctggagtgcagtggtgtgatctcggctgactgcaacccgtctcccaggttcaaccgattcttctgcctcagcctcccaattagctgggactacaggtgcgcaccatcacacccggctaatttttgtatttttagtagagacagggtttcaccatgttggccaggctggtctcgaactcctgacctcaaatgacccacccaccttggcctcccaaagtgctgggattacaagtgtgagccaccatgcctggccaatttttttatttttagtagagatggggtttcaccatgttgcccaggctggtcttgaactccagacctcaggtggtccgcccaccttggcctcccaaagtgctgggatgacaggcgtgagccaccgcactcggcctgtatttatttttctagagacagggtctcactgtgccgtccaggctgctatgttgccctgggcttcagtgatcctcctgcctcagcctcctgaagagctggcattacaggcatgtaccactgtgtgggcccttattttttatttatttatttatttttgagacggagtcttgctctgtcgcccaggctggagtgctgtggcgcgatcctggctcactgcaagctccgcctcccgggttcacgccattctcctgcctcagcctcctgagtagctgggactacaggcgcccgccaccacccccggctaattttttgtatttttagtagagacggggtttcaccgtgttagccaggatggtcttgatctcctgacctcgtgattcgcccacctcggcctcccaaagtgctgggattacgggcgtgagccaccacgcctggcccgggcccttattttttaattgacacattgcagttgtatgtatttatggggcgcagttcgatgttttgagaccaccccttcttgaggcaggtctctccacacatcagcataagcctcaggccaattccatggcccctggtccgattcacccacagcccctcctccgccccagcttcccacgactgggtgcctcctggcagcttctgcaggaagctgagccaatggtcccttcccaagtctcagggggacctggacacaacctggtcggggggagtgtgcaggatttggaggcaggctgatctgagtctcccattcaaccgtgcgcactcgggcaaggcctttcacctccgtgaacttcaatttcctcatggaggcatccacacctgactcacagggctgttatggaagagtgagagcaacggacttatctcgagctcttcctgcaagtctgacactgatgaatcctctacacacagcatctgcgttcatgatcatgatagcagacatatgcggtttaagctctcatagccgctcccatctcacagatgaggatgctgcagcttaacgagagtgaggaatttacccagtgcacacctaggaagtcagagctggggttcaaaatcaaggcccccagcaccctctctgctgaaactgcagaatgtgtgaagtccatgacccgcagctgctgtaactgctgcttcctcagaaaggcaacatcgggcctcctggtgtgtgtcccgacccggtgggcagacctggtgctgggaggccacccccagtacagccctcccgctgcctcgtgcccatcacttccgctccagctgccaggttcaacctgggcacatctgacccaggactgcacctcctgatgctaaggcccagttctcgccccgcctcctccagagagccttctcggagagccccaggtcacagtgggaaactttgggtcctctctgccttcctgctccactaagatctaccctctgcagcctcccaggcgacacttgctgctgtctcacacactccagccccttctgaggccaggcctgggccaggggcactttcctaagctgtaagcccctcaagccctgacatcttcctggtgcctgctgcaggtgtggccctggtatctgctgcaggtgtggccctggtgcctgctgcaggtgtggccctggtatccgctcagagaggcctgcctggccccacggtgccctgacaacgacgctctgtttcccaggaggctatcagcctccagaaaccaagtctatttcaggatatcatttaaacacagaggagggagggagaggcacagcgtacattttccagagaaacgctgctgcccgcaactgcgctggctatttataactcctgggaaatgtggactgtgctatttcctgatgagattagcaccggggtggaggggctggcccctgggacgttggtggatgggacacctgactgctcaccctctggtcccagcagacaggtgccttccatgggcccaggggagcaggtacttgggggatgtctgatcacctgaagcagggagacagagggagctcgtgaagggtcaggctgggaagaccaccaggggcacacgagcactggggcctccccaaggtgggccacaggcaggagacagaaacaggctgcaaaacatcgtggagccaaaaggcggacgaacgactgggccaggggtcgacgactgggccgtacatggtcactgagagcagctcaactatttccttcttttttttttttgagacggagtcgcactctgtcgcccaggctggagtgcagtggcgcgatctcagctcactgcaacctccaccttcgggttcgagcgattctcctgcctcagcctcccgagtagctggggctacaggcacgagccaccacgcccggctaatttttgtatttttagtagagacggggtttcaccgtgttggccaggctggtctccaactcctgacctcaggtgatccacccgcctcggcctcccaaagtgctgggattccaggcgtgagcccctgcatccggccgactgttttctctttgtctgggcacttcgcctggtcaaatcatgactgcgcattcaggcctctcccaaagagaaacgctggcgctgggggctcatgtccaggagacgaccaggtcccctgcggcgaaaacccagcaggcaggggcaccgggttgaaatggggctccgtcacctccgagggagcaggagtgaagacccgaaggtgagcgtggattctctgccaagaatcccgtaggtggctggtggaggtcgcctcgcctttctggaccgaagtgacctcatgtttggggcaggaatcagcaaagtggccccgcagcggggagaggatttgaggctccagggcagagggtgctccacgcacacctgagcgtcctccagggctgagtttcaggaacatcctggggatgcccctgagggtctcagcccttcctctcggctcacctctcaccccctggggcaggtgaccccatttctcctgcctctgcccggagggctgctcccggccagctccccgtgctcggattcaggggcacgctccctccggtctccactcctgctccctcggaggtggcagagcccccattccaacccagtgctcctgcctgctgggccacactctccactccagcacgcagctcgccccaaggtcttcggagatggtttccaccacctcccctcccacaagccctcacccagggccctttaatccacagtaaggggcctgtggtggccctgcccaaggcaggtgggacttagaactggccactgggggtctcagtggaggggggagcagaggtcccaagcagccttcagtggacgccactcaggacgtgatccaggggctcactggacgacgggaatctgaagaccacatttgccagggccccaagagctcccaggcctccgcctccttcctgaaagccgcttccctcaggagcccactcggtcactcccaccgcccaggagctgaccccccgaggagccctgcctccaggcacagccctgccctcgggggccgccccatcctgcctctcacggctggcgctcttctaccctccaccctctgagccccggcatcccagaatgcgggagggtttccctcagagggggttgcagaggttcataaaaaaaagtgcttcttcagccaggtgcggtggctcacgcctgtcatcccagcactttgggaggccgaggcgggcggatcacaaggtcaggagatcgagaccaacctgaccaacgtggcgaaaccccgtctctactaaaaatacaaaaattagccaggcgtggtggcgggtgcctgtaatcccagctactggggaggctgaggcaggagaatcgcttgaacccgggaggcggaggttgcagtgagccggagttgagattgtgccactgcactccagcctggcggcagaaaaaaaaaaaaaatgcttcttcacaacaaaggtggtaaatctgttcctgagaggtgggacaggaacgctagaaaatgactcccagccgggcgcggtggctcatgcctgtaatcccagcactctgggaggcagaggcgggcggatcactcgagctcaggagttcgagaccagcctggccaacctgacgaaaccccatctctactaaaaatacaaaattagccggaaatcacttgaacccgggaggcaggggttgcagtgagccaagatagcaccactgcactccagcctgggcaacagagcaagactctgtctcaaaaaaaaaaaaaaaaaaacagaaaatgactccagaaggacctcagtgcaagtggcccccggacagggaaccacgtggaaggtggagctgtgtgggcacatttcacgcctgccctggaggggccgcggagcccaggccctgagccaggcatcgggtctgagggtgggcacgtttcctggggctcccaggccagcggccacggtggcagcccgggctggctttcccctgccctcccccaagggcagccccacgctcagggctgggtccccttgggacaccgaagccggcctgtcattggggcagaccacaggcgtgagaggcacggcggggctggcaagctggcaacgggggagacgggagttgccaagaccctgcctctcctccctcgaggaggcgccggaggattccgtcaacgtgactgctccgagcgactccgagagaggcagggcagagagggaggggctgccaggacctacccctggcttccagctcagcagctgggttggggacaccgggccaggctccataaactctccacacatcttcccatggcttggcatccacactgctaggccaggcaggctccgcctctccagccctcaccctgcagggtcagccaggctcccttgtagccaaggtgtcctgcagccaaggtgtgcccacctgccatacccaggccagccacagataggctcgggctgatgccgtgtcccagggcctcggctggcttcccctccaacaccagagaacttcgaagttccccaagcctcatgggaggaaggggattagcagctctgaacgacgcttttgtccaaggcaggctagcctcttagcacccgcagcaacctgccttccccagcgtccattctagcacctctgcctgccccacgtccgctccagagcctctgccggccccacgtccactgcagagcctctgcctgccccacgtccgctccagcgcctctgccggccccacgtccactgcagagcctctgccggccccacgtccactacagcgcctctgccggccccacgtccactccagcgcctctgccggccccacgtccactccagcgcctctgccggccccacgtccactccagagcctctgcctgccctggcacccactttgcttttagcccccgggctgggcatggctgaccttgaggagaagcagacaaaatccaaacctgggctgctcttggaggccccacagccaggcacatctcccccagcggcctagggctccgtcttcctcagggccagcccaccccaccactgcctccctgtgcaggcagcctggaggcttcagcttcagctcagaactgggctacaaataccagccaggaagccggccctgccccagcccagggcaggtcgaggatgccagagtggcaagggcaggggcagtggggccctcttgagaaaaggaacaggccagggccaaagcaacacggaggccctgtcctgaaaggaaaggggcgccctcagaggtcaaagtccaagatgagaggccttctgtggtcctgaccaggaagcttcacgctggaggccacgggaaggccaaggacctgtcagacctccatgggctctgaagcctcgagctggacctggagtggttaagaaacattaacagggctgggcgcggtggttcacacctgtaatcccagcactgtgggaggcctaggtgggaggatcacctgaggtcaggagttcgagaccagcctggccaacatggagaaaccctgtctctactaaaaatacaaaaattaccccggcgtggtggcacatgcctgtaaacccagctactcagggggctgaggcaggagaaccgcttgaacccaggaggcggaggttgcggtgagccgagattgtgccattgtactccagcctgggcgacagagcgagactccatctcaaaaaaaaaaaaaaaaaaaaaaaaagcagcatcaacagccttctctgataccagcttcaccctccctgcccgggcccagaacactttctgggcatggagcttgctgccggggacgtgaggggctccagcaattccagggcccaggtcagctctgagcggcccctcccaggccttgccttgctccgagtctcacgttcagtggcgtcgtcgagaagaaccgtcttgcctgttgctatgcacagcgtgccaggacgggcaccacactgatgcctgacgggcaggagcccggcgtctccagacgctcccatctggggcacgcagcccaaccccaaccggccacggaaggcaggacaccgcgggtgagagcctgcgctgaggctgagtggccggggtctgaacgtcgcccctcggctaagccactcacgtgacttcatctgagtcactctctgagcctcattcctcatatataaaaacagtctgggccaggcacgggggctcccgcctgtaatccagcactgtgggaggcggaggcaggtggatccactgaagccagaagttcaacatcagcctgcgcaacataacgaaacctcgtctttacaaaaaatacaaaaattagccaggcatgttggtacatgcctgtagacccagctacttgggaggctgaggtgggaggattgcttgagcctgggagatggaggctgcagtgagccgagatggtgccactgcactccagcctgggcgagagagtgagactcccacaaaaaaaaaaaaaaaaaaaattaaaaatgtaaaacaaaattcaaaacacatttaggcctggcgcagtgactcacgcctgtaatctcagcactttgggaagctgaggcgggtggatcacctgaggtcaggagttcaagaccagcctggctaacacggtgaaaccccgtctctactaaaaatacaaaaaattagctgggcgaggtggcgggcgcctgtagtcccagctactcgggaggctgaggcaggagaatggcgtgaaccccagggggcggagcctgcagtgagccaagattgcgccactgcactccagcctgggcgacagcgagactccgtctcaaaaaaaaaaaaaaaaaaatacaaaacttggccgggcgtggtggcgggcacctgtaatcccagctactcaggaggctgaggcaggagaatcgcttgaacccgggaggcggaggctgcagcgagccgagatcgcgccattgcactccagcctgggcgacacagcaagactctgtctcaaaacaacaacagcaaacaaaaacaaaagaacccaaacaaataaataaataaacagtgtgaataacagcaccttgtaagtgtcacctcagttgcgtcacaggctaagaatgatgcctcgtacagtacgtgttcaaaacatatcgtcacagaactgtgcttgaacaccccgcggcttcccactgcattcggattaaaggccctgtcctgaaccgcagggccccacgtcgcctggccgccgtcccctgaccccacgtaacgccccacactgtccccctctgcctctgagcacacctgcctcggggtgtggaccttgccggttctttggcctggaatgcactgcccccaggttttttatggctgaattcttcttgtcatttaaatcttcgttcaaaagtgatcctctcaagccaggcatccccccgtcactctctactgcgttacccagttgtgtttatttttttcacagcactcatctgaccggcaaggatctcatttgttgacggactcctcctgcagacagggtctcgtctgtctcgggcgcctctgtgtccctagttcctgcaggcctggcacgtggaaggtgctccggcaatactcacaggccagaggaaccaactggggcatgggggaaggaggtgacaatggctccccgccggggctgcttcaggacagggctcaagaagccctgtgttcccactaaaccccctgctcccgtgtccactgaatggctggcattggcccaggtgcagccctgtgacagactctcccagggtgctcagggtttaaggtttaggactaggaatcttgagacatggccaagatcatcacatgaactggattccaggagatcatcctgttcagctccttcattgagctgataccagagaaccagagaggcaaagggatgtactcgcgggcacacagcagttaagtagcagactgagacgagaaaaatgggaaaccttgactcccaccggcctggcgccctgtcttctctggcaccttgtgccacatgagcctgaggggctggggaccccggaggcctccccgagcacagccacggcatccaggcatcggatgggaagggcgctgtggatgtcacggctctggctgtgccggtcatcggtaccagccccggctggggtcacggtccagaaaggagatccctccagatttcggctcaggagctggttccgctgtcttgaagcgggactggggaagtctctgtggggatcctggggcctcctggcctctctacagaagcccaggaccagctccacgggcccctcccgcctctccagggcccatcctggagggccaagggtctacggctcactggacccaggactgacgctgcgtttctccccagggtggggcaggcaggtcacaggcgcaggggactgtctgttcctcgaaggtgctggggggccgtcaggacacaaacatcttcctgccccagcatgagttcacaggggaaacgaggtcaaagaacagcacctgctgaccagttcccaaccacctgggcagtgagcgaggccactcagcagagggccaggcctctccagcaccagcgccctgtggccaacacctggcagctcccccagactcacacctgcaggcttgggggcgcttccaaaatgcctggggcagctcccccagactcacacctgcaggcttgggggctccttccaaaatgcctggggcagctcccccagactcacacctgcaggcttgggggctccttccaaaatgcctggggcagctcccccagccacacctgcaggcttgggggctccttccaaaatgtctggggcctcattgcctctgggtactacagcaacactgggctcaggcagctttggcctttgaggaacccccttgattggcaggttctcctctccctggtccagagccatccaaaagctggggcaccgcgcccagcaccgctggctggccaagccgtctgtggcctgcagggaggccggggaggaccagcgcccttctaccctccctaggtaccaagaagcggcaccttgccaagttcactcagagcagggttcccgccttgatgtctgcagccccctctgaagtcgcacacagtgtgtgcatggggtggctctgtgtctgagtggcctccagaaccttcatcagattctcagagtccagggttcccgctctgcggactcaagcaagcctcttgggagctggcctggcagagagatcagagagtactcatgaggccccagcagtgaggtctgcccactcggcaggtgggtaagtgctgtggaaaagagggagggtcgcccgaccccactgccaacctgtcagccagcctggccgcagtcaggacccacacataggcccaggaagaggtgggctggtgtaggggcctccagctctcgggggaggcagcactgtagtcccctgtctgtggctgaggggtcgctatgggggtgtgtgtgaacagagaagacgcacgatgaagctttcttcccaccgggaaacaaggaagggcggtgggcagccgggccaggccagacttctattgcagaaggctgcgagatctttcctgacgcccagactggattataaaataaagtagacgagcccaagacatatctgtatcttgtacccagcacctgtgtaccctcgatggccaagtgagtggtagagtgaacctctggggtgtgcacgtggtctgcacacctggtaccatcaagaaggaataaacgacaggctctgtgaggggtggggttgtcctgcggtggcgatcaagctgacaaagaaagggaccctttcctccccccaccccaagaccgagtctcgctctgttgcccaggctggagtgcagtggcatgatctcggctcactgcaacctccacctcccaggttcaagcgatgctcctgcctcagcctccctagcagctgggattacaggtgcccgccaccatgcccggctattttttttttttttgtatttttagtagacacggggtttcaccatgttggccaggctggtctcgaacgcctgacctcaggtgatccacccgcctctgcctcccaaagtgctgggatgacaggcgtgagccaccacacttggctaatttttgcattgttagttgagacggggcttctccatgttggccaggctggtcttggactcctgacatcaggtgatccaagaaagggaccttcttctaagaccatcatgagcctgaagcttccccgaatggcccaagaggggctctccaccccgcccttcctcaggtaacacctctgatcctctctgaagcaaaggcagcagctcccatcacagaacacgggactcaccgtgggggtcagcagtgccggtgtccagcttaagaggagctctttggaagtaggggattctcagacccacatggctgtgcttcagggcagagacaaggtcacctgaagctgcactcaatctccttacaccctgccggctcagcctgagtccccaccgccggccagcatctggcctggtctgggtcaggagcgtcttggacttggttgctctataagggcctcaacttccccgacagacaaatgcttctggaccggcctcccttcaggccctcttagcctcctcacggctcccacaaggggatgctgcgggggcagggtgggggggttcctccttcagccccttcccctccaaagctcaagcgagaatctagaattcagccccttcccatccaaagctcaaccaagaatctagaagagggaaggatgggagggagaggaaggcaccgggcctggtctacttgagtgtgatttgaggcaaaaaaaaaaaaaaacaaacagggaaaaggaaagaaaagtagaaacgcgaagttcaataccgagagccctggctgaacccacaaacccagatgccacgtgtctcccagctaaacactcgcacaaaaagctgactgccaagtcaggggctggaatgaggctttggcccctgaactctcctccggtgacaagaacagcccaaccacagggacccccgctggtacccaaaggatcctccgtgagtgtccctgcctcctctcccccagaaaccagaggccctgcactatttaaaggctcagttctgatcatgagacctttccatctgaacagattgtttaatcccagccctggatgagtcacgccccgcctccagcctttaatgaaccttcaggtcagtggaagcaggagggccaccggtgtttctcgcacccacagcatcactcagggcaaagttaacgaggagttaatgaggcaatccctcctgccagtctgggcagtaccaggcacccttcccttaccccaccgaaacgaaactgcctagtcccagcccctcggcccaactgtgaagctcctgcaggaaaatgccaggttaatgtggctgaggatagaaagcaagaggcctggccctttgactctgctgctcacccgctggcctgcgcacagtgaggtgggaagcacagggcagacgtccctccgtccaccacagcgctgacccgtgtccacgacacggacacactgtggcagacgtccctccgtccaccacagcgctgacccctgcgtccacgacacggacacactgtggcagacgtccctccgtccgccacagcgctgacccctgcgtccacgacacggacacactgtggcacacagcacacgttaggggatggaatcgctcgtcacacagagcagcccagggccggggccaccctgagctgcactgacgccaactgctcagcagctcaatagcccggcgtctgcctggccaccacccctgcccagagatccccatcagacacggagccaccaggcactgccagaggcaaacccagctaaggaattcttgaaggggcttctcagttctgccggccacaaatgcatagggaaagaactgaaagtctgggacctcaggtttaaaagttgccccctgcccaccaggcacctcctcaaaggggcaggtaaactggaagcgccctgtttggctggcgctggacccggaacctgccaggtcagtttcttgccaaccctgacgtttggggatggatggtgagctctgggctggtgcctgctggcctcagcaggggctggggaggggatgagtccacgctgccgggcacagacagctgcctcagcacagaggggctctggcagcagctggggccagcagggctctgctagcccagtccccagggaggctgaaggtgacacaggggccagtgcagtacagctcaagttgctgccctgcccagcactttccagggctgatgtcacctctgggaggtcaagtatgccccatggcaggagctgaaacaaaacgaggggccagtgagcccaagatcacttcgtcctggctgatgccaggagcctcaatgccggctggcagtaagagcctgcagagaggtcctgtgagcctcaggaggagctgcagatccccaccacggactggccaaggcctcccttgttgctctcttgatggatgggcccagccctggccagccggactggcactctgagacagctaactcggacagttgatttgatctgcagagttatcgagcacttcctgtgcgctgggcgctgggtctggctcttcctcacgtgcctgatgccagggccccaagccagccccgaggcagcctgcccagctgcaggacagtcggcttctatctcagattttaatcccaactcaggtctggggctgcaggggcaccggcggtctgccctggcacatggacggaacgcctggtgcccggcgggcactgggcccacagtcagatgggtggtccctgaagggaagcctcgagcccccagacccggcagcatctcccctccccacaatcctgcacagagaaacctcacacggcagacggtgctgcggtcggcgcccctcagcaaaggggcagccagcaaggcccgctggatgcagggatcaggtagaggctgaacagggcggcaagacatagacccagaggcaggcgtctccccgtgcgctgtttgcactcccggagtggaaagcagggtccacctgccgagaagaaacctcccttctcccgaggcaggggcagatgcccgagcgccagggtccgggtgggggcggccccagcgttcgccatcaagttcaagccacttagagggacgcgcacagaccccagctctgtcccgggactccacggagggggcgggagcgggaccccatcagcccccgcagcccccgcagccccccgagccccgcagcgcccccgagcccccaccccccggaacctccagcccccgcgggcaccttgtttcggagcagcttgttgcgcacgcggccccagagccgggcgccggtgttgggggggcgcttgctccccgactcctccagcgccaggggttcgcgccccgccttcgggctgcagtcgggctggggcaggacgtcggtcatgccgggggggacgggacgcggcgctggagagaaggcgcctgtggagcgctcagtcccggctgccagtcccgctagttccctagtcccgccggctttccccgcgctcgcctccctccctccctccctccccgcgctcccctccctccctccctccgtccgcgtccctcctccctcctccctcctccgcatccctccttccccgccctccgcgaggctgcagcccaggctgagcgccgcctcccaggcccagggccgcccctccaagccccaaccccgggtttcatccctggcaagggcgctgctcctccccgaccccgccgccctccctcgcaataaagtttacaccagccccacaccccagtccctccctgctgggtccccgtgttgcccaccgggctgctccaggggccaagcggaggggccgggggccaggcgggggctgcattttggccacaaacagctgccctcctccccgggcaaaagactctgactgccctggggtcgcacttccccacccccaacttctgccccaggcaccttcctcagagccagcttggtgacccggccagacccttgtggaccggcactcagaagcctcctcaggtgagaaatgtaaggataaaggagacccctagtgtgggaatcccagtgggaatcgggtcactgatctgctcagggacaggagcaaaagcccgaaacgacgcgggtcacacgtccagccagagatgcctcttgaggggtcactttgaaccatggccctttgcacctcaccaaaaaaggtttccgctgccaggggcagaggacgccacgggcaaccacccgcgtccgtgctgggcgcagaggacgccacgggcaaccacccgcgtccgtgctgggcgcagaggacgccacgggcaaccacccgtgtccgtgctgggcgccttgagagagagaagaacttgttcttgaccttcaatttatttagtgaactttctaaccgcagagactaggacacaaattacgtctcaaggtaacagtgcaagttagagtacggtattcagagaaaagagaaaggctgaatcccaaatgtttaactatgcaaaacccaggggtgtctggggcctcggacctctgcagaccccagcacggcacagaaaggaaaccagtatttgcaccgtggcaaccgcgaaccaggtctttcaaacgcccgactgcatgtgagcctcacattcttgtcatgttggtgttactgccctgttctagagaggtgaggacagggggtcaggaggtccagttcttgccagggttacacagtgccaagtgaggatggggaggtccctccaaagcccttggtgctcacaagcactgtgccttactcaaacatggatgatgctttggattcaggaaaaagagctgggtcaggacatttcttggttgaccccaaggcaggtgggtcggggcccagagacgagccctcggcatccggcgtcaccagccaggcaggtgtcgggatttctcctcagaggccttggtgtttttgaggaataggtggcttccctgcagagacagccgtagtcagagctgtccttcgtggaaggctggcagggaccaggcatcatggattaagtcacttacccctcccaactgtatgaagtcagtaccagcatccccgctttacctctgaggaaacgaagggctctgacaagctgagctacgtgtccaaggccaggacaagctggaacacaaacggaggtctggctaactccaaagcccacacccctgtcactcactgtgatgccctagtgtggcaggatctggccctggactatcttccacctggctggtggaggggggccttggggcgtcctgcctgggctagaaccgggcctcagtcttcactgtccctgcaggggcggccagaccagctccacttcttcctggctcacacgtcacacgcacccctggacggtgcacacggaacttcctcaaacctgagctgctaagtgggggctgagccacaacagcctcaccagcaccgcctgagggggaggtggagagacggacggaggtaggaacatgcctgtgtcccctaactgaggcctcagtcacccttctccacccctccttcgcctgccccttccagggctccaggaggacccagacagccccttcacacagccacaaagccatctcctccaggaaggctctgctcactcctcaggccccactgcttggtcccactcatgtcatttttttttttttttttttgaggcagtgtcttgctctgttgcccaggctggagtgcagtggtgcaatcttggctcactgcagcctccgcctccccagctcaagcaactctcctgcctcagccccttgagtagatgggactacacacacccaccaccacgcccggctaatttttgtatttttcgcagagacgaggtttcaccatgctggccaggctggtctcaaactcctgacctcagcctcccacagtgctgggtttacaggcatgaaccactgcacctggccccactcatgtcactctagaggtagtgactgagggcctggctgcgtgcccgaccctggggtgggggttaaggcatcacagagacgaatcaaaagtcagtgcttgacaaaggggcagccaagaaagcagagatgtccatcaacaggaggcagacaagcatttgtgcatttggcacgggtcacttgtgcacctactaggcaccacgcccagatggacaaaacccgcacaaaatcccatattacggcctcagaacaggacagacaaaatgccacgaacatcgagagatacaatttccagctggaggcaactggggaaggcttcctggaggagaggggtcagcgtggggccctcggggctgtagggaaaggccatccaccctcactgggtcccagctttactctacctccctccagcaaacgtgcaatggctgtcatgtaactggctggtaggatgccattataactgctctccacgtttgcgccacagtgctcctggtgccgtgacttaacttcagaatcggcccctcactggcctatggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacgatggccagctggtctccatggtgacataagtgccttcgcagatgggtagccgagttgggagtcttcccctgagacgctcatctttcccttcctccctatggactgggggcttcctctggggacagcgcagacttgccttctctcccccaagcccgactcattgcttcctggagtcaatggtcttgggtggaagaagatctgtgcaagacagatgtccccagcaaaagcagaagtctgaattctagtcgctgcagcccaccacggacccctcctcatctctgctgggttcagctcaggctatcccaaccacctgggaaggggccactctccttcctccctcactccttccatcccctaaacctgctcccccccaccccttccaccccctacacctgctcccccaccccttccatcccccacacctgctcccccaccccttccatcccctacacctgctccccccaccccttccatcccccacacctgttcccccaccccttccatcccccacacctgctccccccaccccttccatcccccacacctgctccccccaccctttctacccccacctgctccccccaccccttccatcccccacacctgctccccccaccccttccatcccccacacctgctccccccaccccttccatcccccacacctgccagagccctcctcagacgacctgcaagactcccccggctggataaacagagcctggtggtaaggcccccacgaacagatgtcactgcctttggaattaaaaacattcctagtggaccatcccatcctccctcagcccctccccaggctctctgcaaggggagtgagaggggctgtccccggggagacgtgggtgggaccccgcattacacctagggagggggtcatgccacccagcacagctgtgactgaggtaaaatcgggttaaggtgttcagtggcggcatcaacgaggaaaaaaggtcacatcctgccctgtgcgagcgggaggggcaaaggctgcagtggggctgcctcggtgacagctgggggtggggacggcttccaggcaaatcctccagcctgtgagcaccaggaggaaggttctgcctcagaacctagaaatgcagctgccgctttcctggagtgacctcctttttcccaccagaacgacgctcctctcccccagcccacacttgaaccccgattcctcgtcctatccgctagcgcaaatgactccaggagagggggtttctgagcagccagctagaccaaggccacaggcgccccagtggggatagcctgggagccagttggggcggggagagccccaagaggccgcccagagagtccagagcccaggaggagcctggcacccagctgaggatggggaccgaggggatgtggctcaggtctgccaagaacactccctctctcagcaccagaggatcagggcaccggctgggcatcagaggaccagagctgggggacaagaaggtgctggaggagagcagggcggacccgaggctggggggcaagaaggtgctggaggagagcagggcggacccgaggctttgggggctgcagagagcctgccagtggctcctgcccaaagacaggtgcaggctccaggatgagagagagacaagcaggccgagcatgggagcccggggtgcccagcgcccacacagggcgtgcgagttgggcgggaggatggcacgttccggggacagctgtgggggagtggggacgggagtgtcccccaactcggtggctctgtggtcactgcattcttactgtgtgttctgaccatttcctgtaccgaccctaaccaaaacctgcggactggaaggccaaatgtcttcccagaatgagacactgagactcactctaggtttttctccccacccatcggatacctctgggtatttgcaatgttcagagcctgcattcagcctggggacaggagtcacccagcagccaatggcagattagaccctaggagctatgtttgtttctttctttccttccttccatccttccttccttccatccttccttccttccatccatccacccatccatccatccatccacccatccatccacccacccacccatccttccatccatccatccatccatccacccacccacccatccatccaggtggggctgggagaggggtccagggtgggctcaaggttgaagatgggcacagtgtaaggaagaaggcagtcaggatgaaatcagttgctctacggcccagacctaggcctgcccaaggtaacctgctgtcctcccaactccccaaaggcctgtgccggctcatagggcagtcccgagtacgtgctgcttctcacacagctccagcctccctctgcctgacctccagcctctctctggccacgtcaggctggtgtcgccagggtgctcggtggttctaggtacggaggagaggctgaaacagcccaagagcttgtctgctgcaggagaagtgtcccgacagcccgtccctggcaaaccctagcgattctcacagcacatttggtcatggaaaagggtgaaaaatgcacttgagcctttgggaacatcttgcttatctagaacaaaactcacccagggacagagtgggcagggcgtggcccctcagtatgctgtccctaccgctggagcccccctgggctgcttgcctgctcctcctcccgggaaggagggggtgtggccgggtctcccagcacagccataaattgcagcctgaggcaggaggggctgaggcctgaaggtgggatggggtcgccgagcctccctgctctttcttcattctggattcccgaacacctcccttccacccaagctccgagctcatggtggccagaagcaaagccctgggagccagggacctgtggactcaacggctgtgtttttctctgggttcagtttccacagctgtcaaatcaggagctcggaacagacacatggtctccggtgagatttcttttctgctgaggacgcacccctgccgttttttccaaatgaaattttatgccgacgtctccctgcccacctcgtcggataaaagcagaagcagagagagcaggcgccctggctgaagaggggacgtggggcccactggctcacacctgcttttccaccacccctcgcctgccttggggctcacgtccctccccggaattcccacgccccacaggcagaatctgaggcacacctcagcgccccgccctcctttcaggcatctacagctcaaaccttaggttcccagcagctcctagaggcagttctcccgaaggcctcgctctccctcggggtgggggacgtgggggtctgagagattaggggctttgtaaggacacctctgggtcagacgctgaacctgcagctccagtcgtgtctctgcttctctccctcctttgggaaactcagggcttttgctcagtggctgtgggttcgccctggcagcctcgagaggggacagcacctgtctagtgggtcaggcgggtgtgtctgggtcatcttgcgtctccagccgcgctagggtctttcctgaagccagggcagctcagcacttgcctccgagggcgtgaacacggtgtgcccatccctccctgccccagcccaaagctacaggctacactggggcttagaccctcgcccagcaccaccaatgtccacgcccccaggccacggcaagggcggggctggccacgaggggctgctgtgagtctgcggtggccgcaggcttgagggaggccagcagagcccaccctaaaggtgacccccgctcagcattcatctgcagcctcagccctaactcaagaaattctctggcaacccttctgtggcatccttctcttgaagctttcagaaaacacggaaagtgggacaaccctggagctgatcctttggattcctaggaggaagcagcagcctccgccagcagggaggttagcggctcacggggaggaatctatgtctgcggctttcgcctcggcgagttcgctgaatgccacggacccgagaggacactctctgaagggtcacccgaggttggccggctaagatcaaacccaggtcccgtgcctctgagtctgggagcccggcacccagagctgagaacacctttttttggtctgtcgggaggctggatgttctcagggcctgactgcatcggctcctgaggtcctgtctggaccggcttctctgcatggtgcccacccttcagaggcgggtcagggggagcgggcgccaagcctgcctgctgaggcggcacttcccaggggtggaggggagcggggggagccgactcacacctccatctgcttcctgctggatgcttcctgcccagaatccactgggcagagtccaggctcccaaaatcaggaacacctgggcgatggaggcagctgagcagggctgacgagagaggttcgtgccccacgtttggaaaagctttcgacggcagggcaggcactctcgagggaccctcccccgacttcccccacccaggacagtctctgctgcccactctccaaggagaaccaggcgtctagacctgccttgaagagggacagcaggtgggagtctgggctggagaacaaatgtgcccgaaacagctggggtgggcagggccagagcaggacaatggctgcagtcacggggccctgggaggaagtggagagtcagcaggaagtagaaccaggcctggggctcagcctccacggtccctatgtgcctggggaactggcacaggggtgggggtggcggcagagggaagagccccacgtgggccagctgtgagggtggcaagcagcagggaggcggaactcctaagccaggagccgaggcggggcctgacatgcactcctggccttggcgggcgccgacgcgggctgatcttccagggagaggtcactccggtgtcccacgacagggagctatgggggctgtgagtgccagggcaggggttggggacgggagagatggaaccaaagggaaaggcctgtgttccttcccagttgaatcaaggcctccctcagggccaggggcccggctgtggtcagtgtggcccacgcgtgaggcctggaacggggaagcactgaggacccacgttaccggccgtcgatcatcttcctgggaggggtcccagtaccactatgaagaacgagagggggccggagctggaaggggctctgggctcacaacccagggcccccaggacgcacgcgcaggaccctcaggcagggtcgaatggggacaagacaccccttgggggtcagagggagggaagtggggcaggggagcccttgactcctgccctggcgggctccggccccacgttctctgcaagcttcctcgtgctctccagagtaattgaaaccagaagctgctccccagccgctgacaaaggccccttgtttccgaccacaccaggccaagctcagagctgccgtgctgggtcatggcagggaaacctcgggccagccggcattgagggccccagccttgacttccccgcccctgctatgaggttggttcagcaaagccagtctgaccccatcagcttaagaaaataatgctgcctcggccagccaaaggccccgacccaggggaccacttataggtgacagcctttaggagggggctgctggacaagtgacacccagaaccactggaagggggtgggggacagggtgcctgaacccgccagcttagggcaaaccacgtactgactccatgccaggccccgggtccagggtttcatggaccctcacattcagtcctcttacagcccatctgacaggtcaggaagctgaggctcagaggcaaagatactcgctctgttctcccaactaacgatggagaaagctagactcagccccgcaagatctgtctggcctcaaaaccccggcaacactggctaacgatccaagttctcgttttcctttttttgagacagagtctcgctctgtagcccaggctggagtgtaatggcgcaatctcggctcaccgcaacctccacctcctgggtcctggttcacaccattctcctgcctcagcctcccgagtagctgggattacaggagcgcaccatcacgcccggctgatttttctatttttagtagagacggcgtttcaccatgttggccaggctggtctcgaactcctgacctcatgatccgcccgcctcggcctcctaaagtgctgggattacaggcatgaaccaccgtgcctggcctaagttctcttgttttctttaccagacggtgaggtcctggtcattctttgtacccacagcccagggcctgccattcagaggatgtatcgtaaacagaaacaagtgagtgaacaggtgaaagcgtggacgcacacgtcacagcaccgactggctcttccaggtatgtgagatcctttaagccagtgctgaaggtggggtaggaatagttacccccactgaatcaataaagaaacttggccgggtgcggtggctcacgcctgtcatcccagcactttgggaggctgaggcgggtggatcacaaggtcaggagttcgagaccagcctggccaacatggcaaaaccccgtctctactaaaaatacgaaaattagctgggcatggtggcgggcgcctttaatcccagctaaccaggagactgagacaggagaatcacttgaacccgggagacggaggttgcagtgagccaagactgcgccattacactcagcctgggcgacagagagagactccatctcaaataaatataaataagtaaataaataaaagaagaaactgagatgccaagaagtcaagggaccagaggttgttcccgcggcctcagggtgactgcgtctgcattcgatgcacctaaaccactgaccaggggaggaaagagctgacccaggaagaagggtgaaggggtcaaggggcagggacacttggccgggagggggagagaaggccgaggcagggggcccaactgtgtgcttcaactacaggagactaatagtgaccagtcatgccctagggtcacgggtcctgctcatctattacagctgggaggcaggtgggggacagagcttgggtctggagagaaggaggctgtgctgtctccatcctcagggacaaggttctttttctcaacgaaaggcaagagcgttttgggtggaaacaacccaaatgtgcacggatggacggacggacagacggataaacagacatggcacctacatccacggacggacggataaacagacatggcacctacatccatgaatggatggataaacagacgtggcacctacatccgcggatggatggataaacagacgtggcagctacatccacaaacggatgaataaacagacgtggcacctacatccacgaacggatggataaacagacgtggcacctacatccacggacggatggataaatagacatggcagctacatccacagatggacaggcggataaacagacgtggcagctacatccacgggtgggtggacaaacagatatggcacctacatccacggacggatggataaacagatgtggcacctacatccatggacggatggatgggtaaacagacatggcacctacgtccacagacggatggatggacgaagagacgtggcacctacatccacggacagacagaaggacaaacagacgtggcacctacatccacagatggatggataaatagacgtggcacctacatccacggatggatggatggataaacagacatggcacctacattcacggacggatggatggataaacagatgtggcacctatatccacagacggataaacagacgtggcacctacatccacggacggacgggcagataaagagacgtggcatctacatccagggaaattgtatccagcctcagaaagggaggaaattcagacacacaacggcatatgggtgaagctcaaggacatgaggaggacaaatgctgtctgattccacctacgtaaggttcccagactggacaaattcgtacagacagaaagcaggcaggtggttactggaggctaagggtgcaggagtggggagttatgatttaatggggatggggtttcggctggggagggccaacaagttctggatatgcacactggcaacggctgcacagcaccaaatccacctatggccacggagctgtgcacccaaaaattattattttttgagatggagtctcactctattgcccaggctggagtgcagtggcatgatcttggctcactgcaacctctgcctcccaggttcaagcaattctccagcctcagtgtcccgaatagctgggactacaggcgtgcaccaccacgcccggctaattttttttaatctttgtagagatggggtctcaccatgttggccaggctggtcttgaactcctgacctcaggtgatccatctacctcggcctcccaaagtgctgggattacaggcgtgagccaccgcgcccggcccctaaaatttattaaaatggtaactttatgttatgtatatttcactacaatcttttattttttatttttttcagtggagatagactcttgctctgtcacccaggctggagtacagtagcgcaatccttagctcactctagcctccttagcctcccaagtagtccacagctacaccacgtgagctactatgcctggcttctaccactattttttctttaaaaagaataaaggccggacgcggtggctcacactcccttcctggcctggaacctgcccctcccaccacagggtcttcagcgctgctgtgcccagggaggggctgccctggcaggcacgtggggaagtggagctgcctcccaggcacagggagcagaggtggactgtggggtgggggctgtccccagcctgcggtgagcgagggaatgacgcagggccggggggcgggcagggggtgcagagggcccctcaggtttaagtagcttcttggtctcaggcccttctccagtctggggacgctggcagaaactgagctgtggggccccaagggaaagcgctctcctcaggcccagcccgccaagaagggccggaccctgggaatatgctaatcagctagcgggtaggttgcagctggagcggcaaggctggaaatagagtaggataaacacagtggagtcccctgggaccaggagccagggcagactacgccgggggcaggggcaagagccggtggagggggggctcccagctaagcggacctggatggggtccctgagtctggggcccttgttcacccactaacaagctctgtgaccgcggctgcctcgctcacccttgctggtgtccatttccttctctccggaaaacaggattggattaaacgccctctaagatttattccaggccgggtgccgtggctcaggcctgtaatcccagcactttgggaggctgaggtggacagatcacctgagctcaggagtttgagaccagcctggtcaacatggtgaaaccctgtctctactactactaataaaaatcagctgggcatggtggtgggcgcctgtaatcccagctactcgggaggctgggacaggagaatggcgtgaacctgggaggcagaggttgcagtgagccaagattgcgccattgcactccagcctgggcagcacagcaagaccccatctcaaaaaaaaaaaaaatacctcttccggccaaacccccaggaatcccctccttttattcattccttctactggccttgcttgcagctccccgccacccctgctgaggctcctgactttcctgggaccctcccttcacattcgtgcctccctgccaggcgggtctgtcctccagaactcccaccctactcccttctgcggaagcggagcctgcgcaccttgctggaataacacagagccttagcatagcaattgcgctggccgctctataccaagatttctacaaagaatataaagtacttttaacaaagtatccaaaaaggtgcttaagaagactccatacagctctagagaaaaggaggtttataataatccatgaaaacagaaaaacagacaaaacaggccctgattaaatctacataaaaatgtgtatacctcaagaagggaaaaggcacagaataaactggctgcttcggaggagccggaggaaggatggtttctgattaggtttcaagtctctttgcttctactgcaattttctttctcatacaaacattgcttttggaattaaaaaacccagggcttccaaatcgctctcgttccacctcctccttgaagcctccctaattccagcccatggtgacctttctgcctctgaattcctgcgggacaatcttccatcttcttatagcaggacaatcttccatcttcttacagcaggacaatcttccgtcttcttacagcaggacaatcttccgtcttcttacagcaggacaatcttccgtcttcttacagcaggacaatcttccgtcttcttacagcaggacaatcttccgtcttcttatagcaggaggcagcaggacatctagaaatgggctctgcagccagctgcccgccctggcccactcctgggcacatggccttgtccgggctccttagccccagcttcctcatctttctagctgtgatgatattcctctcccacagggtcctgggaagatctcctgagacagcagatggaagcatttagcaccgtgctgggctcgtcctgggctcgcttatgtgtgtacggctattgtggctgacatctagcattcttctcactggagaacatggaccaatatactcgtctttccaatctgacagtgggtccctggaggccaggaccccctcctgggctggggacctcacagacgcatgctaagtacccctcctgctgttttcttttcttttttttccccagacagaatctcattctgtcttgtccaggctggagtgcaatggagcaatctcagctcactacaacctccacctcccaggttcaagtgattctcctccctcagcctcccaagtagctgggattacaggtgcccgccatcacgcctggctaatttttgtttttttagtagacacagggtttcaccacgttgaccaggctggtttcgaactcctgacctcaggtgatccccccgccctggcctcccgaagtgctgggattacaggcacgcacgaccacccctggctaatttttatatttctagtagagacggggtttcgccatgttggccaggcgagtctcaaactcccgacctcctaatccgcccgcctcggcctcccaaagtgctgggattacaggcgtgggccccacacccagctaattcttgtatttttagtagaaacagggtttcgccatgttggccaggcgggtcttgaactcccgaccttgtaatccgcccgcctcggcctcccaaagtgctgggattatgggcgcgtgccaccacgcctggctaatttttgtatttttagtaggaaaggggttttgccatgttggccaggctggtctcgaactcctgacctcgtgatcagcccacctcggcctcctgctctttcccgcacgtgctcctctccttcctcccaggggcaccaggcacaagtgtcccctgcccagaggactccaagacaaaggacgctcaccttatgccataaagcagcacctcagctgcttctccaggccattagccatgccacggccctctgtccgggctgggggattcgttgacaaaggcctgagacgtggggacatggcacagaggagggaacatggcctttcccacataccatacgcagagatgccttggccaaggtacttaacctcagtaccccagtgtcctcatctgtaagatggggaggagggactgtcattctccctggaggatcacgacaaggatcacacgaggagatggcatttgggaagcggcctccaggagcacaagtgctggacacacattggtgacgcatgctgccgtctgtctgtcactaaatgcttcccccaccccaccccgccgctgagactcctgccccactgccccatcaggcgacccagagtgggggcctcatcacagcagcaaatgcctgcgcttaggccgtagggccccttgctttctctggatgggctgctgggagggggcttagagagaagtgggggcctcagagactgccctcctcctcctgcctttcctacaggccccctgaatatccccgagggctgggccctatctcaaagccacctccgactatgtcctcagcgcctgctggcgggcagaaagactgcattccagaggctagtgccagctcccttccttagatgtgtggccggagtgaaggcagagacaagctgtggggacagaccgttccgtggctccgtggggcccgggttcgtgggaacagctccgtgtggactcgtcacccagcctggccatccacggtggctctgagggcagtcacggggcgagactttctaagccacagcccgcccctggggcatgcctcccccaccaaaggcaggctggtgagatggttctgcagcggagggccagggccgggccttggcatgctgagtgctgggggacttcaaaggcctgcaggggactctggctctgaactgtccgctcacaggcccaggtcagctggcagcaggaaggtttatgtttcttttaatatcaactcccaggcatttaacattcctcgaagcttaaacacagaaacattttccttaccagactctgccttctgctttgccaaacataacctggcttcctccctcccccactgcctccatctgctcctgtctccaagaggcttgcagtgactgatggtgtgtttcccccggggcttgtgcagctgagtgagaaggagggaagcaatggggctgaagtccaggtgggggaatgtgccctcgggccttgggagctgagttctcgaggggctggggcccaccgtgcccacggggctggctgcccggcacatccttgtaactcttctattccacagccaccagtggcccagggagtgtggcgtggcgaccactcgtctcttgcctgggcgtctcctggggctgcacaggccagcccagaacccttccgtgcctgtccctctagcccagcccagggacagggagatggggctccctccccttatccccacagagagcaggtcccagggactgaatctctagagcccatttcctaaatcacgaaggactggctggcagttgcctggcagccctgtctccctagtgacgagtactgagaagcagggtgcagaccccacagcatcggaaagagacgtgtttaggaacacggggcgtatgcggcagaggccaggcccctccacgtggggcccctggttcaaacactggagcctgagatggggcagcgagtgggagacccacacagctccccaggggcaatgctaccaaggacctgcaggtaagagccagataccaaactcggtggccatgacaatgcatcagagaacaaatgcttcctgctaaaaagcatcgttcagctccctgttgtagacggagccatcgcagcctgcgcctggatcacctcttgggccacggtcaagaagctcggcgcccagctgcgcctggatcacgtccggggccacggtcaagaagctcggcgcccagctgcgcctggatcacgtccggggccacggtcaagaagctcggcgcccagctgccgcctggatcacctccggggccacggtcaagaagctcggcgcccagctgcgcctggatcacgtccggggccacggtcaagaagctcggcgcccagctgcgcctggatcacgtccggggccacggtcaagaagctcggcgcccagctgtgcctggatcacgtctgcggccactgtcaagaagctcagcacgcccaacgcccgaggctcaacctcagtacgggtcagttaccgtctcccttcatttcatggtcacagaatctacccccaaaccagaccacttgcggcacagcacgaggccacacgaggtaccagacgggagtgtgagcggctccaccacgtcacgccttttcccgctcccaagcctacttctcttaataggttggtgaatagcagccatcttcaaaattggcagaatgtttcagagacacaggctgcacacacagaggccttttccctatatatgtttatagggagccaaaagcacagttgaggcataaatgctgtttttatttatttttatttttttggagacacggtctgactccatcacccaggcgcgatctcagctcactgcaacctctacctcctgggttcaagcgattctcctgcctcagcctactgagtagctgggattacaggcgcccgccaccacgacctgctaatttttgtatttttagtagagatggggtttcgccatgttggccaggctggtctcgaactcctgacctcgtgatccacccacctcggcctcccaaggtgctgggattacaggcgtgagccaccgcacccagaagcataaatacccttaacccgaggtgcagcctctactaacacccagagtccccacccgaagccacagactcccaacgcagctgagtaaggtccggccaccctaacaacaagtcagagacccccctccccccaagccaaccagcaggaccctaagtctttcgggcagaagagcaaacgcctggtccgtgtgcctaactccggtcccccgtcaatggcagacacggctcctcacacacagcattcctccctcccgttcaccgacgcagcctctgagtccttctcaacatggcgttccgggaaacaaccacccatagactaaagctggcgtgtgaaaacaaagctggttgtttccatcttgcagaagcgcagatgacccacctgaggagccacgcacacgcctgggcttccggggccacaacaggcagccacctctagcagggaggggagaaccacctcctgggaactttcctccaaccagcttggaaccaaaatcacgaaagagcaggctccttgaccagaattccttttcaactggaaccacctcctggaggctccctcagcctcgccccggcgccctggcctcacctggatctgtcctttgcccatgatcttgtccacgatctcattgttgtccttgttgaccttggtcttgtcatagcacttctcatagcacaggatcctcagggactgggagccctccagctcgatctcaaactcctggggaaagatgggacaaagggccctgaacctccgaagctgggaggcctggctttccggcaggtgcgtgcctcagctttgcaaggaggagggagtaagcacggcccacgaaggacacgtcagattttctggagctcccagaggcctcccatcacccctggagtctgggggcctgagctgacaccacagggtctgacacccagacacacaccgcgatcagaagccagaggagcagggagcagaaaggggggtgcagacatagctggtccaaccaatgggctggccgtccccagcagacaagccacgagcacggggtggtggggtccccacagagatgccagcccctgccactcacctcatcccacttgggctccgctgtgtcccggaacaccctggttttggctttgctgacaaaatagccgaaggaatccacctccagggtacagtacaggtctgtgggggaaggacagacggagatactgagtgagtggggccagggtggggcagctggggcggcactcaggatggagggggacatcgcatctgtcctttccaacgtccccacggatggcatcttggctctctcctccctgaagcccgggaccatctggcttctcccctgcccccttcttaggggctcagccctccccacctcggctcaccccacactctgcccttcctacctcagccctccccacactctgcccttcccacctcggccctccccacactctgcccttcccacctcggccctccccacactctggcctcctcctccctctaaagggcccttgactgttccgtctccacatcttcctcaccatggagacgacaccacaaactcttcactgaccgccctggagccacctctccccgtaacatgggtgcccaggcctcaacagcggcatttggggtgggaggcgtttagcagccctgcctctgggtcctgaatgctcggagcatcccctgccgcggtgacgaccaacaacgcccacatccccaagcccagggtgctgtggtttcctccgctgcacttaacataaaccaaagggatcttctctactcgtgcgtccctagtctctctccccccacgacgtaaacaccatgtggagagaagcctgggttttcctgcctgccggtgtacccgcagtaccaagaacagggctgggaacccagctggcacacggtgaacgaggctcccaccaccaccaagcgctccaggtaacaaggcagtggagggctggggcgggagggcagggccgggggctttccccggcatttccatcttccaccctggccttcaggctgaaaatctaccttgggacccaactgctgaggccacagcaccggcacggaccccaggccctctgcaaacccacacccgccctgggctcggaccccagcagtcctcccacctccagggagatgccgaggttgttcccagggtaccagaggtggtgtgggaggtgcctttgggacactatggccaaccctctgcagcgtgaaacaacgtcagaggtcacagtgcgggcatacagtgcaggtggcttactccacttagcccctgcagctgcccagctgggccattctccatcagaacagctttcctggccgggcaaggtggctcacgcctgtaaatcccagcactttgggaggccaaggtgggcagatcacctgaggtcaggagtttgagaccagcctgaccaacatggtgaaaccccatctctactaaaaatacaaaagtgagcccggcgtggtggcacatgcctgtagtcccagctactcgggaggctgaggcaggacaatcgcttgaacctggggtgtggaagttgcagtgagctgagatggcaccactgcactccagcctgggcgaccaagtgactctttctcaaaaaaaaaaaaaccaaaaaaaccagctttcctgcagaaaggacagtgcagctaccccaagaagcctccagctggagcaacagaaagaagacccaggtgggcctcagaacacacagaacggggctggggatttgcaggtgaacaacacagaggccctgagcaccccagcctgggccagaccagggagtgggcctgtgtgtttgagacgggccatgaagtgctgtcatcatggattgatctcggtgtgagcccctcctcgaggggctggggagggctcacagggtcagagggagggttccggaaggggctgggggagggctcacagggtcagagggagggttccggaaggggctgggggagggttcacagggtcagagggagggttccggaaggggctgggggagggctcacagggtcagagggagggttccggaaggggctgggggagggttcacagggtcagagggagggtgccggaaggggctgggggaggggtcacagggtcagagggagggttccggaaggggctgggggaggggtcacagggtcagagggagggttccggaaggggctgggggaggggtcacagggtcagagggagggttccggaaggggctgggggagggttcacagggtcagagggagggttccggaaggggctgggggacggctcacagggtcagagggagggttccggaaggggctgggggagggttcacagggtcagagggagggttccggaaggggctgggggagggttcacagggtcagagggagggttccggaaggggctgggggaggggtcacagggtcagagggagggttcaggaaggggctgggggagggctcacagggtcagagggagggttccggaaggggctgggggaggggtcacagggtcagagcgagggttccggaaggggctgggggagggctcacagggtcagagggagggttccggaaggggctgggggagggttcacagggtcagagggagggttccggaaggggctgggggaggggtcacagggtcagagggagggttccggaaggggctgggggaggggtcacagggtcagagggagggttccggaaggggctgggggaggggtcacagggtcagagggagggttccggaaggggctgggggagggctcacagggtcagagggagggttccggaaggggctgggggagggttcacagggtcagagggagggttccggaaggggctgggggagggttcacagggtcagagggagggttcgagaaggggctgggggagggctcacagggtcagagggagggttccggaacgggctgggggagggttcacagggtcagagggagggttccggaaggagctggggacggctcacagggtcagagcgagggttccggagtcagaccatctgggtccacaccccagctctgcacagatcacctcccttctctccccaggttcctgtctgcacagcaggaaaagtcatggtgcctacaccctgggcctgcctgtccagaggtcctgagtttaccacggctgaagacacagggcctcacctctgagtgagaacagacatatgagtgggtcaggggtggcggcggcgaagggagtgaggataatctgggggtaaagagagattttggagcagctcagccggctctgacacccgcccaggctgggaggccacgggtcggctccctgaggcgaggacctcccggccaacgggaagcaggagagggaggggcggcatctggggacatggagtggtggcgcctggtccagacatgggtgggacagtgcttcagagctcactagccagaagctcctcagcggcagcccccaagaagggaggtctgtgggtctggagagagttcaggaagcttccacggtaacaagcagcctgagggaccgtgtggtgttcccggccagacatcgagaagtgcccaaaaggttagagctccggctctggtgccggaagacgtggattctgctgcaccacctgctactgtgtgactccaggaaggaaccttgagcccctccgagcctcggcgtcctcgtgtgtaaaacagggatggtttccgtgacctcggcgggatgccggaggctcagagcggaccgtgagactgagaggctctgaacacgccacaggctttgcacatgtgagtacgtccacacgccagccatgttctcaccttctccaggtgcacggtaggtgctgtgtaaattaacgacttcattccacatttctgagctcccatgcatcccagggtaaaggagacctggttcccgccctcagagaactcacagtgggagacgcaaattgttaagtgacaaaacagcatgacaggtgccataaccagcttgccctgagcaggatgggggcacaaggaacctcaggggatgggggcacaaggaacctcaaagggatggggatacaaggaacctcaggggatgggggcacaaagaacctgaggggacgggggcacaaagaacctgaggggatgggggcacaaggaacctgaggggatgggggcacaaggaacctcaggggatgtgggcacaaggaacctcaggggatgggggcacaaggaacctgaggggatgggggcacaaggaacctcaggggatgggggcacaaggaacctgaggggatgggggcacaaggaacctgaggggatgtgggcacaaagaagggacaaagaagggaggccagtttgcccccaggaactcagggaggcttcctgggaaaggctgctctaacggcccggggagtcacctctgtgtggggcgctgcagggaggggtgagggcagaccccacctgccagtgaagagcagggagtgggaggggcaggtggagagggagagagtcagggtttctgatcctctgtgatgttaagtcttttctcctctctgtgactcggttacctcctctggcaaatgggtagaaactattagctgtctaactgactcacagattcccgtgtggataacaggtagataaaaagcgcaaccaggccgggcgcagcagctcacgcctgtaatctcagcactttgggaggctgaggtgggaggatggcttgagcccaggagttcaagaccagcctggccaacatggggagaacctgtctctaaaaaaaaattttttaaaaattaaaaagtgcaatcctactttgtgagacactaaaaacagatttagtatgaggaacccacaagggggaaggggagaaaaagcgatgagcgtggcagcacaccagcgttgcacacacacgatcatatcccagcctgctctcgggtcaaaattcacaagcgtgactgccttttagtggaggcccagagaggttaagaaacttgcccaaggtcacacagcttgtcatgggcagatatgaagttggagtccacgtgtttgtcgccctcagatatgaagttggagtccacgtgtttgtcgcactcggtttcttttttttttttttgagacggattctcgctctgtcgcccagggtggagtgcaatgccatgatctcagctcacagcaacctccgcctcccgggttcaagggattctctggcctcagcctcccaagtagctgggactacaggcgtccaccgccatgcccacgctaattttagtatttttagtagagacggggtttcaccatgttggcccggatggtctcgaactcctgacctcgtgatccgcccgcctgggcctcccaaagtgctgggattacaggggtgagccaccgcgcccggcccctaggtttcagacagcttcagggagggcttgagaaagaggactttggagacaaaggccaggggtgacctccctgccaagaggagctggtttctggcctccaggggaatgccccatgtctaaaggcgtgctggcagggccccatcctgggcagagcagtgcagaatccacaatggcccacccaacctcgtcctggccagggcacttactggctgattgcttaaatcccttggcagagtggacgatgacatgaaggaagccatagagtcctggagactcatcgtctgcaagagagaaaagcccccagggcagagggtggtcagcggatcccctcagcctccaccccaggccggcgggaggcagacggggtatgagactcagctgagtcttggtccaacatcaccacctggtggccagatgaaaaagtttccgaaggccacggcggccttatatgtgagctgcccggggtagggctagggggtccttctctcctccactcagcctgggggggtccagcacacccaccatcctggcccagggacttagtaccattccccatgggtactgtctctccctccaaatcctgcctatcctggcactgaaaactgaccaatatgataaatcattctgctaatgatttatgtcgaggaaagcttgccttcaggaccccgttcacaaagtggaccctttcccagcacacaggcagctagaatacacccactccggtcagttcccagccctgatcacagctccccactgctcaaaacccccccagactcccgggcttacagcatgaattccaaactcccttgcttgggattcaaggcctttcaagagctggtccctggaaacttccagcctcatttcccatacaccattttatctaccgggtctgctctctcatgaatatattaacagcacaatctcagtgcaccagggtgccagttctcccaagccagacagaggggcccaaggaaaagctggggtcatctgggaactcagtagacagtcacccctacccaagctgtgtcctggccactcaacagtctcagcacagccgagcagggatcagccatttacagccacatgtctgtctgagtccttacgggaagccggccacgctctgagggctgggacctgccggttgggccacctctggttcccgagcttaccgtctttattgctggtgacaggaatgttgtgtacagtcctaagcttgaaacaggatcctgtgagcacctggagctccactgagctcaggacaaaggcctggagatctggagggagagccgagagagaagggagcgtgggcactggtccaccaggaccggctgctcttccctgggggctgctgcaggaagacggcttaatccctggggcagacttggtccttgcgagggagggggaaggatttgtggacacagcaggactggtgtagatgctgcgagaggggtcagagtaggagaatctaactgaagaggtttgtgtgtgtgtgtgtgtgtgtgtgtgtgtgtgtgtgtgtgtgtgtgtgtgtgtgtgtggtgtatgcgttttgttttcgttttttttttaaacggagtctcactctgtcgcccaggctggagtgcagtgctgtgatctcagctcactgcaacctccgcctctcaggttcaagggattctcctgcttcagcctcctgagtagctgggattacaggtgcccaccaccacacctggctaatttttgtgtttttagtagagacggggtttcaccacgttgcccaggctgatctcaaactcctgactgggattacaggcgtaagccaccgtacccagcctctgtgtatgtgtgtatgtgtgtgtgtgtgtgtgtgtgtgtgtctctgtgtgtgtgtgtgtgagagagagagagaggtagagagagagagaaagcccaggctgggctctgggtccagtcccaggactaaatcatcatgtctttcagccaatcagttagattctttgggtctcaattaatccgtaacatccttaaacgctcaccctggcacctctgagggtgactgcgagggccaaagacgtgatactggacatgaaacgcttagaaatacaaaaggcccatcaatgccacggacatcattggggagcgtggaagaggcaggaatttacccttcttctgtagtttctgaattgcttctctccactctgacctctcgtagtccgaggacagtaggaacaggtaactctgaagagaggagataagcataaagtgggtgaccacagtcaggcaaagcgtactcccagatcctggggaccccaacaaagctccttttatcttttttttttttttttttttgagacagagtctcgctcttgttgcccaggctctagtgcaatggcaaaatctcggctcactgcaacctccacctcccgggttcacgccaatctcctgcctcagcctcctgagtagctgggattacaggtgcccaccaccacgcccggctaatttttgtgtttttagtagagacagagttttgccatgttggccaggctggtctcaaactcttgacctcaggtgattcgcctgcctcagcctcccaaagtgctgggatgacaggcatgagccactgtgcccggcccaaagctcctccttatccaggcacagctgaccttgcaggaggaggcagctgggggtgggtgggtgaagggggagctccttcctgggaagccaaggtgacaggagcggctgtgccagggacggccagcagagggcactcattccacacgagaggggagagcgagtcaacagctggagccatggcagcctcctcaggaagagggggcctgagtttccggttcgtacaggtcagggccaggagccacagagtgggctgctctggactaaggaaggggctgtcttggtcccacccccacccatcctgacctttccattccgattgtggatcctgaacgggattgtgggggagttgagcagcagcaggaactcattctcaaacatcttcttcttcaggcgctcgatggcccggctctggcctttgttggctttctgcaggagatggggacacagagggttcccctcacactcgggcctttctcacgagcagcactaagcacgacactccactgtgtgttaacatgctctttacattttccgtatttcgtgatgttttgacatcttgtggcaggagaggcgggtagctgggtgagaaactgctcccccacagggctcactaattcctaagcctgtcagtgatgccctatgagcacagctttcatacacacacccactgatccagagcccatgtccccaaccaccttctctacctgacgctcactcgccaagccagcatctcctctgccccacgtcacccagggccagggaccaggtcaccagagaccactcctctagcccagggctgccgacataacggaagccagctggtgccaagccctttccctgccctgtttctccacagaaaagctgtggccacactttctttccattcctgcctcctgttcaaagctggcacctctccacgtggccctgggcggggtgctatgcctccttctcttgagaaccctaaataatacaaatattacagtagtattaacctctctgtactgtcactctgctgcctctacacattaaatcctgggtacaacagagacacctgcttaaagaaacctcagacacctttcagcctgaagccccacctgctagcctggcaccaaggcccccatggcagggttccagcctccctgcccggcagacaacccaccaggtcccgtcggctcagcctccccctctcaccagacattcatcctctgcgggcagagcctgctccctcaatgttccaagtttctgtctgtttcgtaaaggaccccctcccttttattaaccaccattatgcttcaagtctcagctcccaaggccatcctcaagctcctcagttagaattcacctctatggtgttttgttctttttaacccactggactggcaaaattgtaaagaatgttcacagccagtgttgtgacactgtgggggacagtcaccctcacacaccgcagggggaatgccaccagtcacagctttttcagaggtaaaagcctgtcaattaagcgcacactcaccctgccctgcccatcccacctggagggaacctactgcagaggcacctgcgcagtgatgtttactgttgacttgcctgctaagagcgaagaatcagagacaatccaaacacccaaaaacatttgtatgcagccaagcgacagagcaggaggcagttgttaaaaagaatctgatactgccaggcgcggtggctcacgcctgtaatcccagcactttgggaggccgaggtgggcggatcgtttgaggtcaggagttcgagaccaccctggccaacgtggtgaaactccgtctctactaaaaatgcaaaaactaccgggcgtggtggcgggcgcctgtaatcccagctactcgggaggctgaggcacgagaatcgcttgaacccgggaggtggaagttccagtgagcccaaatctcaccagtgcactccagcctgggtgacagagcgagactctacctcaaaaagaaagaaaaagaatctgatacatccaaagggctcaaagacccactgtggagtaaaatgctgaagttgcaaaacagcacgtgtagtctagtctcattggacacgcgggcgcacaccagcataagcaaagaagagttcagaagaatacacctcaaactgtcagcagtgggaggtgagtggcgaccagctttaccctgtacatgctggtactacgagcatttctcattaaaaccagccagtattatattggggattagaaaaaacatgaaaatttaaaaaattattatcaagagaacaaggctgagcacggtggctcacacctgtcatcccagcactttgggaggccggggcgggtggatcatgaggtcaggagtttgagaccagcctggctaacacggtgaaaccccgtctctactaaaaatacaaaaaattagccaggcgtggtggcggacgcctttattcccagctactcaggaggctgaggtagaagaattgcttgaacccgggaggtggaggttgcagtgagccgagattgtgccactgcactccagcctgggcgacagtgacaaagtgagactccatctcaaaaaaaaacaaaaaacaaaaaacaaatcactgcttcttctgtgactcagaggacggcacctgtgcctctccagtgactcacatgtaccacactctgtggtcagcaaggggcgtgtctgcttcctccactggacagggatatacatgaggcacccggcacaccccaggcagcacagccagtggggctcactgagtgttgactgttgactcgactgggcacaaggccacgtctgcacagctggggcaacggggaggcagcaagcctcccaggggcgggtgggaaacaggcacgcaggatgctcctgggcgggcactgtgggcagggcccagccgttcaggagggggacagctgtgctggcgaggaagccctctgggcagatgtaccaccagttggaccctctgtcctaggacatcccccagccctgaacactcctggggctgtaatggtgatcttgctttcccctgttcaaagggagatgcttgagttgaaaggatcctcagagaggccatctggttatgttttcttcaataattgtttgtttactaagtgcctttttttttttgagatggagtcccactcactctgttgcccaggctggagtgcagtggcgtgatctcggctcactgcaacctccacctcccgggttcacacaattcttttgcctcagcctcccatgtggctgggattacaggcacccaccaccacacccggctaacttttgtatttttcatagagacggggcttcatgatgttggccaggctggtcttgaactcctggcctcaagtgacccacccgtctcagcctcccaaagtactgggattaccggtgtaaaccaccatgctgggccctaaccacctgttttctacgtgtcgaatatgaggaacatggaacagaagaaaatagcgctgtccctggagttcaaattccagtggggaagagaggagtctgacaatgcaattacaattcagtaccatttaagcaaagccacaggtgaacaaaaagccacaggatctggggacagggcacccaaccaagactgtggtgggcgtgggtgtcagagaagcttcccaggggtggtgaggcctaagctgaacctgagaggtgaggaaaacagaccaagctgaccaaaccgctccaggcccttcctccactcacagggatgctcctcccgtggtgccttcctctagacactgttgttacgtgaactgagggctatgcatgttcctctagacgctgctgttatgtgaactgagggctatgcatgttcctctagacactgttgttatgtgaactgagggctatgcatgttcctccagacactgttgttatgtgaactgagggctatgcatgttcctctagacgctgctgttatgtgaactgagggctatgcatgttcctctagacactgttgttacgtgaactgagggctatgcatgttcctctagcactgctgttacgtgaactgagggctatgcatgttcctccagacactgttgttatgtgaactgagggatatgcatgttcctctagacactgttgttatgtgaactgagggctatgcatgttcctctagacactgttatgtgaactgagggttatgcatgttcctctagacactgttgttatgtgaactgagggctatgcatgttcctctagacactgttgttatgtgaactgagggctatacatgttcctctagacactgctattatgtgaactgagggctatgcatgttcctctagacactgttgttacgtgaactgagggctatgcatgttcctctagacgctgttgttatgtgaactgagggctatgcatgttcctctagacactgttgttatgtgaactgagggctatgcatgttcctctagacactgttatgtgaactgagggctatgcatgttcctctagatgctgttgttacgtgaactgagggctatgcatgttcctctagatgctgctgttatgtgaactgagggctatgcatgttcctctagacactgttgttatgtgaactgagggctatgcatgttcctctagacgctgttgttatgtgaactgagggctatgcatgttcctctagacactgctgttatgtgaactgagggctatgcatgttcctctagacactgttgttatgtgaactgagggctatgcatgttcctctagcactgctgttacgtgaactgagggctatgcatgttcctctagacactgttgttacgtgaactgagggctatacatgttcctctagacactgctgttacgtgaactgagggctatgcatgttcctctagacactgctgttacgtgaactgagggctatgcatgttcctctagacactgttgttacgtgaactgagggctatacatgttcctctagacactgctgttacgtgaactgagggctatgcatgttcctctagacactgttgttacgtgaactgagggctatgcatgttcctctagacgctgttgttatgtgaactgagggctatgcatgttcctctagacactgttgttatgtgaactgagggctatgcatgttcctctagacactgttatgtgaactgagggctatgcatgttgctctagacactgttgttacgtgaactgagggctatgcatgttcctctagacgctgctgttatgtgaactgagggctatgcatgttcctctagacactgttgttatgtgaactgagggctatgcatgttcctccagacactgttgttatgtgaactgagggctatgcatgttcctctagacactgctgttatgtgaactgagggctatgcatgttcctctagacactgttgttacgtgaactgagggctatgcatgttcctctagcactgctgttacgtgaactgagggctatgcatgttcctccagacactgttgttatgtgaactgagggctatgcatgttcctctagacactgttgttatgtgaactgagggctatgcatgttcctctagacactgttatgtgaactgagggttatgcatgttcctctagacactgttgttatgtgaactgagggctatgcatgttcctctagacactgttgttacgtgaactgagggctatacatgttcctctagacactgttgttatgtgaactgagggctatgcatgttcctctagacactgttatgtgaactgagggctatgcatgttcctctagacactgttgttacgtgaactgagggctatgcatgttcctctagacgctgctgttatgtaaactgagggctatgcatgttcctccagacactgttgttatgtgaactgagggctatgcatgttcctccagacgctgttgttatgtgaactgagggctatgcatgttcctctagacactgctgttatgtgaactgagggctatgcatgttcctctagacactgttgttatgtgaactgagggctatgcatgttcctctagcactgctgttacgtgaactgagggctatgcatgttcctctagacactgttgttatgtgaactgagggctatgcatgttcctctagacactgttgttatgtgaactgagggctatgcatgttcctctagacactgctgttatgtgaactgagggctatgtatgttcctctagacactgttgttatgtgaactgagggctatgcatgttcctctagacactgttgttacgtgaactgagggctatacatgttcctctagacactgctgttacgtgaactgagggctatgcatgttcctctagacactgttgttatgtgaactgagggctatgcatgttcctctagacactgttgttatgtgaactgagggctatgcatgttcctctagacactgttgttacatgaactgagggctatgcatgttcctctagacactgttgttatgtgaactgagggctatgcatgttcctctagacactgctgttatgtgaactgagggctatgcatgttcctctagacactgctgttacgtgaactgagggctatgcatgttcctctagacactgctgttacgtgaactgagggctatgcatgttcctctagacactgttgttacgtgaactgagggctatgcatgttcctctagacgctgctgttacgtgaactgagggctatgcatgttcctctagacgctgctgttacgtgaactgagggctatgcatgttcctctagacgctgttgttatgtgaactgagggctatgcatgttcctctagacactgctgttacgtgaactgagggctatgcatgttcctctagacactgctgttacgtgaactgagggctatgcatgttcctctagacactgttgttacgtgaactgagggctatgcatgttcctctagatgctgctgttacgtgaactgagggctatgcatgttcctctagacgctgctgttacgtgaactgagggctatgcatgttcctctagacgctgttgttatgtgaactgagggctatgcatgttcctctagacgctgttgttatgtgaactgagggctatgcatgttcctctagacgctgttgttatgtgaactgagggctatgcatgttcctctagacactgttgttatgtgaactgagggctattcatgttcctctaaacagcactttggctgcatccatgggtactggtatgtagtacactcatttccagacagcactaaacagtttgcagttctcattttgaattttgatttcctctttaccttgtcagtttgaactttccaaaccaatgctttttttttttttttttttttttgagacagtctcactctgttgctcaggctggagtgcagcagcggaatctcagctcaatgcaacctctgcctcccaggttcaagcaattctcctgtctcagcctcctgagtagctgggattacaggcggaagccaccacgccaggctaattttgtattttcagtagaaatggggtttcaccatgttggccaggctggtctcaaactcctgacctcaggtgacctgcctgcctgggcctcctaaagtgctgggattacaggcatgatccaccacgcctggataattttgtatttttagtagagatggatttttaccatgttggccaggctgatcttgaattcctgacctcaggcgatccaccatcctcagcctcccaaagttctgggattaaaggtgtgagccactgcacccaggctgaccaatattcttgttcacttctaattttactccactgtggtctgtgaacatgacttgtatgctatcaacttgcagaaaaattttgagatttccttagtggcctattataggataaatgtgaaggtcccaaacgtgtgtgacaagaatctcagttttctgtcagggcacaagcttctctgcatttttaagtcaagcatgttaattgtggcattcaggtcctctctctccttatttatttgcctacttgatctgtcagtttctgagaggcctcccaggtccttttccttgcacaggtcctgcttttccttacaaaagcctgctttttcttctcttgcttccctctacctccactttttttttttgtttttgacagaatctcactctattgcctagactggagtgcattggcatgttcttggctcactgcaacctccacctcccgggttcaagccattctactgcctcagcctcccgagtagctgggattacaggtgcccaccaccacactctgctaatttttgtacttttagtagagacagggttttgccatgttggccaggctggtctcgaactcctggcctcaggtgatccacctgcctcggccttccaaagtgctgggattacaggtgtgagccactgcgcctggctacttgcttcccctttctatcgtgttcaacatgcactgctttccagggcacttcccatgttagccctatgaaatcctgagcactgaccccctcgatctgcttggagctactgtagtcggggtctttcccttagtaactacacactcaaggctccctctcaaagtctcaaaccttacaacttcctgcctccacctcccccaacacagctggctcaaagggccccaggctcagataccaagctctgctcacctccttctggatttcactcttgagggcagagatcttcatcttcatgtcctccagctcatggtctgggaaggggtgcacctgggggctggcctcagactcctcgggggatggaaacaccaggtcggccagggggatgtaccacttacagtcatactgctggtgcttcctgcaaacgagccagagggagccatgagccagagggagcctggctcttccagcctcaactcttgggtccagaaccacagaaccactgacaggggttgactgagaactcgccagaagcaagaacgatccctgctcctgaggagcctgattgggaaacacacactggagtgatgaaagctgggttctggggtccgccccgcccgcagggagcaactccgccccttcaccttaccaggcttctggcccagatgactcatgttgtcaaacatcccaaaccacttaggtatcaagaagagcgaagccttcctggctgggctcacattttcctattccccaccacaatcccctccctcccttctagactatccgtgttcaatatccttcaggctagcaatggaatacaggtgttattccaaatgccacctcttatcaagagtggtcacatgggtcaacactgggtggaggattacaaagccacatccaagtctagcaagaaagtgtgccctagttgattagtgatgtctgccatggcaaaggacagcaggcagaggcatatgtgattagtaatgtctgccatcgcaaaggacgacaggcagaagcatgtgtgcttattattgccatctctgcctcagaactatctcaaacatgatctagttccagggagtcatgtcctttattattattattttttaaattatttttattttgtgagatggagttttgctcttgttcccaggctggagtgcaatggcgcgatctccactcactccaacctctgcctccagggttcaagcgattctcccacctcattctcccaagtagctgggattataggtgcctgccatcacacccagctaatttttgtactttcagtagagacggagttttgccatgttggccaggctggtctcaaactcctgacctcaggtgatccacccgccttggcctcccaaagtgctgggattacaggcataagccaccgtgcccgcccagtcatccctttattgacgttcataatcatcgatccttcccctaggacttagatttgcacttctcattctgacccttgagtgttgaggtgggcgtggggcttgctccccctgagctatacttgggggcacagccagccagggagggctgaagggagaggtaggatagcctggtggtgtaacacactggctgtggagtcccctgtgctgtacttgggggcacagccaaccagggagggctgaagggagaggcaagatagcctgatggtaaacgagtcccacagacacgggtttgaatccagactgccgcttctcagccgtgagaaggggtgtgcttggcacactgcagttgatcactaagtgtgggtggaagaatgtgtgaatgaacgcagaatgagcctctgctcaaggcacagagcagacccacactcccgggtagagagaaggaggctcaaaggagcttgcacatcagcttggggttccagtcccaccctcccgggtagagagaaggaggctcaaaggagtttgcacgtcagcttggggttccagtcccacctgtgcctctagctgtgcgagcttgggctgcttatttaccttctccaagactcctctctcatctatgattagggaacaacagtcgctactttgtggaggtgttgggaggactagaaatcatgtattcaaagcatgtgtcacggcacctggcatggcataaaccctcaataaatagtagcaggagacgtggtgaatattcacagcactgcagttagcagaaattcagagatgtctaataaaaggagaatgcttaagtagacgatggcacatctacgggtaacatcgtgcaggaaagtaaaaggatgattatgaagatgaggcagcaacagggaaaatgcttatgacacgaaacagaaacagcagagccccaaattgggcattcacagtgattacgactgtgtgaagaaacatgagaacatttaaaaacagggaaggaagcagcgcggcaggagtcggacctcatgcttcagtgggggacggggtttcctccaatggccttatattatctttataattaaaaacatgacttactttcaggaaaaaaggctatgtagtgaaattaagttaattaatatagtttttaaaaggaaaaaaccggccaggcgcggtggctcatgcctgtaatcccagcactttgggaggccgaggcgggcagatcacctgaggttgggagtttgagatcagcctggccaacatggcaaaaccccgtctctactaaaaatacaaaaattagccagacatggtggcatggtggcgtgcacctgtaatcccagctactcaggaggctgaggcaggaaaatcgcttgaacccgggaggcagaggttgcagtgagccgagatcgcaccactgcactccagcctgggcaacagagcaagaccctgtctcaaaagaaaaaaaaccaacaaagttgctgaaggctccatgggtggcagggtccggcctccctcccccgccctgtgccactggactcacacactcaccccgcagaggtcaggaccccctcccccgcccctggactcacacactcacctcgcagaggtccggaccccctcccccgcccctggactcgcacactcaccccgcagaggtcaggaccccctcccccgccccggactcgcacactcaccccgcagaggtccggaccccctcccccgccccgtgcccctggactcacacactcaccctgcagaggtcttcttcagcttggcacacagtaggacatctgtaaagaggaagacgtgccgcagcttccgggagctctctgacacttccaccaggaagccgtccttcaccagctgtcgcgtctgagggagatggcagaccccccagcctgctcagaggggaatgcggccgagggcagagcctgcacacgggggcacggccagccagggaggactggaccgagaggcggcatagcctgtcatcccttaaccaaaggtggttcaagcactgcctttggagtcacatgggcatgggtttgaatgccaacaggcttctcagctgtgatctcagacaggctccctgacctctctgaatcccagattcaccttctgttaagtgcggacagtgaggtctgcctcataaggtgactcatcgagatggtgcatgtgaaacagcacagtgcctggcacattaagtgtgtgcaacgcacggggctctccgcggctaaccctggagccccctgcccgggacgacctggtttctccaccctggggcacgaacatccccgtttgcaatccctcccgaccgcggcggcgaacttcatctagccccggctcaaccgagacccgagacccgagacccactcaggcctgtctgtgctactcctccctggcttctccagccccctggggatgagacctgggccctccagcctgggactgcagcagtgcccagaggggacctgcagccaactctaacctgggctctgggtggtttctgctccacgtgggagttccagagtttccaacccccgctcagagccggggggtcgtccccatctgtgccagcctttcctgtatgatacacggtgtgacctacatctgctgtaatacgtaggtgagcgtattcaaagtatacaattaagatgaccgaggccgggcgcagtggttcacacctgtcatcccagcaatttgggaggctgaggcgggtggatcacctgaggtcaggagtttgagaccagcctggccaacgtggcgaaaccccgtctctactaaaaatacaaaaactagccagacatggtgacgcctgcctgtaatctcagctacttgggaggatgaggcaggagaattgcttgaacccagagggtggaggctgcagtggagctgaggtcacgccattgcactccagcctggacgatggaatgagattcagtctcaaaaaaaggatgactgaaaacggagggtacgctaagccctctggagatttttcagatatccccagagtaaaacagacgacgggatccccagacgctgcacatcagcaccaggagccgcacggaatcggctctctctgcccagtggacactgtccaggcctgtccctcaccactttctccccaggagaccctgggggctcgtaaacagaccacaggagcagacaccctgtcagcctcactcgtaacggccgcctaatggcctcccctggacaggaagcctttcacccgggcccggctgccaatccacgaaggcaactgtccctctcatgcttcctggtactccccttgctgggctgtccccacccttgcatcaagaagggcccccagggaacggctgtcccacatgcaggtgcccactggacattccggcaacctggacggcctccaccacctccaacgccagcctttcctgctgtgggctccccgcaagccactgcgtgtgcaggccgagctgaagcagctccaagctcctgctcccttcgcttcctaggagaccctgacggcatcacactggccagaggcaggtgtctgcattcaagaatgaggcacccggaggccacttccccggcgtgggcctccagacagtcccaggtgaggaatccagctctgacaccagtggctgaaagactgcgtggtggacctggagagactccccagcctcaggttcttctggctcactggattgttattattatttctgagatggagtctcactctgtcacccaggctggagtgcagtggtgcgatctcggctcactgtaacctccgcctcctgggttcaagcaattctcctgcctcagcctcctgagtagctggcactacaggcatccgccaccacgcccagctaatttttgtatttttagtaaagacggggcttcaccatgttggccaggctggtctcaaacttctaactcaagtgatccacctgcctcagcctcccaaagtgctgggattacaggtgtgagccaccgtgcccggcctccctagattattatgaggattaatgagacactggacttaaacttctcagcctagggcctggaaagctgcaggtcatcagggtgaccaagggctgaaaacctctccttggctgggaatgggggatcaggattggagaggcaggaggcacccggtgccgcccgtgtgtgagagaaggggacgagggacctgccgcccgtgtgtgagagaaggggacgagggacctgccgcccgtgtgtgagagaaggggacgagggacctgccgcccgtgtgtgagagaaggggacgagggacctgccgcccgtgtgtgagagaaggggacgagggacctgccgcccgtgtgtgagagaaggggacgagggacctgatacttctcagcctgggtgaggggccgtgccgggctctgagctcacctcccccttgggcgttgtcactgcagtccggcgggggtcgatgtcctcgttgatgctggacaggaagttctgggagatgcggagggcatcctgcagcagcgggtagtcggggtggtccacaggtgtgtgcttcagcaggtcctgggaagggtgaggcggtgagttgaggggagcggctctggggcctgatgtgtggccaccggggagtgctcagtccccatccaaagggtgggcactcagggacctgcctaattcccgcaaaatctgaactacaaatcagagtcaggccgggcacggcggctcatgcctgaaatcccagcactttgggaggccgaggcgggggatctcttgaggtcagaagttcgagaccagcctgggcaacgtggtgaaaccccatctctagtaaaaatataaaaattagctgggcgtggtggcgggcgcctgtagtcccagctactcgggaggctgaggcaggagaattgcttgaacccaggaggcagaggttgcagtgagccgagatcgcaccactgcactccagcctgggtgacagagtgagactccgcctcaaaaaaaaaaaaaaaaaaaaaaaatcagagccagcacagcaggggagagggccctggctgccccctcttctcctggccacagtcatactctctccccagtgtggagaccaggtggaggctcatccccccgagcagctgggagagaaaccctgtgtctgccctgcagctgctccaaggacactggagaccaggaggcagcgggtggggaagcaggaatgcctgcctccccgggagcacctggccacgtcaagcttagtagccaagctgtattcaggccctagcctggcggcatggataccgcgggccagacaggcatccttggagcctaggaacccctgattccccaggtggactgttctcggtgactccagcaccctctcacccaggctcagtcttccactgaactcctaagccctctctggccattcggaggcttgacactcacgtgtaggactagggtgctccgagtgacccggtcaatgggcttgtagagcagagctgtcgggggagacagggagaaggaggaagaggatgatggacgagggcaacccaacaccccagagaccagcttcgtccccccacccgcatgcttcccacgtgaacacccctcgagggacaccagagtgagcccacggcagcccccacctctgttctcactccccgggccgaccaaacagcagacacaggtgacacacagccctggcagcccctgctccctccgcagccctgcctcctctcccatcagacatggcttcatcgagagccgccccgcccccctccccaggcctgtcctggcctcacctggctcaaggcagatgctctcctggacccccagccctgaatcacacagctccacccagccacgccccgaagagtccagcacacctgccacacgcaggaccccagaatcacacagctccacccagccacgccccgaagagtccagcacacctgccacacgcaggaccccagaatcacacagctccacccagccacgccccgcagagtctagcacacctgccacacgcaggaccccagaatcacacagctccacccagccacgccccgtagagtccagcacacctgccacacgcagaaccccagaatcacacagctccacccagccatgccctgcagagtctagcacacctgccacatgcaggaccccagaatcacacagctccacccagccacgccccgcagagtccagcatacctgccacacgcagaaccccagaatcacacagctccacccagccatgccctgcagagtctagcacacctgccacatgcaggaccccagaatgggggaaggagacatgctgtgtttccaggaagggcagctctccagaccttatcattctcaggctcctggagctgaaggccaggcacagccagctgggattggcatgcctcactgtgatccacaggactggcctcatctctcagaggaaagacccctccccacatcctcaaaccccagatagcaaagcacaggaaggctggaggcagggaggctggaggccaggaggctggcctgatctccacagaaaggctctgctccccgaggccagcctggccaaccagtgaaaccccatctctattaaaaatacaaaaattagccaggcgtggtggcacatgcctgtaatcccagctatttgggaggctgaggcagggaaatcacttgaacccgggaggcggaagttgtagcgagccaagatcatgccactgcactccagcctgggtaacaagagcaaaactccatctcaaaaaaaaagaaaaaaggctgtgctctcaaacacgtggcagcctgaggggcaaaggtttcctgaagcaactcaggttaggcctcacatatgagagccccaaagaggctgggaggacgcaggcaaggccagcccaggcccccaagagccacaccctccacaacccggacaccaagtgaggatggctgggattcagcagggacaggtggaggtggcagctggtggatcaacacttcccaacacccttcctgtacgcggctgcgcccaccctcccaacaggaggctcagcttcagtcctgcacctggatgctctgtccctggggtcatgaccttgggcctcctgccgcaggggcagtgacagaggcaggttggtcatctgggaagaaggatcccagactgggtgtcccataagaccaggttgtgacaggtcccagcgtgaacacgcacgccctagccgggccccaaacctgatagttctccaaagcctgagatataaataccccgtgcgcggctaagcagacacttcagggagcaatctgctggctgtgaagaaaatgcagcctcagcagggccaccagccttacccgcagtccgagcttggctgcctgtcggaatcactgggggagcggttaaaagatacagatgctgctccccagccccgtcaactcaacccaaatctctgcaagaccacaagggccatcagcatttctataaagcttctttactgatttgaatgtataataatggttgaaaaccactgctttatgttttatttatgtatttattttaatttttttaaaaatatagagacgaggggccgggcagggtggctcacgcctgtaatcccagcactttgggaggccgaagcgggtggatcatttgaggtcaggagttcaagaacagcctggccaacatggtgaaaccccatctctactaaaaatacaaaaattagccaggtgtggtggcaggcgcctataatcccaactacttgggaggctgaggcaggggaatctcttgaatccaggaggcagaggttgcagtgagctgagattgcgccattgcactccagcctgggcgacacagtgagtcttcgtttaaataaaaataaatatagagacaaggtctcactatgttgctggtctcgaactcctggcctcaagccaaatacaagctggtctcgaactcctggcctcaagcaatcctcctgcctcagtctgccaaaagttgggattacaggcatgagtacccggccaaccactggtttacgtaaatacacttcatatgacatatctgtagccctttcttatctagcagtttccagagaccctccccatgggccatggaagcttgaaggaatgaggccagtcttggggtatcctcggcactgagggtgcagcccaggtcctagctcaggtgggatccatttctgaggctgtttaaggcacccacctgtggctcagcccatcttcagggggaaaaaatcacactggagaaccccagagacccaaaagaaagcacaagctcagcagacacctgccagggtgggctccggagtggcggctccacagaaagctgacactgcattatcggctccccgcagccctctcttgggtcccaagaggaagaggtttctgactaagctcagaggtctgaacacatggcaggttgggtttcagaggggttattaacatgtctgtggtcacctccagagtccacctgagtaaggctgtggaatgagccctggaagggcggccaggagggcaggtgcacggggggggtgggggtggggggggtggcggcactgggaccacatcagatacggagggaaccgggggaataagagcggccctgaagtttgtgctccccacggcccctgcacgctggggtcccctgagaactcagggtgaggcactcgctctggcccttcccctgtccctgggctcctgcaggctggcctgcttcctgcccggcctcacccactctccctctccactgacactgacttgggcagcaagctggtctctctctagtttgctgggtactcgctctgtgcccaagggtactgagttaactgctttgctctcattatttcctgtgattaaaacgggaagcaattctcactagccccattttacagacaaggcaactgaggccagagacttgtggctacaagtggtgggagctgggtagatccacccgcactccttgctttgagctgcaccttcttcagggaaaggcagcacctgtaaaacctcaatgaaccacaggagcgttcttggaaagagtgaccaggatggggtgagccccctcctcacgagctggccctttcactcctcattccccactttgaagccgacttcaacaacagtatcacggagaccgaagcaacgtgaactccaggtcccaggtccgtttcactgagtcgaagcttccttttggggaagggagaggaagccaagggtacgtttccttttcagggaggcagagtcaagacctgaccaactcctaggccagaccaaaaagaccatttctcctctgatcgctgaccaggccaatttcaagtgagaacagggttcctgcagccgccctgctgggccgcaggagagaggctgcctcagagcttgcttccatcaagagggtcctgagaaggtcagggggcactggccccacacagcccctccagcacagccgcccctgggaaggagcccaggaaacctgccatctctcttccggcaagccaccatccccctcaagtcagccttcgacaaggagctccaaggagctccaggttaccagggagataggaaagcaaagtgactgagaagggtgcagagccgaaacacctggtgggaaggaagaggaaggtcctaaaaccagccgcctgctgctcccacagactcaggcccagagcagccggcctgggagccacacgtgcccaccccactccctgccacaggcaggcagggcaccccttggcacgtcttgcctcttgaggcagggtccacgggcttctggacacctccctacctgggccggcttcatcctcctacgaccgacagtcgtgttgatgacatgcacctgtcccgggacttccccccagcccccagccagctgcgggagctgcaaggaggatggtccgggtcccttccaccgaaaggtggtgtgtgtgtgtgtgtgtgtgtgtgtgaccttcacagagtagcttgccacacccctctcccgctggccctgccgacctgccttccacagttgagggcccagacctcggctgggggtctctcacggctggaaacaaacctctccttcctgctcccacagcccctccgtgtcctccgcctactgctgcatgtgcgcggagcacacaataccgtgccgcccagcctccgcgcctctctccagaaacaaagaaactcccaacttctccctctggctcgcgctggcaccctctcggctggcaacgccgccgtccggaccatcgccacccatcgccacgctgtgcctggcccccgcagaccctctccctggcctcagggctactacgtctgcgggcacagctcgtcgccgtctctccctaacagcccctccaggaagttctctcacactagcccaccaattccccaccgatcctcggggccacctggacccctccagcctggtccttccatttgcaagcggccctgctctgagcagcccccaggtttcaactctaggctggatgccgccaaaacgaagggggaattcaggtccagccgctcgcccaccctccttccctgcggccctctaacctccccggccacatctaagcccactccagccggcccccagaggtgggagggtccgccacctcccacagcgagcacctgggttaccataggtgcagttacagcagaagcgaataatgaggagaatctccatggcagcctctgtccccgcggcgggagcgtgcagccatcgctccaggctccccggcgcccaccagcagcccggccactcagccaccttgctgatgctgccgcacggactccagcatcgggcagccgctccggagtgctcttccagcaagggggaggggagggaggcgcgtggcgaggagaggagggaaggggaaggggaggaggggtagggagggagggagccagcagcctgctggcatcctaaagaggagcacgtttgtagctggctggctgcctgggcacgaggctagagtcctcgcgtgcgcgcacacgcgcactcagctcacactcacacgcgctcacacacgctcacgctcacacgcgctcacacacacgcacacacaaggggaagggcgccgcgttcacgcagcctgttgcctgcacagccagacaaaggtaggtgcctgtaatccagcccgctccccgaggtaccttccatggtgacagacgtgtggctgtccttggagtccttgggacctttcactttgagttcctgccaaagggaggagaggagtcatggcctgttctgtccctcacctctcccagcccccactgtgagcctggcaagaaggggagttctgaaactcagggtgtacatatgagaacagaggccgggtgtggcggctcacgccagtcatcccagcactttgagaggccgtggtgggcggatcacctgaggtcggaagttcgagaccagcctggtcaacacggtgaaaccccatctctactaaaaatacaaaagttagccaggtgtggtgtcaggtgcctgtaatcccagctacttgggaggctggggcaggagaatcgcttgaacctgggaggcggaggttgcagtgagccaagatcacaccattgcactccagcctgggcaacagggcgagactctgtctcaaaaaaaaaaaaaaaaaaaaaaaaaaaaaaaaaaaaaaagaaagacaaaggagccccatggccatgggctgcctctgccaccccaatcccctgcaccacacctgtgaactcctggagcctcgtggagtccagtggctggggcgtgggcaagaaggaagggactccaggtcccagagatgagagaggctggcagggagccctgtgattacaggaaccccgactcaggaaccctacacgtcggccaagggcagacagggtttgagttgaccagcgccaggtactccagccaatctttagggcatgaggaacccatgaggtaggaaggaagggtcccacacgccagcagggaagtggtggaccttcggcagagatgctgagctccccaggacagtgagctgcatcctacccccatcagagagcacttactcagcccccagcacccccgacactccccacccaccactgcccatgctgggggtccgagaggaagcttcgagggaggaacagccaatgcccctcctggatcccaagccaggcagcaggtagtgagtactggaaagacccccgggatgactcatctgctccaagcctctttatcctcctttagagacgttccagccccagcttttgctaacaggacagtgcagcctgcaactggagctgtaataccatccccacttggcagacggagcacacggagcctcaaagaggggtgtgggagggaaggcaggaggcaaggtgaggccacggtcaggtgcccaggtgatgaggccagggtcaggtgcccaggtgatgaggccaaggtcagctgcccaggtgatgaggccaaggtcagctgccgaggtgatgccacctgcttggtctgcaggggaggaagcgctcagacagcaggaacttcctacttctgtctcaagctgtttctagacagagaaaactcctggagatggagcttgggtgtgtgtatattttggggggcgggggggtgggggatactcagcgtccccagcctgtgtctctggctggtgcctggactcccagatttcgggaatgtttcctcacgccccctccagtgaagtctagggtatgaaatcactcctgctgcagagaggagcctaattgcagtaattaagtggcagcctcagcaggaagcaagcacgtcatcgagtgagtcaggatgagaagccacctggcagaaagccaggggcctggctctgccctccagggtgggcaggctgtgaggggcttatggttgggtgtgggggtttctgcctaggcacagagaacaggcaatcagcccaggccaagagaagaccccacactctctgcaccatgtctgaccccgggatcttgggcggccttggcagggctgatctgaacacagaccaggggagtccaggtagttcctgggttgggctggaaaccgcagggaaagcaccatttctccagccccttttatttgtatttttaatagagacggggtttcaccatgtttcccaggccggtcttgaactcctgggctcaagccaatctcccgcctcggcctcccaaagtgctgggattacaggcgtgagccactgcacctggcctctccagccacttgactccatggagagggacttccccaccctgcacttcgtcctcccaggcagagggtgacacatctgctccatgggtctgggagaagaaactatggtcagccatcctctctctgcacactgggtaagaggcgtgggctctgtcctcattgtggagaggggcctgtgttttcctattcctgcaagggactcaatagatacttttttttttccagacagggtctcgctctgtcaccagactggagtgcagtggcgtgatcgcagctcactgcaacctccacctcccgggttcaagagattctcctgtctcagcctcccaaatagctgggattacaagtgtgcaccaccacgcccggctaatttttgtatctttagtagagacggcgtttcgccacgttggccaggctggtctcaaactcctgacctcaggtgatccgcccgcctcggcctcccaaagtgctgggatgacaggtgtgagccgccacgcccggcttctataggtacgtttcattccagaggcgaagtgtcagcaagcccactgtggctacagatccaaatccacattttccaagctgcatttttttaacagtaatgaaggtgacatgttcatctccaactgtcagcttctctgctgcctctcggtggattctaaacgtgggcatcgaccgtcacccctgaagtttcaggaaaactaccctgcgtttccccaactcttctagcgttagagctgagacgggaacacaaagggccaagaggggcctttacggcaggactcccaaaactgcagaagcttctccccttttctaggatggaggttctcttgccctgagctgggggctgttcctctcaggccagtgcttcaggggtgccactgaggtctttttggacaaagggatgaactgggctctgtcctgaaggatcctaagcaactgtccctccatgccacctcttaggtagaaatgttgatggcagataggactgcacctctgccctgtggaggagtgcgggaggaaggctgggcctcaggagcagaagcacgcgtgttcccagccaggaaggctgggcctcaggagcagaagcacgtgtgctcccggccaggtaggctgggcctcaggagcagaagcacgcgtgttcctggccaggaaggctgggcctcaggagcagaagcacgcgtgttcccggccagggattctaaggctccttctccacataagtggctcttaccctttttgtgtttatgggatggcagtcttagagttggcaagaaccttaaaagacgacctatagtccaaatttcctcaagacttccctgtcataaatattacccagaagcttgttcaaatatagaatcttgggccccacgcaaagccttctgaatcagaagctccggggaaggtgccaggaaatctgtgttttaaacaatgccccagtgattcttatcaagcaaggtcaggattagctggccaagctggactcagtggctcgcacctgtaatgtcagcactttgggaggctgagacgggcacatcacccgagttcgagaccagcctggccaacacggcaaaacctcatctctactaaaaatacaaaccttagccaggcgtggtggtgtgcgcctgtaatcccagctacttgggaggctgaggcaggagaatcacttgaacccagggggtagaggttgcagtgagccgagaccgcgccactgcactccagcctgggcgacagagcaagactctgtctcaaaaaaaaaaaaaaaaaaaaaaggattatctggccatttctaaacccctcattctaccggacaggacataaaagccaagaggggggacgtgacttgctcaaggtcaccatagtgtggtgtgggagaacactgccttggattttttttttttttttttttttttgcctcccctgttcctctctctaatctgaaagagaataataaaaaaataaataaaatagatcgttttctattaagagggaaaatgtcaggtgcaagaaagcaaatatcaggctaagtgttacccattagagtaaccacttcaccgactggcaagcgagggaggggagaccaagggctctgagcagcccccaaagctccttgtccctcagggtggctatgtggggagcggcctacctctgagatcttctggaactggttgttggactggctgcacttctcagctgtctccagagcgactttatagttatcgacaaacgctttgtacacaccgagctggctggcctgcagggaggagtcagggaacagagggagaggagggtgggaggggagaggattaatgaatggatgaaagcttcacggagcaccgggagctcccctgcactgaaaacctctcactcagctcgttgggaacttggggaaacgcagggatgaacatattacagtgtccctttgaactggacagtttccatggaaaccagctcagccaataaggttaatgagggggtctggggttggggagaccaggctagggcctttgttggcctgctagaaattcaactcttcacagcatccagctttcctcagcacggtgaaggtctcccagggtttgaaatcccttaatgtctcatacttccttcacatcctggaattagccggagcagggagagaggggggtgtgtgtgctggggggagctggcacgtgtggcctgctcaggcctccctccccacgtgcagcgtggggaacgacatttaaaggtgctgtcttggccgggcgtggcggctcacgcctgtaaccccagcactttgggaggcctgaggtcaggagttccagaccagcctggccaacatggcgaaaccccgtctctactaaaaatacaaaaattagctgggcatggtggcgcgtgcctgtaatcccaggtactcaggagaatgaggcaggagaatcgcttgaacccaagaggtggaggctgcagtgaaccaagatcgtgtcactgcactccagcctgggtgacagagtaagactccgtctcaaaaagaaaacaaaacaacaaatgaagatgctgtctttccatttcccttggccttgaggccccgtcctcacctcttccacctcctctacctccaaggagccaaagccccagcctcactacacgtttgcctgtcactcacacagtcacaacctgagtcacaaccacacagagcctcgcctcttctgagaggcagggcagaccccatcgcccctttctgcaaaaggggaaaccgaggctccataagtcaattccccaaatatttatggaaaggcttcgctgcgctgtatataagcacttcctcttaagggaccaaagggtagaaattcaaattaaagccatcacgagatattttatactcatcagaagggtcaaaatttaaaagtctaattgacagcaacggctggcaagcatatggggaaatttaaactccctgtttttgtttttgttttgagatggagtttcgctcttgttgcccaggctgcagtacagtggtgcgatctcggctcaccgcaacctcccggattcaagggattctcctgcctcagcctcccgagtagctggcgttacaggcgcccgccaccacgcctggctaatcttgtatttttagtagagacggcgtttctccatattggtcaggctggtctcaaactcccaacctcaggtgatccacctgcctcggcctcccaaagtgctgggattacaggtgtgagccactgcgcccggccaattaaaacttttttttttttttttttttgagatggagtctcgctctgtcacccaggctggaatgcagtgatgccatctcggctcactacaagctccacctcccaggttcgcgccattctcctgcctcagcctcctgagtggttgggactacaggcgcccgccaccacgccaggctaattttttgtatttttttttagtagagacggggtttcaccatgttagccaggatggtgtcgatctcctgacctcgtgatccacccgcctcggcctcccaaagtgctgggattacaggcgtgagccaccgcgcccggccaatttaaactcttagactactcggggaagtgtaaattagtacaattatttggagagcaatttgttaataactaataaagctgagaataggcatggcctattttcagttgaactaataacagtgtggataggcacagcccatcgattgcttagcaaatccacttttacatacaaactgcagagccgtatcgttcagtgcagtcgccaccagctacctgaggctaccaagcacctgagatacggccggttcaaactgagacgtgccggacatgtaaaatacacagtgggttccaaagccttagtatgtaaaagagaatgtaaattacctcgttaatttttaaatactgattacatgttcaaataatatttggatctgcgggaataaataaaagatattctcaaaattaatttcacctgcctatttttacttttaaaaatgtgggtattaggggccaggcgcggtggctcacaactgtaatcccagcactttgggaggccgaggcgggcagatcacctaaggttggcagttcgagaccagcctggccaaaatggtgaaaccctgtctccactaaagatacaaaattatccgggcgtggtggcacgcatctgtagtcccagctacttgggaggacaaggcaggagaatcgcttgaacccaggaggtggaggttgcagtgagcccagattgcatcactgcactccagcctgggtgacaagagcaagaccccgtctcaaaaaaacaaaaaaaaggtgggtattagaaaatgtgaaatgatgtacgtggctcataagctatttccattagacagcagtgctctggagcaaatggcctatgtgtgtgccccaggggactcaagggtgttcaccatctcacttttcctcctcatagtggagggactggtaacaaatgctcacaaacgggggaagccgcgcacacagccatgaacatggatgcacccgatttacacatagcattgctgacaagctccaaaacgaacatgggttgaactgtaaaatacgattgctgacaagctccaaaacgaacatgggttgaactgtaaaatatgatatatgtgtatacttatacacttttttttttttttttgagatggagtctcgctctgtcaaccaggccggagtgcactggcacgatcttggctcactgcaaactccgcctcctgggttcaagtgattctcctgcctcagcctcctgactaactgggactacaggcacgcaccaccacacccggctagtttttgtatttttagtagagacagggtttcgtcatattggtcaggctggtcttgaactcctgacctcaggtgatccacccgcctccgcctcccaaagtgctgggattacgggcgtgagccaccacgcctggcttagacacatttttaaagtacatgcagctgggagctgtggtacacacacctatagccctcgctacttgggagactgaggtgggaggatcacttgagcccgagttcaagtccagcctggacaacatagcaagacctttttttttttttaaagtacaggccaacccaaaatagatacagatatgtagtaaacacacaaactgcagtctggaaggctatccaccaaattcatgccagtagctgcttcaagagggaggagggaggggagactccaccttcatgtgtgacgctgtattttcttcattagaaggttctgctgttattctttggagtttctggtttaaatgtttttcaatacagcagcaagggggatacagctgctgcctggcttcctcaggggcctctgcttcccaccaaggtgctgggggaagtgggctgctgtggacccccaccccggaccactctgctttctgcaggatcctcatgctccccaaggacccagagaggctggggtgggggtaggggtgggggcaggctggccgcagcatcggctgagcctggagcctcccagtacagaggcagagccctttgaggaagctggtggggcaggggagcggggggcatctggaaaagccagaggggagcgcgagtggggacgcccggcgtgacgccaaggccagaggcattcaggtctcagctgcagaagggcaggactttaaaagggggcagggccggacttttaaaagagggcggggcctgagttttaaagggggtggggcctgaccttaaaagggggcggggccggacgggagggagtttatttccttttccagggagtactgaggcccggcccatcaatgcccacgctacacgaggcatactagacagtcgctgcctaagccaaagtcagatcaccgatattcttccaggaaaaggctcctcttgccccctttcccacaagaaggagaaagcctggaggcccgggttggcacaccaccctcccaggagccaggggcaggagccagccgtgcggaggcctgcgtccagggtcacggtaatctcagggactgccgctgccacagtcaccccaggcggtagggcccgaggcctggcttggcaggttcattaactgggaagtgcaggttgcctggaaacagcagcctggcactggagtgatctcataaaacaaacagcagagacgctaattcccttctctcagtaacgaataatcaaatacccagagtcttcggctgaaaataaaccacctccggatgccagacctgacccggctccccccgggccctcccaaatctgcagccccaggggcctcaggcatcggttcacgatgctggggagggaaagtggtgggtagcagattcacggccaggcctgtggagccaagaccagaaccggggacagccaggtccaagtgacaaagataaactgtgacagcgtttccagcaaccctaggtttgctctcctctaccctcctgagggatgaggagaggatgccccccaggccactcagctcaggtgagcaggcagtgatgacaggtgttcaccatccctgaaccggagggagcaggggggggtatgctagaaccagagtgtggcattcccttggaaggataccttccagggtgcctcttcccaatttaataataataataataataataataataataataataataatggcactgatgataatgaccagttattgagtacttattaatttatgatgttccaggccctgttccaagcactttttcttttactttattgtattctatttctttttttgagacagagtcttgctcttgtcgcccaggctggagtggagtggcacgatctcggctcactacaacctctgcctcccgagttcaagcgattctcccacctcagcctcccgagtagtagctgggatcacaggtgcgtgttatcatgcccggctaatttttgtatttttagtagaaacggggtttcaccatgttggccaagctggtcttgaactcctgacctcaggtgatccgcccaccttggcctcccaaagtgttgctgggattataagcgtgagccactgtgcccagccatttttttttttttttttttttgagacagagtctcagtctgtcatccaggctggagtgcaatggtgtggttttggctcactgcaacctctgcctcccaggttcaagcgattctcccgcctcagccccctgagtagctgggactacaggtgcattccaccacaccctgctaatttttttgtatttttagtagagatggggttccaccatgtaggccaggctggtctcgaactcctgacctcacgatccacccaccccggcctcccaaagtgctgggattacaggcgtgagccaccacgctcagtcaggcctattctatttctttgtagagatagggtcttgctatgttgcccaggctggtcttgaactctaagcctcaagtgatcttccagcctcagcctcccaaagtgctgggattacaggcgtcagccaccacactcagccccatgcagttttcagatattaactcctcaaaatcacccaatgaggtaaatactgttactatcctgttttttacagatgaggaagctgattcagagcggttgggtaagttgcccagttgcaggtttaatctggcagcgctgggattcaagcccactttgtgacacggctctagaagctgtgctggagaaacaggactctcaggacagaaatctcaggccctgcaacgtctccctccatgcccttccgagttctcccgaggcccagtggtcaaggtcacggtgcattcactcattcaagcagtgaccactgggctggttctgggagtctaagaagaaggaaatgcaggccgggcgcggtggctcacgcctgtaatcccagcacttcgggaggccgaggcgggcggatcacctgaggtcaggagttcgagaccagcctggccgacatggcgaaaccccgtctctactaaaaatacaaaaattagccgggtgtgatggtgggcgcctgtaatcccagctactcgggatgctgaggcaggagaatcacttgaacccgcgaggaggaggttgcagtgagccgagatcacgccactgcactccagcctgggcgacaggagtgagactccgtctcaacaaaaaaaggaaatgcagtccgtcctcctggaacttgtggtttgggggagtcaggcagttactagtgctcactacgaggactggcacaaggcctgcatttggcgacttggaaagccttcttggaggaggtcccttctaagctgggaactgaccaggggaggccagacgagagggggaaggacgtttcaggcacacggggcctcaagtaccaagagttaagaaagtgcctgccctgggaactgagaacagaaagtccagtgtcaggagcacagaggtgcggggaggaagctgccaaggctggggctggacacgggtcagtgtgcaaagggtctctcgagccattcctcggagcctgaccttcatccgagggccgtggggatccgctgaaggggccgtcgaggtttcagtgactctctcccctctaaggagaggtgggggtgggaggtgagtgggcctggaggcaggagccacacaggaggatacgcagctgtccaggtgagggccatgggtggccaagaagaggaaaaggcggctgtgagcaacggccaaaaagtggagtccacaggacaggtgggggagggggtgcagccagaaagagtctgaagcactcggtgaggtaaagacaggaagcggagcaggtgacgccggaggcagggagctcagctctgaacacactcagctagaggtcctaggagtgtccaggcaggagagggagagtcttctccagcgtgagaaaggcagagccctgtccattcagccagaacacggcaggggaggggaggaggcctccagcctctcacacccagagaacagggcaggaaggaggagaaggtcctctggccactcacacccagagaagaaccgcggcctggactcccagtctccctcttgcctgctgggcggtcagacgttacgtagcagaggtggggagggagctccatgagtctgacctgggggtcctccaggggacacagccagagatggggcagagctgggggagagggtgtcacagaagcacagggaaccagaagacttctgtgaacgtttcccaacacgaggtctgcatgttaacccacccactcctgccgctcccgaccctgcagtggtgagcagggctgggcttcagtgcttcctgctcttgggacctcaggagaggatcatcggccagtgtgcccaactgcttccttttacagacccgaggtctcaggggagcagtcctcatgcccctaacccggcatgtgcccctctgttcactgagggacaggagactgaagcccagcaagaagccttcattccagggctggttcctcagagcaccctccgggagagagagggagcaccgtccgggaaagacggagcaccctccgggagggagaaggagcaccctccgggagagagatggtgctcccacagaagtgcccatccacacagcccatctccaccacccctggaaggacctatccacacagcctgtctccaccaccccagaagctcccagggctgcaccaggggaggcctagagtcaaggccccggccccaggcaccccataacacacaggcccaggccttcctcccggactcggagaggtctcaggccttcaaggagtccgagagggctgcccggtcctctcctgaggctcctgcaacactatgggctccactgaggccctgcgtgaggaccctccatccctggcagactcaccagcttctggaagaggtggcccatggtgacctggctgtcccactgttgcaccttggggcacaggttgtcatagaactccttgtggatctcatagatgtcctggatcttgtagaagatggtctcgatctgctggatggtgagcacgggctgggaggtggtggcggtggccttcaggggtttcatgggctgggagaaacagaggaagaaagagcagaggtcgggggtaaacaaaccagagtgtcggcaggccccggggccgatcgttagcccttcccgctgcccaagtcctgcccagacaaggctgccaaaggcagggcactgaaacgagctttgtatcaaggagccactgccacaggccccaacaagccgcacactcgacagcaggaacctggcctggcagctgtgccaggcccgaggggtggtgcctgggctcactcccctaccacgcagctgagctcagcagcagcctgtactgggttaacaggatccgcgtctttcttccacgatagcctgtgccccgagtcataagctccttgtcacacttcagtggaagggagggttgacagggaactcaagcctatagctgtttccttccaagaaacagaatgtggttctaggactcagaaggtagggacccgaagttactcaagaccagtcttggcctcactgatgttccaagttcccgtcacttggcacagggagaggcatgggcgttcacgtgtcccccactgcagcccacccccgtggcagacattgctaagcgaccgtgatggtccttcccactgcgcatggcaggggtctccagtctcagactctttctcaatgcctgcctgtctataccaagatgctccagggcctgccagtgtagacggtgaggtggcagataacacagaccaacccccagcactggccgggagctgatgccatcaccttccagcctagcagtgggaccgtgggataacgggacgtgcaggcatttcctcagtgtggttctctgcattttataaatcacctacaatgaatgaatatgaataatcagaaaaaaaaaaaccaaagatgaccaggctgtactgcaaaggccctgcaggacacagggcctgataacctgccatacagggaaggtgtggcagggaagggcagggtggccagagggagagcagccacgtcgaattcttttttttttggagacggagtctcgctctgtcgcccaggctggagtgcagtggtgcgatctcggctccgcctcccgggttcacgccattctcctgcctcagcctcccaagtaacagggactacaggcgcccgccaccacgcctggctaattttttttgtatttttagtagagacggggtttcactgtgttagccaggatggtcttgatctcctgacctcgtgatccacccacctcggcctcccaaagtgctgggattacgggcgtgagccaccgcgcccggccagccatgtcggattctgttgatgttcttcacctacctgaaggccacgtggaaagaggcttagacttggctggtcacggtggctcacacctgtcatcctagcactttgggaggccgaggcaggtagatcacctgaggccaggagttcgagacaagtctgaccaacatggtgaaaccccgtctctactaaaactacaaaaattagctgggcgtggtggtgcacacctgtaatcccagctactcaggaggctgaggcaggagaatctcttgaactcaggaggcagaggttgcagtgagccaagattgcgccactgcactccagcctgggtgacagagccagactctgtctccaaaaacaaaaacgaggcttagacttaatctacgttgctctgcagacccaggaacagtggggaaaagttatggggtcagattcgggctcactagagctgtcccccataggattaagtagtgagctttccgacaagagaagcattctagcagagaatgggtgactccactgctgaaaatgctgcactgaagggaacaccaaagccagcgccagctccctctgaacgacgaccaccagctccagccaaccacggcaaactcccagcccagcctcactccagcctcacatcacctcattctgatgaagtctcatctactcagatatatcgcctcactctgatggagacagaacccatgttcactggaagaagtcgtctcatctactcagacacccagatggtgctctgccttctggctccttcatcctccgagctctaaaaagcccagatccaacaatccatgcaggacaaagcaggaccctccttctgaccctcgccgcgctagaaacaacggcccctcagtgtccagtcaggactctccttctgaccctcgctgtgctagaatcaatggcccctcggtgtccggtcaggcccctccttctgaccctcaccgtcctagaaccaacggcccctctgcgtccggtcaggcctctccttctgaccctcgccgtcctagaaccaacggcccctcggtgtctggtccttgctaggcaagcgcatggggttccacctggtgcaggccaggcagggtgggcttgagtcgcagctctgctgtgcgcacatcactcagcatccctgggcttcgtgtcaccagcagcctcatgtgtgaaactgggataatacagccatgcgctacctactggcattcccgtcagtgcgtacacgatcatggtcccagactgcaattttttttttttttttttgagacagagtctcactctgtcacccaggctggagtgcaatagtgcaatctcggctcactgcaacctccgcctcccaggttcaagcgattctcctgcctcagcctcctgagtagctggaattacaggtgtccaccaccccgcccagctagtttttgtagtttttgtagatatggggtttcaccatattggtcaggctggtctcaaactcctgacttcaagtgatccacgtgcctcggcctcttgaagtgctgggatgacaggtgttgagccaccatgcctggctgagacctttataatccagttgggcaaaatgggccaacacagatgaaatgactatggacgatgcgactgactgtaagcaccaaccacatggttccaaggttgtgctggagtagcctggagggctgcatggaggaggcacacataccaggtccttggagagctgagcaggtggaggagtgggggcgtagagaggcatgccagacagggaaacagaaggcaccgggaggcaggagcaagggaagagtgtccccccaagcccaggtgggtgagctgaaagctttggggactccccaccctccatgagggacatggaactagcttcaggattgacatcgtcgtaagagtttatccttttcacctcaacgcaggaccccacggaggagcccgcagagtcgccacagaatccccatacccaagaattcttgtccccgccttggcgcagtccccactgagggggaaataagggaagcaggaaggtcagcagtcccaggaaggccaaggagacgggatttctcagaagccgcgacgcgctcatctgccacccacacgaagacaaaacacaatggttatgcttcctcctcaacttcccaccccgtctgcaaaaggggaagaaatggacgctcacccacagccagtcacaaggacggggcctgcgcttggggcatcagatggttctcatgacacgatggggaccttggctgttactcctgatttcactcgcggggaggggacagggctgggtgtgtgcccttggctggccaggaccctcgaggccgttatttgtctctggtgaagtcctgcgtatgggctcaggggcaggagggtggactgaaaggcaaggtgacccacactgagcttcggcacggcacagccattctgccaaagcgctagcacaccactcaggcaccccctcctccccagtcctgctgcagggacaagggcaggccccggctctccatttcaccactcgagttctcggagaggacccgtgagtgacttcaaccctggctcccataccagctgcttctcaggaagacgggcctgggccggttctcacttgccagtgggacttcacatagccgtttgtcagctctgtcccccagcgaccggcctttcgaaataagggaaagaaatgtacccacttcctccacctcctgccccagaaggcctggcatgcttgctgccatgccacccgagtcactcgtcactggagcccagggaggaaggcctcattcacctgttttatagataaagagcctgcgatgcagcgtggccaggagtccaccccaggagggccagtcgtggccagcggtgggaggggctctggggagtggcctcaccctgtggccccagcgtagcaagacacagttcccaagctcagttcccagtgtcaaggagatccagaatttcaatgcagttggcttcatcttttttccttcaccccctacttcggcccaggctcccaggcttttcctgtaatcagagcccaccaggaagcaggagggccccagaagatgacccccacaagcaccccagaggccaggacggaggcttctgtgtggaggctcgtctgccccgtgtgtgcacatggttttaggtacacacacccagccctttgcatatcaggaagtgttcagatgaaagcaaacaggctggggcagagcggtgggaatggggtcaggagtgggaaagcgagcatggagggaacgaatttcttctccttcaagctggcacctttgcgaggccaccccgaagagcagaaggtttagcttcctcctagctgaggggtggggagggtgcaggggttcccagctcagggaggagaggaggaagggtgtgattctttcactctgaggttttcttctgaggctgtggctgtggagggtcctactcctcttcctgagccctcctaccacagacctggcctcccagcgagttcttcctttgctccctctggtctctgctcaagaaagagccaagcaggggcccaggaggagagagctgggggaaggtggggaacccgccccgggaggagagagctggggaagggggggaacctgccccgggaggagagagctggggaaggggggaacctgccccgggtggagagagctgggggaagtgggggaacctgccccgggaggagagagctggggaaggggggaaacctgccccaggagagagctggggaatgggggaacctgccccaggaggagacagctggggaaggggggaaacctgccccgggagagagctggggaaggggggaacctgcccggggaggagagagccggggaaggggggaacctgccccgggaggagacagctggggaaggggggaacctgcgccaggcatatcaggaagggggcccctgccccacagattctgcctttggggcatgagctgttagaaaggcagagcagggaggggctcttggtcttggcccagaggaagaggctcgtgggtggcaggtgggatctaagggctccgtgtctgatggggacaggcgccactccctccttcagggaacgggtgtgttgtggcagaaaccacgaagccctaacctgtctcctctcccagcaatagagaaattaacagtgtcaacgaacactcaggctgtgttctaagagctttatgtgccggacacagtggctcacatctgtaatcccagcactttgggaggccgaggcgggcggatcacttgaggtcaggagttcaagaccagcctggccaacatggtgaaatctcatctctactaaaaatacaaaaattagctgggcgtggtggtgggtgcctgtaatctcagctacttgggaagctgacacaggagaatggcttgaacccaggaggcggaggttataatgagccgagattgtgccactgcactccagcctgggcaacagagcaagactccgtctcaaaaaaaaaaaaaaaaaaagaactctgtgtataaattcctttaatcctcacaacgaccccatgaaaagcatactatttgtatacccagtttgcagatggaaaaactgaggcacgatagctcattcacctgctgaaagcctggagccagtacggccaggcagtctagatcctctgtctgaactcctttcaaatacacaccctgttagtaatgacaactatgttcctttttggacagcaattcacggtttggaagacgtgtttcacgaatgtctgacgggttgtctctttgcctgtcctcctttcttccactaacagttgagtgtcttaagtaactcaacgctgtatgaggtcccgaaagcatctcccgatcttctcaaccccatggaaagagagagaaagaatggcatccctctcatcttcagatccagaaatggaggctcaaggaatttatgtagggcttgcccaaagccagcagttttcttttctttttttttttttttgtgatggagtctcactgtgtcgcccaggctggagtgcagtggcgcaatctctgctcactgcaagctccgcctcccaggttgacgccattctcctgcctcagcctcccgagtggctgggactacaggtgctcgccaccacgcccggctaattttttttgtacttttttagtagagacggggtttcaccgtgttggccaaggatggtctggatctcctgaccttgtgatccgcccacctcagcctcccaaagtgctgggattacaggcttgagacacggcgcccggccaaagccagcagttttcaaacccacaacaggtgtaagacaccatgggcccggcaattacatatatatacaggcacacagacagacaacaaaccgaaagttccctcacttatctttcccgtgtatgatgcatgctgacattttttcattggtttaaaaatgctggttcaacccactgtactggtttcacaacccactgtactgatttcacaacccaaagcactgatgggctgagaggcacagtttgagaaacagtgcaatacgcctgctcttaatggcagggccaagtcttgccctagctctggccccagaccaggaccctcagctacctgccacactgcccctcacttggaaaacagctccgtacacacagataaactcctggagagatgggacgtactcagcctggcgtgtggcaaaacagctgcacattcagagtttcactcttgttgccccggctggagtgcaatggtgcaaactcggctcactgcaacctccacctcccgggttcaagcgattctcctgcctcagcctcctgagtagctgggattacaggggcccgccaccacgcccagctaattttttgtatttttagtagagatggggcttcaccatgttggccaggctggtctcgaactcctgacctcaggtgatccacccacctcggcctcccaaagtgctgggattacaggtgtcagccactgcacccagcctttttttttgaggaatttcacttccgtcgtccagtctggagtacagtggcgcactctcagctcactacgaccttcgcccccagattcaagcaattctcatgcctcagcctcctgagtaactgggattacaggtatgcaccaccacgcctggcttttttttgcatttctagcagagacaaggtttcaccacattggccaggctggtctcgaactcctgtcctcaagtgatctgcccacctggggctcccaaagtgctgggattacaggcactgagccacggcgcccggcctgcacctgcacatttacacagtcattcctgggtaacataaatgtcaagtcccctgggacactgacagcatctcagggttgacgtgtgacaacacctcacgtcatggcaagtacttaaatgtgcatcttagaattcttgttaagaatgagcttccacagatccacacttctgcgtctcccttttctgacaattaccttatgtctcaggctgcaaaatacccaaaagaaagattgacacgccacgatcactctgcataacatccagacacatctaaggagcactttcttccaaggcaaaaccacctcacatctgtgtagtacttttatcttccgaaaacattttcatattcccctcccaatcagactctcacaacgatgcctccatctgggaggggaactgaggcatgttaccgagggctgagcttggcctgatgcctcagagctgtgccgcttctcaaaagaacacagacaggccgggcgcagtggctcatgcctgtaatcccagcactttgggaggccaaggcgggcagatcacctgaggtcaggagttggaaaccagcctggccaacatgataaaatcctgtctctactaaatacaaaaattagccaggactggtggcgtgcacgtgcaattccagccactcgggaggctgaggcaggagaatcacttgaacccgggaggcagaggttgcagtgagccgagatcgcaccactgcactccagcctgggtgacaagagcaaagctccgtcttaaaaaaaaaaaaaaaaaaaaaaagaacacagcctcccacctcatatttcctgacacggggcctcaggatggcactaacggttccctcacccagggaggtagaaggacttggacacaagacggcagagacttcttaactggattgattgggaatgactgcccagagcacagcgtggagaaggcgctcggcccccgcccaggcaggcagagcaccatgatgggttcacgatgccctatgccagggtcgtgggtgacaggtgtgtttgccatctctaagccgggtgtgcttctcctgccttttgagagctggagctgagaggcacaggccctttctggcaatgacccgggctgcccgatgcccagccagaagcagaccagctgcagactctgtccacagggagggacgggtacggtcccctttcctctccaactccaaaagcagcttcagagcatgacatcacccaacacgggcggggggaccggaaggccccagagcagggactgtactcaccagcaacagggcttccagctggttaatgtagatctcttcgctggccaagaaccccgagagaaccagcttcctcatctccaggcctttccctgcttccacctgcacaaacgcaaagcacagccaacagctcatgagcaaggaggccaaaaccctgcgtggacggtctgcttccctgcccttcccccccgacctttattttttttttgagacgaagtctcgctctgtcacctaggctgaagtaaagtggcacaatctcggctcactgcaacctccgcctcccgggttccagtgattcccctgcctcagcctcccgagtagctgggattacaggcacctgccaccatgcccagataatttttgtatttttagtagagatggggtttcaccatgttggccaggctgatatagaactcctgacctcaggtgatccacccacctcagcctcccaaagtgctgggattacaggtgtgagccaccatgcccagccattatgccagactaattttttttgtatttttagtagagatggggtttcaccatgttggccaggctggtatagaactcctgacctcaggtgatccgtccgcctcagcctcccaaagtgctgggattacaggcgtgagccaccgcgcccggcccccctttcccctttccttttattttaagcgacactttcataggggataaaagtcagatattattataaaaaatatacaaaacatgcagaaatataaaaggaaaagacaatcacccatattcctcctgtaacatctcgttttgcttccctcaatctattttccacctgggttctcgaaccgacttttcctccctctcttcctctcctcctgcctgtcccacacaccagagctggattcaactcctaagagtgccaccttgcccgatgcttgccaaggaccgagtatgaataccgcaaaacgcgagtacttggggattccactgggctatgtgtccatttatttattcattcaataaatatttactgaatgtccaccaggccctatagataccatgggaaacagacagtggcccctgttctcaagtggcttagactctagtgggaaagacatttattttttcttttttttttttttttagagacggagtctcgctctgtcgcccaggctagagtgcagtggcgcgatctcggctcactgcaagctccgcctcccgggttcacgccattctcctgcctcagcctcccgagtagctgggactacaggctcccgccaccacgcccagctaactttttgtatttttagtagagccgggatttcaccgtgttagccaggatggtctcgatctcctgacctcgtgatccgcccgccttggcctcccaaagtgctgggattacaggtgtgagccaccgcaccctgccggaaagacatttaaaaaacaagtaaagattcggccctagactgggacatggggcccaccatatcctttatgagccacctgcagtggcccggatgcccgtccctacccttccagtctttcccacagccaggacatcgctcagtctcccccacacgcaggagaaccagcctcctcatcttcaaaggtctctagctttcggttcgttctttacctgctgcctaaaatgccatctttccctgaggcatcgtggccacagaaggggagtgagagggccggggagacagggtagtggtgagggactgcttggaagatgctacactggtaggtttgaagacagaggatggggccacgagctaaggaatgcagagagcctttggaagctggaaatggcaataaaatgaactcactcccctagagcaggggcttccgatcttttggctcccctgagccacactggaagaagacgactgtcttgggccacacataaaatacaataacactaacgacagcagatgaactaaaagaaaaatatataatgttttaagagtttacaaatttgtgtcgggccacattcaaagcagtcctgggccgtatggccgcaggctggaaaagcttgccctagagcttccagaagcaatgcagccctggagatcctttttattttaattaatctatttatttatgtatttacttattgagacaaagtctccctctgtcgcccagggctggagtgcaatggcatgatctcagctcactgcaacctctgcctcccaggttcaagcgattctcctgcctcagcctcccgagtacctgggattacaggcgtccaccatcacacccactaatttttgtatttttagtagagatggggtttcaccatgttggccaggctcgtctcaaactcctgacctcaggtgatgcgcccgcctcggcctcccaaagtgctgggattacaggtgtgagccatggagccgggccgagatcctttttagatttctgtataagagaataaatttgtgtggttttaagcccttaagtttgtggcgatttgtttcagcagcattagaaaagcaagacagaccccacgcttcaggcaagggcaatagttacttattggcggcttcacaaattccaggaactgagcttagctatctttgtggttcaattcaccggagtctcaaaacctggcaggtgttatcatcttcctgaggcaccgagagtcgggactgccagaggcctgcacagcctccagcacacgtagccccgggggacaagatcagagcctggaacagcccccagctccagcccctccaggtcagaccctcaggggtcttcctgctgcttcccagccttgacaaatgggaactcatcccctgtgctgggggctagcactccctcctgttccctgccaaccaaggttttgcctgagggtttagcaaatgccacaccgtgagctgtaactgtagagctggttggactaggatggggggaagaaagggatttgcagccccagccacaaacaagcttcatcccccctggcacgagcatagaccctggaagccctgtaatcgcccatttctgcaagatcctcccctcaagacttccattcatagtccactcttgaaaggctggttctgatgggaagacaactcaggaagaccctccctcaagaggcaacagtcagccccaagagtcctgctctgggccccgttcacgctgcagttttggctgagattggagcaaaggcgttggagagcgtacggatgggaaattagcctcggtgcacttggctaacaggagacccgttgctcagtcaccaccaaaggaaggcctgttccatctcccatcttttccagctttcctcagactccacaattcccagtttagagccatgaggaaattcacattgtttcttcagtctttgcagggcgtctcttgtctcatcaaaaaccaggctcaccactcactcacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggctgacagtgtggcagcttgaagccgccaaaccaaagacgtcaggtcactctggtaggaacaatgtctagagataaggcgtggccagctcaggcctggtcctccacagagttgagaggctaaataaagcctccaaacatctggttccaggccaagcaaagacacaatctctccagtagcactggcctccaagacaacaagcagggctggctctctggctgcgactcaaggctatagggcatgcagcgagggtctgaggcttcacagacggtagaagtcagttcacgggccacagctggctgccaggagtacccagcaggatctgctcagagtagatgccactgggcctgggggtgggggtggccgtgcctggggcttatacccacaccaagcatcaacctcaggacaactggcccatctcagtctcaggacagctgaggcagtgtagaggcatcgagagaccctctcctctcccagcgctaggcgctgaggaagtctctttcagctgcttccttggcagaatttagaacagagaagacgggtcaactgctgggggacaaagaccaaattccagtggcccctctctcctgaagggtggatccccgtattctgggctccctattgctgtctgaggtcttaggcaggcaccatagggcacaggcaatgttttgaaactttggttgttcatatcccacccttaaaattttgccatactcacataccaccacctgcactattctttactcaatattgttctttacagtaactttttttttttttttttttttttgagacagagtctcactgtgtcacccaggctggagtgcagtggcaggatcttggctcactgcaacctccatctcccgggttcaagtgattctcctgcttcagcctcctgagtagttgggattacaggtgcacgccaccacgcccagatactttttgtgtttttagtagagacagggtttcaccatgttggccaggctggtcttgaactcctgacctcatgatccaccgcgcccagtctcccaaagtgctgggattacaggcatgagccactgcgcccaagaactgacttgtaaaaagcagtcttaccctacacgtatttgaaatcgtaagaaaaatgtacaggtcatattttttctaatatatattaaaatatatacttaaccattaaaatgcaaaatatagatcgaggtgccaccgatcatttctcaaatcaccacgtggggcccgcacttagaaaaacatccaaatgggggatacaggcatgatgtgcaggcacaagagacctgggcaggtgaaacagaaatagagatgtttcagatgatccattaaaaactggcacagaattgggctgggctcagtggctcactcctgtaatcccagcactttgggaggccaagaggggcagattgcttgagcccaggagttacagactagcatgggcaacatggtgaaaccctgtctctacaaaaatataaaaattagcccaacgtggtggcatgtgcctgtagtgagggggaggctgaggtgggaggactgattgagtctgggaggtggaggccacagagagccatgattgtgccatcgcactccagcctgggtgacagagtgagactctgtctcaaaagaaaaaaaaaaatggcacagaatgatacctaaagggttaatctgcattacaaaagggtttttattcctgacaaataagttccttaaaatagcaccttctacaacgcccccgtcacaaccctacctatctttaaatagaatggcatgaaacatttttggcaagtgtaagccattttacaaatgcaacatgacgctgctatcagtattttatttgcattaccagttttacagatcaataactcttcaaaggtaagtctgggctgagatatgcagcaaactccagctatagctttggagaaaactgcagccaactttacctctgccccccaggaagatgaagcgtcttggaaatgacactggaaacaggattgatttatgggcctggcacttgggcacatgctcacaacgcaactgctgcttaaggtaagtacccctaaagtaaagtaatagcaaagagaattgccttggattcctactagctgccagggaagggtgtgccaagaacctctgcagcccaggacaggagtgtatcatccagaaatgacccttggcctgcacacacacacacatgcacgcatccaggccatccccaactccactagaagtggtcccttctcccctgaatttggtgcccttttatcagtactcttctcacagtcttttttttttttttttttttgagactgagtctcaccctgtcgcccaggctggaatgcagtggcatgatcttggctcgctgcaacctctgcctcccaggttcaagcgattctcctgcctcagcctcctgagtagctgggattacagacgcccaccactacgcccggctaatttttgtatttttagtagagatgtggtttcactatattggtcaggctgatctcgaactcctgacctcaggtgatccgcccacctcagcctcccaaagtgctgggaatacaggcgtgtgccaccgcatctggcccaccctgcctacttccgtactctattcctactccctgtacctgccccttgctctgaacgccttgtgagggaagatcacgccttgttcctcttgtcatctctacagtgccaggcagggtgctctgaagagcacctaacctgagagtgtttgttgaatgaatccaggagctttcttcccaccgctctgtggccacctgcttgtcttctccctctgaggccaatgccggtagaggagggaggaattctagaggtgttcaggatggagcagggagcctggaactccccggcattcgagaaaggtctccttcccccatgctggcagcaaagtagaggggaagacaccatcccggtgctcacggggacccaggaggagcagcgttttcaggtgtgacacgtgctcaggctctcttggcatccgtgggccaccgccgtacacagcaggacacctctgagatggagcgaggctgggaacctggtgcacccttcgtgggccccagcgggcctcacacattgtgcagactctcacaggcaccagccccacaccaagcactgtgcagtgttcagcaatgaatatgacatggtcctggtcctccaggagaatgggatataattgcggaggcaaatgtctagagttctgagcatctgagcagaatgaaatacgggcttagctgaggcatacgccggggtccagcagaaggggaggtccaggaggcagcctctgagtgggcccacatctgtgctgggggcttcccagaggaggcccatgagggccacacacctcccatcccagcattgctactcccagcctgactcctggctcaggagcagactttcccaccctgttcctagtggggaggctggtcagaccctaagtgcagaggcctccctgagcccacggggagacgtgacttacccccacggccctacgccagcaccagatcagagaagacagggtggggtgccagccactgccagcctccctacagctccactccccacccaggcctgcagccaccgctccacccatactcacacatcagccatctcccgtggttctgcatctatttttacctccattggctcctcctcagagccacactgtagagtgggtggggcaggactgtgatccccatcttctgtgaggggcagggaggcccagagaggttcagggacagcctcccgtccccagcaatgctggctgcacatgccttctaggccccgccgatgggcactcggttaggcagcctcgcctagcagtctgcaaactccccgaaacgcatcctcactgggcctcccttctcgacacagaaccagagagcagctgagcaaaaggctgaggtggaagctctgagaggtgtgtccaggagagaaaaaggaagaccgctgtggtgtgccgggccagactcacagagccggcgtggttccggggccgccccgctcctcaagggattctggccaccactgccctccagttccaccgggagccaacctctcctacaggacgggtcactgctgcagagaacgccgtcagccccagagcgggtgggccagggcccagcagatgctccctgcctgtcccgcctcgggaagggcacctgcccacctggctgcagcctccaagccagctgttccctccccccttcagctgacccagtgcttttccttcaaggaagctcagtgacctctggctcttgccctttgcaaacaccctcttgcctcagctcggagacaccaagtccctgtctcctggctgggaagagggtggcccctctcttgcggttgccgtggaaacgggggattcctgcccacccgctccagggaggcggcgaggctcgggctgacaggcgcgccaggtgactcctggcacagccgccggagccctgagctgggctggcctggagggggcggccaccactgccccgaggacaccggtcggggaggcaggcccgcccctctcccccgggaacagctgccggggccgggaccctccgccgagggcttccacccggccgcgcgctctgcgcccgcatcagccatttctcccgcgcaccttcggcagcgccggcccggccccccccagcgcccagggcgtgtcacgctcccaccttcacagccaccaggaagggggaccctgagccggggctggtcggggttcccagctcgcactcctccaggagaaacacatcttcgtcctccagaaccttgtccagcaagcctatcgcctcctcttcctcctccatggcagccggagcccgcggagggcagacaggaagcggggtccacgcagcggcggcgggaggagggaggagggaggaggcgggcgggagggggggcaggtctacacccgcgcgcccggcctggggctcccgacccgggactgcatcccggacctagtccagcccgctccgccgccgccgccgccgcctcgcgcgtcctcgcccggcgaaagggggagcaaggcccgggcagcccctgacgccgtgcccggcccgtggcggaggcgaacccgccgcacagcagcccagcgccctcctccgtgtcccgcccggccccgcagggcccgcccttcccgggctccggggctcgggctcgcgctcgctccgaacacacaggaaacgcgcgtcgcgaggtggagccgcccgtcctctggggttgcggggccgcggctggcggaggcttctgcggcggaggaggagcgaggaggccgcggccgggccggggtggggtggagcggggaggccgcttcccagacgcatcttcattccccgcgcgcggccgagccaggagcccggcgagcaggggcgacccccagagccaccccggagtccccatgcgccggagcccccttccggaggggaggccccggcccgcccagaagccacagccgcgtcccgccgccgctggaggagtcaggctttgcaacagacaggcctgacctgcccccaggcaggagcgcggcgccaccactgtcctgcacaggagcggtgggcgtcccactcacagggaccaggatccccctcctccaagcagcccccctcctccgagcagtccccccactcacggacgctactgacaccagcacccccacctcctctgagcagcccccccactcacagaccagcccccctactcacaggcgctgcagagaccaggacccccacctcctctgagcagcctcccacctactcacaggcactgctgagaccagcacccccacctcctccaagcagcccccccagccaccccaccgcagggagccatcctgcaaggggagtgcacacagaacccaggacaggcaccatctccggccctgcccactcccagccagcttcccctggcttctccaatggttgcagaacccccaactgtgcagggagtgaggccacattctggtccccctggccctagttcccagatgcacatacacctccttccatgggaggaggagtccagaggaggccctgggaaaagctcttttacaacccaacgatggagcaaaggttgcaaacggcacccatgagggtgcgggtgaggcctgcgggtgaggccagccggtgaagcgagccaggtagggcagggtgaaaccaccactcactccagccgatggctgctggaggaaacgcaagctcatggctgcctgatctctgttcaaaataagctaaaatctggcttattaacaggaatgctcctgattttaaaacgatggcaaataattaacattttaaaacaacatggtgccgtctaaatgaaccacacctgtggcccgagttcaggccacagccccccactccccccagaattcttcagaagctctgggctctaggtggggctcatgcaattccattggcagcagagaagctgccctccctggagagaggctccatcctgttgcagagctgaaatacagagcaggggattgcggggtgagcccttgaggggccccagggctaacagcctttgatcagggaactgtgccaccagggttcaacagaggcacacccccaccccacccatctccttccagcccctggttttcccctgtccctgcctgggtgggttataaatagccagggcgcatctgaagggccctttcagccacaattcctcatttggtgcgggcgggtgaggctgtggcgagggcttgggaacgaccaggcctggcattccccagggcacaagtatgccagctcagggcctggtaccacgggttcttctgtctcccgcccggcgggctccaagtgcatggcatgggctgcccacatgagtcagacctgcaggtgacacgaagaagggcctaaaaccccacaggcccctgctgtgttccttcctccactcaagaggacatgaggtgcccttggaagtctgccaggatatcctcgtccccgttccccacacctctacacggcatggtgagactgacgcccacttcttcccaaaatccctgaaccccacacaagtgactccctgagtatccagggcctctctactccaccctgtccccggtggctggaaattccagtgagtaatgagagtgcccctccatcagacacagactccactcacaggccctcggtgcccccctggaggggaagtgactcaccagtccccacagcttccctccccttccctgacaaatgccctgagccagccctggacctgagctccacactccatctgcctcggcctggctcctaatgttctccatagaagcagcctgcttcaaaggcccccccaaacggtttattccaaagccagaggcctccctctccgactctttggcctctgcagtctagagtttctccaagccctcagctgccctgttgatgcaggcactgccccgaccactctctggtgtaggctggcccttcattctcccgcctcctgtaaatgtggagtcacttgcttgggcccagcctcagccctctgctcccttcccccagagaagcagcccttctcccttccaggccagtggtggcccgctgccagctgcagccctggtgtcttgctgggctctaggtctagcacctgccccggccactgggtctcctcacttggaagcccagccacggcccttccactccacacatctggaccaaaggacccttcctccttctgaaacagcttccccttccgggtttccacttctgttagtgcggccgccatcttacgagtcttccttccctcaacccccacatcccttttaccaagtccttcggttcttcttttcctttgccaaagccaccaccccaccaagctttagagcctcttacacccacacgaccacacgtacttccccactttggctcctgatcttgtctgtccatctgtctgttcattcattcattcatacccagaaaaggcctggcatggcacacatacgaggctgggagacggggcccttgccgttctcaggctctcgatccgtctggggtgaggacgtgtgaacacacgaggcagtgttctcgtttaccagccaccctggggatggaggacagtggcactaacgctgcctgagagtgaaagcttcacaggacagtggcttctgagtagcatctggaaatagggaagggtttccaggcaaagaagagaaggcccgaaaggaaagggttaagcagcttcagcaacccggttgcagtggcgcacctgaaatctcaggtactcaggaggctgaggtgggaggatcgtttgagctcaagagttggaggctgcaatgagctatgatcgcaccactgcactccagcctgggcaacagagccagactctgtcttgagggagggagggagggaggaaggaaggaaggaagagaggaaggaaggcaggttaagaagcgctgcttgctagaggacagaagatgaacttggagaagtgggctgaacagcatcatggagggtgaggggcataagcacacaccacacctagctactgtttgaaatctttcgcagccactgagatttctgacaccatcaagtctaaatctcagtctccaatggttgactccccacagtcttcccccacacccaccctccattccctccttccctgacccaatcagcaagcatttgttaacgcctgacccaatcagcaagcatttgttaacgcctgacccaatcagcaagcatttgttaaccacctgacccaatcagcaagcatttgttaacgcctgacccaatcagcaagcagttgttaaccgcctgacccaatcagcaagcatttgttagccgcctgctgtgcaccaggcagtgtgctagcatcggaatgcagccatggacagggaaccccgtgcctaccctcgcggagctgacagtctcagggacagattgacctggtgactgactcccaaggcagtgtcaagggaggggcaaggccgtactggggaggggagcagtgtcagaactctgcagctgaggtgccacttttctggaagggataacatggaaacacctattgcgattttttttttttttttttttttttttgagacggagtctcgctctgtcacccaggctggagtgcagtggcatgatctcagctcactgcaacctccgcctcctcggttcaacccattctttcgcctcagcctcccaagtagctgggattacaggaacccgccaccaggcccggctaatttttgtatttttagtagagatggggtttcatcatgttggccaggctggtctcgaacccctgacctcaggtgatccacccgcctcggcctcccaaagggctgggattacaggtgtgagacacggcacctggcccactgcttatttttagattcgactttaaacgtcacctcctccagggagcctcccgtgactccccgttggctgcgtcagatgtgcccgctggtgccctcagagcccactctacgttcccaatcgtggcacttctattttaacttctttattttcctgttacatcactaacaattctaactctgtagacacacataataaagaaagagaaagtctcctctggttccctctgacagagggagcctctaagagttagttatacatttttccttatttgtgtccacgaataaactatacatataggccgggtgcagtggcttacgcctgaaatcccaacagttcgggaggccgaggcaggaggatcactcaagcccaggagtttgagaccagctgggcaacatggcaagacctcatctctataaaaattttaaaaaataattagctgagtgtggtggcatgctcttgtggtcccggcttcttgggaggctgaggcaggaggattgcttgggtcaggatattgaggctgcaatgaactgtgtttgtgctactgtgttccagactgggccacagagaaagaccctgtctcaaaaaaaaaaaaaaaattaggctgggcgcagtggctcacgcctttaatcccgcactttgggaggccgaggcaggtagatcacttgagttcaggagttcgtgaccagcctggtctacgtggtaaaaccctgtctctactaaaaatacaaaaattaaccaggaggggtggcacaggcctgtaatcccagctactctggaggatgaggcacaagaattccttgaatccgggaggcagtggttgcagtgagctgagatcacaccactgcactctagtctgggcgacagagcaagactctgtctcaaaaaaaaaaaaaaaaattatggccgggcgcagtggctcacacctgtaatcccagcactttgggaggctgaggcaggcagatcacctgaggtcaggagtttgagaccatcctggctaacacggtgaaaccccgtctctactaaaaatacaaaaattagctaggcgtggtggtggacgcctgtagtcccagctactcaggaggctgaggcaggagaatcgcttgaacccaggaggcggaggttgcagtgagccgagatcgcgccactgcactccagcctgggtgacagagagagactccgtctcaaaaaaaaaaagcagtggttagagatgctggtggggctggggaacagacaggagagagactatgtgaggcacaatgacatgagtttagtctggctggttcatgcattcattcagctaatatttactgagcacctactgtgtgccaggcacagttctcggcaccagagactgcaatgagcaagttttgttacaaaaccgacaaaatctctctctcgtgagagttcacaattctagcacggagttggtcctgaggccacagaggtaggcagggggtccaggggtcaggtcacacaaggccttgacagctgtgcaaagggaaggggggccccataggcgaagggaaggtgctggaggatttcaggacaggtgtgacaggacattcatcctgcatccctcctgctgacatcagatgactctttctaaaacactgctcactctatgcccagcaggaagccaccaagccagcccaaacaagagccgtggggccccagctgatgactcacccatctcactgttgacagtaacctctcaaagggcctggcacgttctcacttccaggcctttaacaacggcaggtcctcggcttgaagcactttctcccgcctcttggcttctccctggctctcccagctttcctggcagaaactcaagccccacctccagactgtatgaagctcagtagctcttcagccaatgggaactgacaccaaagggcaagtgccagggcagttgcagccactaactgcagccacagatgggactggattcgtcaccttccagatcaccttgctcctccctctgcctcctctctgttctagtacaggtcactccaaaatcatatacatagttcaactacataaagctaatgttggccagatgcagtggctcacgcctgtaatcccagcactttgggaggccgaggcgggcagatcacctgaggtcaggagatcaagaccagcctggccaacgtggtgaaaccccgtctctactaaaaatacaaaaaattagccaggcgtactggcgggtgcctgtaatccccgctactagggaggctgaggcagaagaatcacttgaaccccgggaggcggaagctgcagtgagccgagatcacaccactgcactccagcctgggtgacagaaggagactctgtctcaaaaaaataaaatacataggctgggcgaggtggctcacgcctgtaatcccagcactttgggaggccgaggcgggcggatcacctgaggttgggagttcaagaccagcctggccaacatgatgaaaccccatctctactaaaaatacaaaattagccggatgtggtggcctgtaatcccagctacttgggaggctgaggcaggagaatcacttgaacccaggaggcggaggctgcaatgagccgagattgcgccactggactccagcctgggtgacagagggagacgccatctcaaataaataaattacataaaataaaataaagctaatgttgaggagaagccggtacacaacactgtttatacagtgaaacaaataaactaaaacagaaagaaaactcccctgcactctggatgtgagccccagctctgcctcttgccaactgtgtgacctgggcatgtcatctagtctccctgtgcctccgtttcctcatctatagaatgggggtaattacggcatcaactctagggctgctagctagccagaagacggagatcccagacagggcgtgagagctgtgggatgagccaggccagccaggtgtggttcatcagggaagattaacagtatgcagaggtgagcaagatcccagccaggtgtgaatgtaggagggccagagaggacgggagccagcgatgacgggacccagggtcacaaccaaggcactagtctacctacttccgacttacctccttcccaactgggacaagcccaggagccaccctgagcctcagtgtcttcatctactaaacgggggcagccccatggctggaggacttgggtggcagggcagcccctgggctcctagcacagcacctggcacacgggagggtccagctcgtgtccttctctttgcagcagggacccaagatccaggaaggggagaaatgcaggggccggctgctggggggcggaggctgaaactcgaggagtccctgaaccacacaacccaggtccggagcagtcaggagggagtggagcaggcaccatctcaggagttcctggctgccatgccgcctcttcacgcacctaccagcaacctcgaatcccaagccctaagccttctgaagagaccaagaaagggaagaagaggctgcagttcttcccagcgttatccctgagcctgagtcctcccagcgttattgcctgagcctgagttcctcccagcgttatccctgagcctgagttcctcccagcgttatccctgagcctgagttcctcccagcgttatccctgagcctgagttcctcccagcgttatccctgagcctgagttctccccagctttatccctgagcctgagttctcccagcgttatccctgagcctgagttctccccagctttatccctgagcctgagttctccccagcgttatccctgagcctgagttcctcccagcgttatccctgagcctgagttcctcccagcgttatccctgagcctgagttctccccagctttatccctgagcctgagttctccccagctttatccctgagcctgagttctccccagctttatccctgagcctgagttctccccagctttatccctgagcctgagttctccccagctttatccctgagcctgagttctcccagcgttatccctgagcctgagttcctcccagcgttatccctgagcctgagtcctcccagcgttatccctgagcctgagtcctcccagcgttatccctgagcctgagtcctcccagcgttatccctgagcctgagtcctcccagcgttatccctgagcctgagttcttcccagcgttatccctgagcctgagttctcccagcgttatccctgagcctgagtcctcccagcgttatccctgagcctgagttctccccagctttatccctgagcctgagttcctcccagcgttatccctgagcctgagttcctcccagcgttatccctgagcctgagttcctcccagcgttatccctgagcctgagttcctcccagcgttatccctgagcctgagtcctcccagcgttatccctgagcctgagttctccccagctttatccctgagcctgagttcctcccagcgtcatccctgagcctgagttctccccagcgttatccctgagcctgagttctccccagcgttatccctgagcctgagttcctcccagcgttatccctgagcctgagttctccccagctttatccctgagcctgagttctccccagctttatccctgagcctgagttctccccagctttatccctgagcctgagttcctcccagcgttatccctgagcctgagttcctcccagcgttatccctgagcctgagttctccccagctttatccctgagcctgagttcctcccagcgttatccctgagcctgagttcctcccagcgttatccctgagcctgagttctccccagcgttatccctgagcctgagttctccccagcgttatccctgagcctgagttctccccagcgttatccctgagcctgagtcctcccagcgttattgcctgagcctgagttcctcccagcgttatccctgagcctgagttcctcccagcgttatccctgagcctgagttcctcccagcgttatccctgagcctgagttcctcccagcgttatccctgagcctgagttctccccagcgttatccctgagcctgagttctccccagctttatccctgagcctgagttcctcccagcgttatccctgagcctgagttctccccagcgttatccctgagcctgagtcctcccagcgttattgcctgagcctgagttcctcccagcgttatccctgagcctgagttcctcccagcgttatccctgagcctgagttcctcccagcgttatccctgagcctgagttcctcccagcgttatccctgagcctgagttcctcccagcgttatccctgagcctgagttctccccagctttatccctgagcctgagttctccccagctttatccctgagcctgagttctccccagctttatccctgagcctgagttctccccagctttatccctgagcctgagttcctcccagcgttatccctgagcctgagttcctcccagcgttatccctgagcctgagttctccccagctttatccctgagcctgagttctccccagcgtcatccctgagcctgagttcctcccagcgtcatccctgagcctgagttcctcccagcgtcatccctgagcctgagttctccccagcgttatccctgagcctgagttcctcccagcattatccctgagcctgagttcctcccagcgttatccctgagcctgagttctccccagcgttatccctgagcctgagttcctcccagcgttatccctgagcctgagttcctcccagcgttatccctgagcctgagttcctcccagcgttatccctgagcctgagttcctcccagcgttatccctgagcctgagttcttcccagcgttatccctgagcctgagttcctcccagcgttatccctgagcctgagttcttcccagcgttattgcctgagccttccttgctcctcccttcctcctgactgaacatcccagaactacttggttccattccacaaataccagttgagaacccctaggtgccaagaagcttccactggggtccacagagatgatcagggattaaggtcctgatctcacagggcggatgcaccccacaagtgaccgtgcacacctcccaaactgcagtaggatcagcggcggggtgggtgtgaaagcttcacaagggagggcgtgtgagcgggacctgacagcgctgtgcaggctctggcatcatagaaacccaagtttcaataacacgctgccccgctggctgcatggtcttggacaaacaataatattaatagctattattaagagatggagtcttgctctgtcacccaggcggggtacaatgcctattcgcaggcgtgatcctagcacctctcagcctccaactcctgggctcaagcgatcctcctgcctcagttccccttgtagatgggattatgggagtgaactaccatgcccagctaatcttaggcaaattacgtcacctctccgagccccagttttcacacctgtaatgtggagatggttatagcacctacctcatagagttgttggggctcttaaatgaaaccaacacgtgaaaggttcagcacaagcctctctaagcagctgtgatgagggggaggaggaggaagaggatgatagggacaatgatgatgatttttttttcctttttttctttttcttttgagatggcatctcactctgtccccctggctgctggagtgcaatggcgtgatctcagctcactgcaacctctgcccccactgggttctagcaattctcctgcctcagtctcccaagtagctgggattataggcacctgccaccacacccagctaattttttgtgtatgtttttagtagagacagggtttcaccatgctggccaggatggtcttgaactactgatctcaggtgatccacccacctcggcctcccaaagtgctgggatgacaggcgtgagccaccgcacccggccaatggtgaggatttcaattcgcctccacccttatctttgggttctcctgcaggctggagtctaatcccctgtttcgattttacattgacaaagcattctgccaaacaccatctcacagaaacctcacaacagctgtgaggtttgagccctgtgaggtcaggagggaggaaattctcagtgtcttcacactacagatgagcaaactgcagctctggtggggagtcatgagtgacacccctcaggccacacagtgagacagtggtagagtggggacaaaacccagttcttctctctgccttgtagcccctttttactaagcttcccaagaggcaagcagacagaggagtctgtggcctgtggggaggcgggttttctgtaagaccatggtcctgccttaggaacctacacccccacttgtcagctgagatgagtcctggccctttcttctcagagtgaaactgggcagtctccgctgaatggagccacccgtggtctgtgggcctggccctgccgtgctgccctgctcagcctggacttgggcagggtttatggggcagggcttcaggtttcaccctaatacctctgtgggatccatgtcttggggacacaaaagaagacaaaggcagagtgcaaggctgtggaagggcgtgctggggagagaggagcatgtcctgccaacaccgcagagacccggcttcacccggggccaccccatgtggcagaaaggaggttgattgcaaaagcaggttcggtcatggtgcagcagatattgatcagacttggtctttgcagtggtaatgctgttggctccccagccctctaaacctggcgagaaaagtcttgtgggccctggtggccaagggctgtgcactttggtgagccaggcctaatgctgcaggcctcccctcatgctgaaattccgcagcatcttcctgcagctgctcacagtgggatgggagctgagtccccccaggcagggctctgagccctgctgtggtctgagagctgctcacagtgggatgggagctgagtccccaaggcagggctctgagccctgctgtggtctgagagctgctcacagtgggatgggagctgagtcccccaggcagggctctgagccctgctgtggtctgagagctgctcacagtgggatgggagctgagtccccaaggcagggctctgagccctgctgtggtctgagagctgctcacagtgggatgggagctgagtcccccaggcagggctctgagccttgctgtggtctgagagctgctcacagtgggatgggagctgagtccccaaggcagggctctgagccctgctgtggtctgagagctgctcacagtggggcctcctccccactacctttcaggggagttagagctatctagagacaaggagactgaggctcagcggtatgaggacacttgcccaatgtctcacagctaaagagtagattttcttttattttcttgagatggagtctcgctttgtcacccaggctggagcgcagtggcaagatctcggctcgctgcaacttccacctcccaggttcaagtgattctcccgcctcagcctcctgagtagctgggattacaggcatgtgccaccacgcccggctaatttttgtatttttagtagagacagggtttcaccatgttggccaggctagtctcaaactcctgacctcaggtaatctggctgcctcagtctcccagagtgctgggattccaggcgtgagccaccgcgcccagcctgagagtaatagattttcatctgcgcaaagcttatctgctttccatcctgggtggctgaaggaataatagtatgacacttcattttctaggccaacctgactaggccacaaggtgtccagatacttgtccaaacattaatccggacatatttgtgaggcatttgggatgaggttgatatgtgtattggtggactgagtaaaaagactcctccccagtataggtgggcctcatccaatccactgaacacctgaatcaacaaaaaggcagaataagaggaagctcctctcgcctgactacctgagcgtgagctgggatgttggcctcctccagcctccagactcggactgaaacactggctcttcctgagcctcgagtccactggcttatgagctggaatttacatccctggctctcctagctctcaggcctttggacttggactggaaccaatattggctgtcctgggtctccagctattgactgcagagattaggacctctaagcctccataatcacctgaatcaattccttctaatacttttcttcgtatgtagatatagatacagataacgcacacgccctgttggttttgtttctctagagaacactgactaacacaaagactcaaccttgggcttcccgttggctgcatatttgggcgtggaaggcccagcgataaggcggtgccagaagccagatatctgaatatctacaacaattgtctgatttggtccagaagtcccccctgttcccaaggccccagcaggaagcctggtaggggaggggacctgtttggccaaataagcacagccaagccgcagaaacctcggtcttttattaatagtgtttttaaccaaaacatccccaagtactcaggaagaggcgtcagctccctccaggcaccccgtgtaaacagcaatccctgcagagtccactaggtggggccggtgacccagcggaaagggcagaaacgctccccgaggagggaaggcaggtgcgcggatgggacctttgcccggacgatccccaggctggacaagtgctccctactcctgccttgcgtggcttctagtcgatggtgtaaacatcaaccctgggggccacaagcactttagggggcagtcactctagcatctctggatttcaaggtcctcaagccaagtgagtccctcgtgagccaccaagcaagacgcacagccaccaagtcaagttctgccccgaagccccggagcgccaggcgggggcatctgtgcgtgacgcccgtgatctgtctcccgagagaaggcacctgccagcaccaaaggaatcggaaaatcgacggacacggaaaccagtcatggtggtcacgcgacaaggacagggcacagggacagggagcaaagagggaggtggcgcggggacaggcagcggcaaagaccctggccccacaccgggattccgcagcatcttcctgcagctgctcacagtggggtgagagctgagtccccccgggcggggctctgagccctgctgtggtttgagagctgaaggcagagatgggagcgagagtcttctcctcgttgctctcccctggttggcccccgttcaggtccctgaacacctgctctgcctccttgggttactatttgtaccctgagcccaatgcctccaggagaaccagggcaaaaaccctgcccccgcaggtccgagacgcttgtctctaacccgcctcccgtcttagggcaggtcaacaacacactgaccaaccccctcgccggcccccttgcctcccacctgccccccgccagcccttcccacaggtgcacgcctggactgccgctaaactcggcctcggcctctgttgccatggcagcaatgtggcttcccccaagtgggaagcccgttgccaaggcccttgttgccaaaggctataacagccaccccggtgtgtgaagaggggtgagagctctgtggggggtggagggtggccggcggggctggaaggagcagggggttctcaagaatgggagggttcaggcggcctcagctggggtgggggggcactagcccctggaggaagaagaggcagcccgtggcatctcagcgactgctcctctggggacgtcagaaggcaggacggagaccccctacaaaacacacccggacgagcaggaccaagcaaggatggggcactcccaccgcctcctgcaacacacaccccccacagaggaccggcttggattcttctcccccaccagctccaggcaaacaacccccagaacctctgttttgctcgttcatgtgtctccgacacgcacacacgagctgcgctcagacagcgtcagtccctgtcgccaggaacacgttaatgacaaggaccgcaaaccctccacagtttctatccctggcctgtctcagagcacatacttaatattccttctacaatgcttctctctggagcagaactcttgtctctgtcaacaaggagaggtggatgccatcagagtttgttcccttccagagtgaacagaggagggctggagcgggcagctcattgcacccacagggagcaccaggcccaggctggctttgcgggagcagcatctgaacacctggagcccacgggccacgcatgcagccactgcctggcctgggtgcagaggggaggagagcctggtcctctcctgggtcctctggaggagacaggctaacaggggaaagctgaaagaggcacggaggggtctgggaggcctggggagcagacggctagtagacggggagagacaggggcggcagcgttggcaaagcaggtggggagggaagcccgagcctgagaggggtccagggccaggacgagatgacgaggcaccaagaacggccaggtccaaacgtctccagtcccaatctctcgagaccaacccaagcagggcctggcccacgatgcccaggccttcccgtcacccctccccaaacccagaaagaaaagccggtgtacctaccccaggagccagtccctcaggtggagtcggggagacgccatcccccccgccctggctgcgggcgctgagctgcggggacatggtgggcgactcatcgatgtacggcatggtctctgagccctccgggggccccttctgctcctcattcccctctccgtcgtactcgtccgtcccgtagctgaagtctgagacaaggaacaagaaaggccactgagaatcctccaccagagctgccagggactggtagcgtagtgggcgccggcggcggcccccggcagccatggccccggccgcaccatccacgcctggcccgggcgggggctgtgcgggggcctgggcctggtgaggggcgggggagagccagcaggcaccgggccctgcccgctccggggctgctgggaggcggggaggagcggctctgctgttgctacccgatgaagagcatgtcagccgcgtatttcaagctgctgttttctttgccttctgcctaattccaagtgtaaaaattaacagtgggagcaagaggcaggacgcttccaactctcctctctgagtcaccattttgctttttatagggaataaggaggtggggggggccggtcgatgtcacttcctgtggccctcctccttgggtaccatttgtactgagcccactccctccaggggtccagggcaggttctggagtgtgggaggggagccctcagccctcagaacaaggccccgcacggaggacggagcccaaggcagcagggcgtgggcgaggaggctgtgcccaggcctggcagggacaggggctcacagcagactcctcggagccggtgcttatttctatcaccccagtgtgggcttccttcaaaggaggagggaaggaaaggcgaccgggaagttgagccgcattaaccccccagggctgccagcaccacttgggctccagagcccaggcacggagcccacccaccttgggaggggaggctgagccagtgcagcgagcggggtgtgcaggtcagcagctcagggcttcacattttccaaaagggttacgagggcggcctcggaaaggcccctgcgtccagccccaccagcatggctataggagggaccctcccacaaaccggcccctgccccttggcctgtttgctccccagctctgacccaccacgactggcaacggagaacgtggcagtgttgctcccgagggctgtggtggacctccttgggctggggccgccagcggggggtggacacccctctcacactcatcgcagagcaggggtaagcttcagcactcgtgcgggccagcgggagctggcaccgcagggcgtcctggagacacgaagatcaccgtgccggcagccttggggccagcaggagcctcctacgcaccggactgcccagtggcggcgtccgcttgttaaacctccccgggtatcttccgggcgggactccctggccaggcatcttcggatctcgcacagtgtgatgggggaggctggctgagcctgccctgccatctgcccagacatcctttcctccaggtcaccctccccatggcacctggccccctggcaccttagtgaatcctgcccctttgtccttgagcccctggggcaggaggtgagcatctgagtcatcactgtacgccagcacccacaaccccacctgtggcaggctctcggggaaagtgcgtggagcgaatgaatgagcagaggatcgcaccgtctgtctcaggtctgaggcttcagccaagtcccagccagccaagttctccacgggggccccagctcttccctcctctgtcacaacacaccagcccacaggcaaccagcagctggagaatggtgtcaacaggtcaccgggacgcctggccgtggccacactctgcccaatctggccttttggcagccgagcgcttcccctaggctcgctgcacctgcttctgtcggctgcctctcctcgtccctgagccaatgccccattcagctgccaggggacatggactagttttttccctagacagggttgtgtatgaagaaccacaggacccagggatgccccatcactgagatgagtgtacaccacacacccgggcaggacccagggatgccccatcactgagacgcgtgtacgccacgtacctgggcaggacccaggatgccctcccactgagatgtgtgtaggccacgcacctaggacataaggcccagtgccctggagaccatgacacttgtgtctgtggctgaagggatgtgaaatgactctggtccttccagggggaggaggaagaggcacagcggcacccagctggcctgagtctgggtccgtgaagggcctggccgtttggtgacaccccctcactctggagaagcacaggaggggatggaaggcagcctcccgccggcccctccctcctccctcctcctctccaggaggctccaggctgccctgttggtgcctggagtccagggaaaacaagcaatagtggaccgcggctttgcccacagtttagattccagccggccaagcagactctcctgtacactgaccaattcccaggggtcgcaggaatggaccccacacacttgggagatcgtccaagatcaacgggggggaagggacggtagggaaggtctctgccagtctccccacatgcacagttcatcctgatcagagcagaggaccacgggccctgccatcccctgctccttccagcctggatgttccgcggggaggcagttcttatttttcccaatttacatacaattgccgaagatcacaggatcagaacccaggtctcaaatgccctccctttccctctgaatctcactccaaagaagtccccttccatatccctcctggttaaggggggctgaccatggagctgaacgcagggggcctgaggacagggtgctggtgggcggaggcccaggggtggcgaaagggctcggcctgcgaacatttccagggccttcccctttcatttctgcccccacaaaaccatgagagcccaggagactccaaccaggaaaaggggtacagaaaagatggggaaaccaatcctcggagaaggcaggaaccctgggggaggaagatggggacctactgagcacaggcttcagtctccgacggccacaggtgggtatgctgagcagacagcggcttgggcaccagatctcaaaaaagaagaaaaggcagacaaggcaaaggctgctggcagccaatatccatttccccgctgactaacagaaatcctactgtattcggagcggcagtgcacccagcagctagttcaaagacacctttcctgatggtgtgagccatatgattacgttctagacaacaagatgttacagggatatgtgtggaacttgcaggaagctgctggaagagactgatttagccgaaaggtacactatccacactgcccttgttcctccttctgttgctggtttggagagttgatgggatggctggagccccagcagccatcctgaaccatgaggtgagctgaggatagaagccaccactgaagacagctgagcagaaagctgggagtccaggtcactgagggcacagtggagcccaccccaggaaggtctacctcgggacgttttcacaagctgggagtccaggtcactgagggcacagtggagcccaccccaggaaggtctacctcgggacgtttttacataaaagaaagaaaaagtgccaaatgcaatttgagcctctgttacttggtttttctattatctgcagtcaaacctaaggtaactgacccaggtgatcttccctgacgtccccgcttcggtgcttttcctctgactgtcaccgtccttctcaggctccttggtgaaatcttctttctctacccatcccttaaaaattgctgttcccatggaggggaacgtcacacactggggcctgttggagggtggagggcaaggggagggagagcattaggacaaatacctaatgcacgaggggcttaaaacctagatgacagggccaggcacaggggctcacgcctgtaatcccagcactgtgggaggccgaggcgggcggatcatctgaggtcaggagatcaagaccatactggccaatatggtgaagccatactggctacaaaaaaattagccaggcgtggtggttggcgcctgttgtcccagctacttaggaggctgaggcagaagaatggtgtggacccaggaggcggggcttgcagtgagctgagatcgcgacactgcactccagactgggcgacagatcaagactccgtctcaaaaaaacaaaaacaaaaacaagaacaaaaaaagattcatgcacttcagcaaatgttgggctccagtgagtgacatgctggagtgaagtgtacaactctctgcaacttactccgaaatacataaaaaataagatgggctgaacgcggtggctcacacctgtaatcccagcactttgggaggccgaggcaggtggatcacgaggttaagagttcaagaacagcctggccaacatggtgaaaccccctctctaccaaaaatacaaaaattagctgggtgcgatggcgggtgcctgtaatcccagcaacttgggaggctgaggcaggagaactgcttgaacccgggaggtgggggttgtgatgagctgagattgcaccattgcacgccagcctgggtgacagagtgagactctgtctcgaaacaaccaaccaaccaacaacaaaaaaaccaagatggaatgatgatgttcagagggatggaaagatggacagctgtgtgataaagcaagcgcataaaaatcatcactgggaacgttagacagcaggtgaatgggtgttcactgtgaattctttcaacttttctgtgtgcttacaattgttcatgataaaatggtggtggtggcagggactggtactcgccagcttccatcaacctcgcatcaccttcctctcccgaattgtgttcctgctcccggaagaagtcaggtctgcagactcctgggcatctccacctttaggagcctcaaacgcagccttttcccaaagaccacacacgtagggaacctgggagccattctagatgcctccacattcccgcccctcatctcctgcactgtgaggcatcccccctcctccccaccctcaccaactcttacaaggacaattccagcaccctccccacagcagccgggtcacaaatcagaccgtgttgccccccattcacttagggacacagccccgctcctcagctcaaggccctttgtggtctgcacctgctccacctctccagggtcctattctcctgccctgtgacatcggactccttctagctccctgcggtgggttcagtagtggcccccccacaaggtatgtccagattctaattcctgggacctgggaatgtgaccttatttggaaaacattctttgtagatgtgaataaatgaagggtctcaagatgagatcattgtcgattaaccgatgggtcctaaatccaatgctgtgtccctatggaaagagaaagggggaaaacacagacagaagagaagacagaggcaaggtttggactggggctgccaccaaccaaggaatgcctggagccaccagacactgaaagaggggagtaagtgggaactctgccccggcagcctggggaggggctgggactttgatttcagacttctggtcttcagactgcgagagcatcgatttctgctgttctaagccatcaagttcatggcaatctctaatggcagcattaagccacaaatgcagcgcctgacacgcacacagctctcccctttgcacaccaaatgcagtgcctgccacgcacacagctcgcccctttgcacaccaaatgcagtgcctgccacgcgcacagctcccccctctttgcacaccaaatgcagtgcctgccacgcgcacagctcccccctttgcacaccaaatgcagtgcctgccacgcacacagctcccccctctttgcacaccaaatgcagtgcctgccacgcacacagctcccccctttgcacaccaaatgcagtgcctgacacgcacacagctcccccctttgcacaccaaatgcagtgcctgacacgcacacagctcccccctttgcacaccaaatgcagtgcctgccacgcgcacagctcccccctctttgcacaccaaatgcagtgcctgccacacgcacagctcccccctttgcacaccaaatgcagtgcctgccacgcacagctcccccctctttgcacaccaaatgcagtgcctgccacgcacacagctcccccctttgcacaccaaatgcagtgcctgacacgcacacagctcccccctttgcacaccaaatgcagtgcctgacacgcacacagctcccccctttgcacaccaaatgcagtgcctgacacgcgcacagctcccccctttgcacaccaaatgcagtgcctgccacgcgcagagctcccccctctttgcacaccaaatgcagtgcctgccacgcgcacagctccccccctttgcacaccaaatgcagtgcctgccacgcgcacagctcccccctttgcacaccaaatgcagtgcctgccacgcgcacagctcccccctctttgcacaccaaatgcagtgcctgccacgcgcacagctcccccctctttgcacaccaaatgcagtgcctgccacgcgcacagctcccccctctttgcacaccaaatgcagtgcctgccacgcacacagctcccccctctttgcacacactgctcccgtgcctagaaaaccctccttgctgggcgcggtggctcacgcctgtcatcccatcactatgatgtggggcatcctccaaggcaggaggatcacttgagcccaggagtttgagaccagcctggccaacataaggagactctgtctctatgaacacacacacacacaaagacacgcacacacacacatacacatatatatatacctctccttaccccttgtccacctggtgaaatcctgttttgccctcaaatctgcctcatctgtgccctctcccaggaactttcctgtattctacatattatgataatacttgaataccgaaagcacttttttttttttttttgagatggagtctcgctctgtcacccaggctggaatgcattggcacgatctcagctcactgcaacctccacctgccaggttcaagcgattctcccgtctcagcctcccgagtagctgggattataggcatgcaccaccatgcctggctaattgttgtatttttagtagagacggggtttcaccgtgttagccgggatggtctccaactcctgaccttgtgatccacccacctcggcctcccaaagtgctgggattacaggcgtgagccaccacacctggccaataaagcacttttacaagccaatgagaaaagatgaaaacctcaactttctaaatgtgtaagggaaatgaacagaaaatttaaaagagaactacaaatattcaaaatgtattaaaaagaatgttaacctcatttgtaatgaaagaaaatgtaaagttctatatagttttcactgttcgtgtcaaattggcaaggattttaagataataataacaatatccagagctgtcagggcataggtactcacagaaactcttggaggctgcctataactggcacaactttggctgggcacagtggctcacgcctgtaaccccaggtctttgggaggccgaagtggacggatcacctgaggtcaggagttcgagaccaggctgacccacacggagaaaccccatctctactaaaatacaaaattagccaggcgtggtagcacatgcctataatcccagctacttgggaaggctgaggcaggataatcgcttgaacctgggaggtggaggttgcggtgagccaagatcacaacattgctctccagccttggcagcaagagcaaaactccgtctcgaaaaaaaaaaaaaaagttggcccaacttttctagagtcaatctggtaactggtatcaaaaggtttagtggttggtacagtttatacccagcgtaataagattatgatctatgatactagttataaatgaacataaaaataaagttgtaagtcacagggctgtctgtaagtgtgaaatattaaaaacaacctgaattatgagactggttgagtcaattatggtttttctacaagatgggctgctatatagcattaaaaactatatggatgatgaatagcatcttatcaagtgcaaaaagagattaataacaataattaaagtatgttacaatgtctgaaaaaagtaaaaacatacgtgcatagaaaaaagactggaaggctacaacacaaaatcattagagccttccgattctggaaattttgaaaaaattaatgtacggtctctgcgctctagggcactggcagacacccgacacccgtcttcccttcttccttgcttactctaccctcgttttctaggaagtggcaacagaccagtcccaggcaagatacccgctttctctgcctctctcattaccaggaacggctgccctacaccattctggccactgagacccaagtgaagcatgctgggacctctggcaaggccctgactttgatgattacaaagagacgttttgccttgaactcatgggtgatgattggagttacggtggctttactgctgccaccaggaacatgtcaagaaagaacagaggccgggcgcgtggctcatgcctgtcatcccagcaatttgggaggccaaggcgggcagatcacctgaggtcaggagttcgagaccagcctgggcaagatggtgaaaccccatctctacagaaactacaaaaattagccgggtggtgactcacgcctgtaatcccagcactttgggaggctgaggcaggtggatcacctgaggtcagaagtttgagaccagcctgctcaacatgatgaaaccccgtctgtactaaaaatacaaaaattagccaggtatggttgcacacacctgtaatcccagctacgcaggaggctgaggcaggagatcacttgaacccaggaggcagaggttgcagtgagctgagattgtagcactgcactccagccggggcaacagagcaagactccctctcaaaaaaataaaaattaattaattaaattaaattaaataaataaaagaacagagccatttccctcatgctgttcagctgagccacactaggaagagcctgtctcatttcctgctcatgggaaatacaagtccctatatattgggttttctgctgcttacaatgaacacatttccaaatgatatcctcacagcccagagaggaagcgagtccaatcagcaatcaaatctccgagatgctacgacagaggcctcaaaggcccggcaaggcagaccggagggtgtgggcaacacttggggaggggaggtggctggggaggctttggtgccacgctaaggaagacagttcatcgctgtggctgagagcagggaccctgcggtccggcagcggaggttccagcccacgctctggcacttcctaacctctctgtgcctccgaggagtgcctggcacagggcggctgctactaaatggatacgggtttagcaaatccgtgtgaaacgggggacgacacaggatcaagtgcacgggccgctgcgggggttaaactggatgacacgcatacagcacttagcacataggaagcacccaatccatctcagctgctattattaatgttattaattggatcttgaaagctgtgtgggtgcctgccaggcgggtgggggacaggagcagagtttcaggcggtgagaggaggcttggcagtggcacccagtgggaaacagcagggcccctggaggggactataaatagccaggagggctagaacacagagtgagcagagggggagagggccgtgctggagaggaggcagggacttgctcctgagagcctcgtgagctgagccgagagccgtgcaggactcagtgaggatgggtgacctggcccatgatcctctgcaggctcttgccggccacatcattgctgaatattgctaactttattttttattctttttctttttttcttttttttttttttttgagacagagtttcactcttgttgcccaggctggagcgacaccctccagcctgtcgcaagggtgatacagaggctgactgttaagtgataaacttattttctgcccaagaattgaggatgggaatgagagagggaagagcagctgagggagcccagccctgaccattattccaccaaagctgcatcaaaagtcttcagagaggccaggtgcggtgtctcacacctgtaatcccagcactgtgggaggctggagcaggcagatcaccggaggtcaggagtttgagaccagcctggtcaacatggtgaaagcctgtctctactaaaaatacaaaaatcagctgggcttggtggcaggtgcctgtaatcccagctattcggggggctgaggcaggagattcacttgaacccgggaggcggaggttgcagtgaggcaagattgggccactgcactccagcctgggtgacagagcaaggctctgtctcaaaaaaaataaacaaataaagtcaggtaatgtgattcttccagttttgttatttttgttttggttccatataaattttagcattttttttttctatttctgtgaagaataccattgtttgagcattattcctaaagtccctgggatattcagaatggtcagtgagcactggtttaaagtcacccctgcactggcccctaacactagagtcagcctgtccttctgtcctttgaaacttcgaagccaggcacggatcccttttctaggatgaaagtcctacatatgtcttcttccaatagaaggctgttttgtctacattgaaaatctgatctgttttgtttttgttttgtttggttttgttgttgttgtttgaaatagagtctggctctgttgcccaggctggagtgcaatggcgcgatctcagctcactgcaagctccacctcccaggttcaagtgattctcttgcctcagcctcctgagtagctgggattacagatgtgcaccaccaggcctggctgatttttgtatttttagtaaagacagggtttcaccatgtaggccaggctgatcttgaactcctgacctcaagtgatccacccacctcggcctcccacagtgctgggattacaggcgtgagccaccgcgcctggccaaaaatctgatgtttagtgcggtgaccttcctttacagtctttgctacatcttctgcacaactggccgcagcttctccatccgtacttgctgcttcactttgcctttttctgttatgaaagcggcttctttcctgacccctcatgaacaaatctctgccagcttcaaactttcctctgcagcttcctcacctctctcagccttcacagacttgcagagtgcgagggccttgctctggattgggctccggctcaggggaacgttgtggctggtttgatctttatccgaccactcaaactttctccatatcagcagtggggctgtttcccttatcattcttgtgttcactggagaagcactttgaatttccttaaaacacttttcctgtgtgttcacaatttggctaactggtaggagaggctccgcttccagcctatcttggctttcaacaagccttcctcactacactaaatcatttctttttttttctctctctctctctctcttccttctgtctctccctctttctttcttttctagacagtctctatcacccaggctggagtgcagcggcacaatctcagctcactgcaacctctgcctcccaggttcaagtgagtctcccacctcagactcctgagtagctggaattacaggcgcccgccaccacgcccggctaatttctctatttttagtagcgatggggtttcaccatgttggccaggctggtcttgaactcctgacctcgtgatctgcccgcctcggcctcccaaagtgctgggattacaggcgtgagccaccgagcccgggctaaactgaaccatttctagcttttgatttaaagtgacagacgcacacctcgaggccactgtagggttactcactggactaacttggatatttttgtgtctcggaatagggaggctggagcggggagaagagagaggctgggaaaggctggtgggcggaacagccagaacacacaacgttcatagatgaaggttgccgggtccggtctgtggtgcccaaaacaatgacaatgctaacatggaggatcgctgatcacagatcactgtaacaggtgtcataacaataaaaaagtctgaaagatcgtgagaaccaccaacacgtaacacagagagaatgcgaggtggccacacacttccaactggtgaaaaaaaacgcagcatctttgaagctcaactaagcatggaggtgccgtaaagcgaggtacgcctgcacatgagtgccgtaaagcaaggtacgcccgcatcacaggagtgccgtaaagcgaggtatgcctgcaccgcaggaggctatttactttaggttggagcaaaggtaatatataatggtaaaaaccacaattactttttttttttttttgagacggggtctcactctgtcacccaggctggagagcagtggcacaatttcggctcactgcaacctccgcctcctgggttcaagcaattctcctgcctcagcctcctgagtagctgggattacaggtgcccaccaccaacacccggctaatttttttttttttttagtagagatggggtttcagcatgttggccaggttggtctcaagctcctgacctcaggtgatccacccgcctcagcctcccaaagtgctgggattacaggtgtgacccaccacgtccagctctcaactacttttgcaccagcctaaatacaaagctcaagaacaggcgaaacaaatggatggtgatagaagtccatggcagtggctttctgggggtggacgacggggacagggagtgttggctgggaaggggcaggaagcaactttccaggacactgaagatgttccatatcttgatctgggtgttagttacacaagcagacatatggaaatattcaccaagctctatgcttaagactggtgcacttgaaaagcttttttttgttttttgatttttgttctttgttttttttagagacagagtctcgctctgttgcccaggctggagtgcagtggcacaaacatagctcattgcagcctcaaactcctgggctcagatgatccccctgcctcagcctcccaagtagctgagaccacaggcatgcacaaccatgcctggctgattcgaaaaagtttttgtagacacagggtcttgctatgtgggccgggctggtcttgaactcctggcctcaaagagtcctccactttggcctcccaaagtgctgggattataggcatgagccaccacactctgcctgaaaaacttcttaaaaatttaaaatctaagttgtactgttgcaggaaactgaggaccggagagaccgatatggagaagggaaggactgtttattttaggtatgcactagctcagtggatttgcatttaaaaagcttagcattgaataaagacagaatggggtttttataagcagacttcacaaaagtaaaacaaaagcagttaatcatatagtgcataacttgtggcttgtagctgtgtcaaaagaaaaacaaggactggctaaatccagacatttgtaaaaacagttatgcttaggaagccagggaaaggagtaacagtaaaggaatttctttcttttttccttcaaccttgctctaaaaggcgggtgtgtggagcccatttctttagccttggcttcttaaacagcgttatcttataactccttaaagtgagcttgctaggcagaaaaaaaaagaggttttttttgttcctttgttttttgttttttgagatggagtctcgctctgtcgcccaggctggagtgcagtggcgccatctcggctcactgcaagctccgcctcccgggttcaagccattctcctgcctcagcctcccgagtagctgggactacaggtgcctgccatcatgcccggctaatttttttgtatttttagtagagacagggtttcaccgtgttagccaagatggtctccatctcctgacctcgtgatccacccgcctcggcctcccaaaatgctgggattacaggcgtgagccaccgtgcccggcctgttttttttttctttttaacccttgccttgcctgttacttttcttggagtaaatacatacatatttgtttttaaatttctgcctccgtaccattatgactcatttacaatggaggaaatgaaagcgcagggagttaagttactcgcccaagatttcacggcagtcaggtgggaaaccagatggacacaggtcatccaaccccacaacctttgctcttaaaatgttatcatatgtaggactcatacaaataccaaacacgaagtgcgtgggctgccctgaggggttcatatggaagaaacaaccagtcacagagcgtgaggaaggaaaaggtccatttgcggcagggtatcagcgtgcagaatgggggcaggacgcaggaggttggccctgatgaacagactggtaccactgaagccgagctctggaggggtcagactgcagagggcctggaacactatcctgaatagtcagatttcacgcacgctgggagccacggatgccaaaatggcaaggtgatttcagaggtgacttcaggaaaacgaagctgactgtggtgcatgagatgatgtggaacggggcaaaccgcccctccgtgctttgtcaaaggtgaccatggtgggaaccaagggcaaagtctggcgatgggagagttgactgaaaatgcggccacagcagggtcctctgggcttggagggctgagcgatggacaggaagggggagctggttccgggggaacagaccctaagtccaggtggagacatgtctggactgagaagactcatggccatccctgtcagaagatccaacgggcagccagacagcagagtctggaccacaggtgtggatctgggaggccggcaaccctgaaccagggaactggccagcggaagcgaggctgccacttcccaggtgccacctgtaccagatcagcctgtccggggcaatttcagcagggatggtggctcagatacaaaatctaccacctcacctacaacaataaggacactgtcttctactgcactttattttattgatttatttatttttggagacgaagtctcaatctgtcacccaggctggagtgcagtggtgggatctcagctcactgcaacctccgcctcccaggttcaagcaattctcctgtctcagcctcccaagtagctgggatcacaggcacccgccaccatgcccggctaatttttgtatttttagtagagatggggtttcaccatgttggccaggctggtctcgaactcctgacctcaagtgatccgcccacctcggcttcccaaagtgctgagatgacaagtgtgagccaccgcgcccggccagtcttctattgcactgggaggcagaggttgcagtgagctgagatcgcaccacagcactccagcctgggtgacagagtgagactgtctcaaagaaacaagatgaggataacgataccatgtcacagggtggttgtgaaaatgacattaaataacatgatgtaggttaaagaactgggcacagtatcagggcagaagggtccttgggaaagctcagctgaagccgagtgggtgttgtaggcaacgggaaagtagacaccttcagggtccaggtgaccccagctgatccaggagatatttaataccatcgggagcccctcagtcagggcctggctccaaggggaggaatcctggaaaccagcatctttcccacgggacaagccacctccttctcagggccccccattctttgattgatggagcagaggttggggagccaggacagctcagtggtcaagggcagaggctttggaatcacactcgggttccattcctgagattagcacttcgggaatgtgaccttagccatgtgaccttgggcaagctacttagccattcagagcctcagttttctcatctctaaaatgaggataaaaacaagatctatacctcatgaagcttttgcgaggttacaatgaggaaatatatgctatgcaaggcacccaaagctggcgctaacaaaacggcagctattatcattattcccctgctctccttcctgagtaccaagaacccttagggacctcccagcccttaaaaaacaaaccagggctttggcaatttgcagtgagttaagactacagcaagctttgtcagctaactctgctgttcatcagtcagcctccattcagcacaggctggtggactagttacgacttaaattcttttttttttttggagacagagtcttgctctgtctcccacgctagagtacaatggcacaatcttggctcactgcaacctccacctccccggttcaagcaattctcctgcctcagtctcctgagtagctgggattacaggtgcccgccaccacgcccggataattttgtatttttagtagaggtagggtttcaccatgttagccaggatggtctcaaactcctgacctcaggtgatccacctgcctcggcctcccaaagtgctgggattacaggtgtgagccactgcgcccggccagttcatgacttgaatcctaagataactgttccaatcttcactgcacactggaatccctggggagttgggaagctctctggctcctaccccagggattgctactgaattggtatggaatggcctgggcatcaggcctgttaaaagctccccaggtgactctaatgtataggaaggccaagagccgccaggttcagacagggacactgaagtgagcgtctttacaaccaaatggaactaagactcttgctgggcacagtggctcacgcctgtcatcccagcactttgggaggccgaggcaggcggatcacctgaagtcgagagttcgagaccagcctggccaacatagagaaaccccgtctctactaaaaatataaaaattagccgggtatggtgacagatgtctgtaatcccagctactcggggggctgaggcaggagaatcgcttgaacccgggaggcggatgttgcagtgagctgagatcacaccattgcactccagcctgggcgataagagcgaaactccatctcaaaaaaaaaaaaaaaatactctgaagcagcctatgaagccatcagccaggcgcgtgatcaattcagccagcacagggaaggctgcccggaagaggcagggcttgtcctcagtcttggggactgtgggattcgctggggaagagaagacaagacggacggaaagggctttgctctgattgtgaaccacagacaggcaggggtgggtgggggtcggcccctgtctcattcactcaggaccctcggcctggcctgtagcagccactgggagcacagacagcgccaccctcaccccgaggcctggagcccctcattagcccagcaaagcggcaactggaggccgggcagaggctgtggggcagctcactcctgggaggaagctcactcctgggggacagctcgctcctgggggacagctcattcctggggacagctcgctcctgggggacagctcattcctggggggcagctcgctcctggggggcagctcgctcctgggggacagctcattcctgggggacagctcgctcctggggggcagctcgctcctgggggacagctcattcctggggggcagctcgctcctgggggacagctcgctcctgggggacagctcgctcctggggggcagctcgctcctgggggacagctcattcctgggggacagctcgctcctgggggacagctcgctcctgggggacagctcgctcctgggggacagctcattcctgggggacagctcgctcctgggggacagctcgctcctggggggcagctcgctcctgggggacagctcattcctgggggacagctcgctcctggggggcagctcattcctggggggcagctcgctcctggggggcagctcgctcctgggggacagctcgctcctgggggacagctgctgttgcaggagttgtttgctccggctctgcctccactgctgggaacagactcgaggccccaccatgggcgggtgttatggcctctctggttgccatggagatgaaatccaatcatccacctccaagatccttggaagagggaggcagagaccgtagccgcctggagaagtggccgcctggagaagctcagggctccacagcctgagacaaaggaatcatagttcttggacatcaagggcagaggctgaggcccagggtgtcagggtggccagcagccctgggcagagaagcgcatgtggcttcaccagtctccagctcttggggatggatgggacatgctgagtattatctgcgcagtgttttacacggtgagcccacggccaggatctcatttcatccccacagcccagggaggttgtcaaagtagctatgaatggccccctttgacacgggggaaaactgaggcttctgagtctcatccaaggccacctggctgagaaacagctgagccacagattaaagctactctttgcaccaaggccattgtttcctgcgatttgacaaaatccccccaccttggcagagggaactaaaattcctcatctctctgtaggaaagacagttatgtgcccaccgaacatagaggaatcatattgcagacgggccgtataaccttgccatgatacgacgaaagctgacggcatgtgtacgcaagcaacagccactcaacaaacatctcctaagctatcacacaccagatgcaggggcgggcacagactccagcacccccagctccgttacgagtcgcccatggaaaggcaacgggattcaacgaggtgggcatggggccaggaggcagatctgggtcccgcgtccagacctaatctctaggtgccgccacttccttatctgtaaaatgggcaagacacagctgccctgcgcagttcacagggctgcccctgtggagtgacaagagataccagataaaaagagcatttcacaaacaataacgcgttcagtcaatcaggcaaaaaaaaaaaagggggcaggggccaggctcagtggctcatgcctgcaatcccagcactttgggaggctgaggtgggtggatcacctgaggtcaggagttcgagaccagcctggtcaacatggtgaagccccgtctctactaaaaatacaaaaattagggctgggtgcagtggcttctgcctgtaatcccagcactttgggaggccggggcgggcagatcacctgaggtcaggagtttgagaccaacatggtgaaaccctatctctgctaaaaatacaaaaattagctgggtgtgtggcgggcccctgtaattccagctactcgggaggctgtggcaggagaatcacttgaacccaggaggtggaggttgcagtaggccagatggtgccacggcactccagcctgggtgacagagtgagactctgtctcaaaaaaaataaataaataaaaataaaggaaaaaaagaaagaaaataaatcctctacaaagaaagcaagtctgagttcgtttgggttatcggtatattctgtcttccccgcgaggtggtggccctcttctgctcactgcctgttatttgtggcgcccaggacaggactcacgcagagccaatgctcagtaactgctggctgagtgatacgatctcctaataatcctcctcatctcttcccataacaaccaattcaattatttagggtctgggggccaggaagtccttctgacaaatcccataggagttctaacccttattagagttaacagcttcagcctacttcctgcttcccctccgaacctcctcaagaattgataacaagtaataatcctgggctgatttgatttaaggctctgctcttcctcctgtctttccctgtgggaaatgccactcagccccagagctgcagaaggcgggtggccaggaggcgatgacctgggaggacctttcaatccaacggtgctcaccacctgcctgggatggcctcctcggagcccccctcccatctatggctttgtaagtccttagggtatttatgaaaaattaaatgacaatctagtgctgagaagtaggaagaggcaattcagagaacagacaagtaatgccaggtccagagaggccagcaagactctcaaagcagccctgcagggtggcagcagccaggaccaggatgcacgacccctgccttccaccccagggtgcccttcaatcccagagccacgcagctccgggctcctgcccctgtccgcagaagtcgcccaaggcgtccacttgcaccccttcacacatacacctgcagaagcagccgcacctctgcccagtgctgctgggtggccacgttcactggccttcggctcaaaatgctggctctccacccagagccttcctgggccttaaacataattctactgttgaactgggctgtcacagagtgcctcaaaagtcacctccttctccccactcccagctccagagcaccggtgactgtgacttccacttccaatgtcttgtgtcattcaaggagggcaggtaagaggacgtgcccaggttagcctcttccttggacattcgacgtcaccattcctccagagtggtgcaaagctaggtgtgcgcggagctggggaagggcaaaagcccagccagcttgtctctgcttgtttctatccacgcaggcacatggagacacacacacacacacacacacacacacacacacacacacacacacatcacatccttgtggccccaccacctctggcccccacactccattcagcccccggcctctctgctgccataagcaccctcctaccagcaagcacagccatcacttggaggctgtggtcctgagctctggcttccccaaaggtgaaacggaatgataggattgttgtggggattccatgagatgacgtctgtaaacagctcagcacagtgcggggcacatgaagatgaccatgattctgccacttcccctagaagtcagttacacccaagtcccttcagtgcccagacacctgccaccatgccaccactgccacatgacaccactgccaccactgccacatgccaccactgccaccaggccaccactgccacacgacaccactgccaccatgccaccactgccactactgccaccattgccacacgacaccactgccaccactgccacatgacaccactgccaccaggccaccactgccaccatgccaccactgccaccaggccaccactgccacacgacaccactgccaccaggccaccactgccaccactgccaccattgccacatgacaccactgccgccactgccaccatgacaccactgccctggccacagagcaggctcaagggccttcatccttcacataagccacctgccactatgtggtcaacacgaccagtgcccagcaatatccccatcctcctgtctttctgggcacatggaaggccgtactgtctggccacttggcagtccctgggcagggccaggtgctcagtcctggctaacaaactgtaagtggacatgacaagtatcatttcacggctgaacagtgaaaaattacacacagctctttctccctttctcctccctctgtgacccttggaggccacatattccaaatggtgcagtctccatcaggctgggtcccggcatgaccacggggagcagagccccccgtctaccaggaccactgtgagcaagcagcagcttgcttgtgttaagtgatgaggatttcagcagtaatttgtggggggttttggttgttttttttttttttgacacagagtctcactctgtcgcccagcctggagtgcagtggcacaatctcggctcactgcaacctctgcctcctgagttcaagtgagtctcctgcctcagcctcctgagtagctgggattacagtcacccactaccacactcagctaatttttatatttttagtagagatgggatttcccaatgttggccaggctggtctcaaactcctgacctcaggtgacccacccgcctcagcctcccaaagtgccgggattagtgtgagctaccacgcccggccttcagcattaatttggttctacggcatgaccggctaccctaacaccctgctcccactcagcccttccatgtatgctcagaaggccaaccccagcctcacggaagctccacacacacttcccaacacagcacctgacagtcctttctcctaaccccacccacgccagcctcatggcaagctgcagccgcccttttcccattcaggagagaagcagaaacccagcaccctcttctggggaaagacgggaaagcaaggtggaatgtcttccagcaagtaagtaagtgccaggagcaccaacggcttagtgttgggtagaagctggcacctgagggccacgccttcccagccagcatgatggccccaggctggtcaatgacccacccactctccccaggctggtcaatgggcccaccccacggtaagcttcaaggatggcctgcttgctgctgatgagtgaagtaagcccaaaggttgtcggggaaatacctgcattcctaagagcattattgacacttgccaaaaaacagaaacacctcaagtgtctatgggtggatgaatggatacacaaaacgcggcctttacataaaacggatattattcggcttatattccgacacaggccaattctgacatcgatgaaccttgggggcattaggctacgtgaaagaagctggtcacagaaaggcaaataccacatgattccactcggatgaggtgcttagagcagttagattcatcaagtcagaaagtaggagggtggtggccaggagctgggggctggagaaacggggagctgttgttcaatacaggggtccccagcccccccgggcatggaccggcaccagtccgtggcctgttgggaaccaggatgcacagccggaggtgagtggtgggtgagcaagcgtcaccccctgaaccccacttcccatccgagcagcagcggcattaggttctcgtaggagcgtgagccctgtcgtgatctgcgcgtgcgagggatcgcagttccatcccgaaagcgctccccacccttccccggtccgtggaaaaagtgtcttccacgaagccggtccctggtgcgctggtttcacagatgcggagtctcagtttagccaggtgagagttccggagatgacggtgctgatggccgcaccagagtgtgaacgtgcctcgggccactgatgcgtacactggatggaaaattttaggcatgtgtattttgccatgattttcttttgttttttgtttttgtttttgttttttttgagacagagtctcactctgtcacccaggctggagtgcagtggcgcgatctcggctcactgcaagctccgcctcccgggttcacgccattctcctgcctcagcctcccgagtagctgggacgacaggcgcccgtcaccacgcccggctaaatttttttgtatttttagtagagacggggtttcaccgtgttagccgggatggtctcgatctcctgacctcgtggtccacccacctcggcctcccaaagtgctgggattacaggcgtgagctacctagcgcccggcctattttgccataatttaaaaaaatagaataaaatctaaatttaaaaaaaaagtagacaggaaaggagtaataccagggacagagacccccccatgggtatcgacaggaggccagggggctgaaccaggcctggagcccacccagcttctgaagaggggttgggagtcaccttctgaattacaaaggaagatcccacctccagaattcatttctggttttagtttttttttttttttttgagacagaatctcactctgtcacccaggctggagtgcggtggtgtgatctcagcaacttccacctcccgggttcaagagattctcctgtctcagcctcccgagtaggtgggattacaggcatgcaccaccacacccagctaatttttgtatttttagtagagatggggtttcaccatgttggccagctggtctcgaactcctgacctcaggtgatctacccaccttagcctctcaaagtgctggggttacaggcgtgagccactgtgcccggcccagagctcatttctgttttgccgccaactccctggcacaagacgagctcagctcggccataggtaggggttgccgggcacctgtcagctccaaatgccaggagccaggctctccgaattccactcccagttttagctgtgtgtcctggggcaagttgcttcatctctctgtgctttagtgtcctcatttgtcaaatgaagataataacataacaacatcatcccatgcagcttttgtgacagttgaatgagttagtccaggcgaagttctaagaacagggcctggcacgtggtataacgttagtggctgttattgtcgtcactgacgttgtcactgctgttgtccctgttgttatgatttctccccatagtcccggcctgggagagacaccgagaggaaggccagcttgcccggtgtcttctcaagggctgacacacttctcaaagcgctgagattacagacgtgagccaccgcgcccggcctgtgtcagaattttttttgttacccacctgacaaagctcttcatcttgctaaagataacagagcacttggccaagccagcgcgatgtctgcactcagatctcctctctcatcttttgcccacaatgggaaaggaggtaagaagtctgtgttccgggtgtgctgagcacttgctgtgtgctgggagttgcggtagacactgtcctgtatgattccactctgaagaggtgctcagagcagtcagattcgtccagacacaaagaggagggtggtggccaggagctgcaagcagcggcacacgtgtgggcaatacacaggttgcccaagcgccgagagaggcccaggaggacgggccccgggcatggcaagcgcactgccccctctcactcctccggcggccgccgtccactcccagtcctagatctgagctccttcctgggagtccagggcccttcacaagtttgggtgaacaatcccggtacacggtctgtggtaacatcctgcacggctctaaaccagaggcaacagggcaccccacccactgggaaccacgcgagcagggagggacgaagggaggagcatcacgcacacagacgccggactccctaggttctgcaaacccagccatcaacacacagaggcccacgagcccattcctgagcctccctcccttgctgagctactggtgcgcgtatgtgtgcatatatatacacatgtgcacacacacactcctgggggtgaggaggtcacgtatgcaacttgctgtcatctttctaaaaggtaagaatggaggcaggagaacatttgattcagagctcatgctctgcagccagactgactgggtctgaatcacaggctccaccccttaccagctgtgtgaccttgggcaagtcacataacctctctgtgcctctgttttaccttcaacatggagtaacagtagcacccaagttcacagggtttctgtgaggatgaaacgagtaaacatctaaagcacaccgaagagaggattagttcctattaccacacctcagaagctcagcaagtcagatctcatgactgccaggctctcacagaggccctggttcccctctggctctacgtcttatttccctggaccagttccctaaagccctgtctgctgagaactcatctgacaattcatcctaatccctagagggccccaagcaaaaatcccaagctcagttcctgcacccaggctaggcttggtcagtgtccagccctgccctccccaactgcttcctgggcgtgacaccctcaacgcccccacctctctcattctgccatttagaaaccacaaagggcctcggtcagccactccccacctcaaagccgcgttcttccctgcggagagattgtcatggtttttccagcaagggatggacaagtgtgtttcttcacaggacatcctgagaatgcctgattctggggatggctgacatcctacagagccctggacaggaagcccaaggatttaggttgaaccctttttgggcaggtcacttcaactctctggctgcccgatccggctcttctgcaaaacaggaacatcactgcctcctccccaagtgagggagaggatacaatagaaagacaggacatccatcccggctaacacgaggaaactccgtctctactaaaaatacaaaaaagttagccgggcgtggtgatgagcgcctgtagtcccagcactttgggaggccgaagcaggtggatcacgaggtcaggagatcgagaccatcctggctaacacggggaaaccccgcctctactaaaaatacaaaaaagttagccaggcgtggtggtgagcacctgtagtcccagcactttgggaggccaaagcaggtggatcacgaggtcaggagatcgagaccatcctggctaacacggggaaaccccgtctctactaaaaatacaaaaaagttagctaggtgtggtggcaggtgcctgtagtcccatctactcgggaggctgaggcaggagaatggcgtgaacctagagcttgcagtgagccgagatcgcgccactgcactccagcctgggctacagagcgagactctgtctcaaaaaaaaaaaaaagacaggacaggctgggctggtggctgatgcctgtaatcccagcactttgggaggctgaggtgggtggatcacctgaggtcaggagtttgagaccagcctggtcaacatggggaaaccccatctctactaaaaatacaaaaaattagccgggcgtggtggtgcgtgcctgtaatctcagctactcgggaggctgaagcagaagaatcacttgagtccaggaggtggaagttacagtgagccgagatcgcgccactgcactccagcctggagaacaagagtgaaactctgtctcaaaaaaaaaaaaagacaggacagtgtctactacaactcccggcacacaacaagtgctcagcacacctggaacacagactttttacctcctttcccgttgtaggcaaaagatgagagaggagatctgaacccaggcattgcactggcttggccaagcgctctgttatctttagcaagatgatgagctttgtcacgtggttaacaaaaaaaattctgacacaggccgggcgcggtgggtcatgcctgtaatcccagcactttgggaggccaaggtgggtggatcacatgaggtcaggagtttgagaccagcctggccaacacagtgaaacctgtctctactgacaatacaaaattagccaggcatggtggtgcacgcctgtagtcccagctacttgggctgaggcaggagaatcgcctgaaccaatgagccgagattgcaccattgcactccagcctgagcaacaagagtgaaactccgttaaaaaaaaaatttttgacacagcctgggcaggtttaatcagctgtgatccagagccgccctctgttctgggagatggggaccagtctggacccctttcttgccccatcatcaggtgcacttggtcaaatccccaccataccccttcccccacaactaggcagaaggaccaaggaaggccccctgacactacatgggcctggcgtggccccctgtgtccctcagtcataccccccagcctggccaatgcccagatggcttttgggacagtgcccatcatgccccccagcagatggcacacctgcgggagggctggggatccaggcacacctgcgggagggctgggggtccaggcacacctgcgggagggctagggatccaggcacacctgcgggagggctgggggtccaggcacacctacgggagggctgggggtccaggcacacctgcggggagggctggggacccaggcacacctgcgggagggctgggggtccaggcacacctgcgggagggctggggacccaggcacacctgcgggagggctgggggtccaggcacacctacgggagggctgggggtccaggcacacctgcggggagggctggggacccaggcacacctgcgggagggctgggggtccaggcacacctgcgggagggctggggacccaggcacacctgcgggagggctgggggtccaggcacacctgcgggagggctgggggtccaggcacacctacgggagggctgggggtccaggcacacctacgggagggctggggacccaggcacacctgcgggagggctgggggtccaggcacacctgcgggagggctgggggtccaggcacacctgcgggagggctgggggtccaggcacacctgcgggagggctgggggtccaggcacacctacgggagggctgggtccaggtctaccgaacctgtcagcctgtcacacgcatcacatggtgagaaaacctcgcccggcaaccatctcatccttctcactggtttgaagcctggtggtcaccatagcaacaggctcccgctccagcctgccaggcggggctgatgcaattctcggcagcgagcagctccaactcagctcacatggctctgctcccactcgggggcgggcgcgtgggaggaccaacgaagagggaggaggtgggcacgcagcccacagaaatctcagcttcccccagttctgctccgaggactgggtctaagggacgagggccaggaactgagcagcgggttcacctcccaggtccttcatgatcctggtgtccctgccgcggctgccacttctgggagattcatctctaaggcctcaggggacctgggggatcgggagacaggctgtaccatggcgtctccaccaccacacggtcccctccccgcctgcaccccacaagctgggcacccccacttcccggggcccacgggcagcccggaccttcagaattcaacaggtgcagcttacagttcccgtcccgtggtgctgcctgccctggttgcattaaagtgctcataaagcccagaatcctcctgcaaaccaaaatatctccatggtgccggccagccccttcctcccagctttccatcccactccacaagggtgtctggctgccctggggagtgttacctcctctgcacggaaggcacactagctgagagcccgttcaagcatccacatcccccaatttcatggaacgagcacacagaaaggatgggggtcacctcgtcctgcctgcccgcccaccccccacacactgcggacacagggaaggaagccacaggacaagagcttggcaatgccgtgtcctcagggctccggcgcctacccatggatgtagtgctcgccctcccaaggccggtgtcctggtgacgatgccactagtgccaagaatgcttccctcctgcaggccccgctcccttccccattccagcagccacttcccaccctgcatttgttccctcctacctggccctcaccaaggcatccacccaatcctggcggggcctcagcacaaacagggcctgctctgggaccgtgcctcctgccaggacgctgtgccaggaggagggatctgcagatcccttcccgggcgccctgggggccagccagtcacactgggccctctctgtggtcgcctcgatgcctgtgggaagtgattagctctgaggccacttgagagatggtgttcagctctgggatgtcccagcaatgtgtactatgggagcctccaggatgactggagcagatgggcaaagaaggtaaactgtcaggctgggggcatctttccagacacacagatccacggagtcacgttgagtgagtccagaaaggaacccacatatctatggtcgacggattgtcaacaagggcaccaagacccttcatggggaaagaagaatcttttcaccaaatggtgctgggacaaccagattgccacatgtaaaagttgaacttttactttctaccatattcaaaaaataactctaaatggatcaaagacctaaatgtaacagctaaagctaaacaacatgtagaagaaaacctgggggtagatcttcatggtcttggacttggcaaaggattcttacatacgacaccagaagcacaagcaacagagagcacgggggaaccacacgtcatcaatgaacacttctttgcttcaaaggaccccatcaagaaagtgaaaagacaatgtgcagaggggaagaaaacatatctagactatattttaaaaatcttacaactcaacgataaaaagacatctaggccggccgcagtggctcacacctgcaatcccagcactttgggaggccgaggcgggcagatcacaaggtcaggagtttgagaccagcctaaccaacatagtaaaaccctgtctctactaaaactacaaaaattagccaggcatggtggcaggtgcctgtaatcccagctactcgggaggctgaggcaggaaaatccaggaggcggaggttgcagtgagccgagattgcgccattgcactccagcctgggcaaaagagcgaaattccgtctcaaaaaaaaaaaaaaaaaaaaaggatagggtggcaggtaggtgggtgaccagatcctgctggccatcgagggacaggagaggtgctcaccgtggagcacagtgtcctggtacccaggtggccccaggttcaactccaacactgtgatcctcaatgggggtgctgtggggacccaaattcagacacccatgcccaccagcctacaccagagggcagacgggtatctaaggggcacatgctgtggggaagagcctaggcctccggctgcagggggctcatgaggagccattctgaggactgagcctttgttgagagggaacctggggccaggtggctgctcccttcacatgggcgacagtgtccagtgagaaaataaacctcttttcatgtgaagaaaaaaaaaaggcctctcctgagttcctggctgggtagccgggtagacggcagagctaaatgctgtggtggctcacgcctgcaatgccagcacttcgggaggccgaggtggaaggatcacctgacgccaggagttcaagaccagcctggccaacgtggtgaaaactcgtctctactaaaaatacaaaaattagccagacgtggtggcgcacacctacaatcccagctacttgggaggttgaggcaggagaatcacctgaacccgggaggcggaggttgcagtgagtggagatcgtgccactgcactccagcctgggtgacagagagagactctgtctcaaaaagaaaaaaaaaaagctttatgtgcattatcttatgtaatcctcttaaccattacttggtgaatagtgagttccactactatccccatttcatagaggagtaaactgaggcacagggagatggactaacttgctcatagtcacgtagttacttaatggtgaggctgggatctgaatacaggcagcctgagaagtggctcttccgtccacctccaacctccttttagccgagggttttgagctcatttcaacacagccactgtgtccagggataccagcaaagaattagatcaatgtcaggctctgacgcacaggcaggctcagtaataacaacagtccacacacacatacgataagttaactcaccgcagcctcacaccgcgccaggaggcaggcactaatattatctcaattttacggatgaggaaaccgaagctcagataggtcagatgactggcccaaggtcacacagctgctgagtggcaaagcttggaacccgggcagtctggtctcagacactaccctctcttgctactaagtcagtcgtgctacagcgcacattactttttttttttttttttttgagatgaagtctcactctgtcgcccaggctggagtgcaaaggtgcaaccttagctcactgcaacctccacctcccgggttcaagtaattctcctgcctcagcctcccaaatagctgggattacaggtgtgcgccaccacgccgggctaatttttatatttttaatagagacagggtctcaccatgttggccaggctggtctcgaactcctgacctcatgtgatctgcctgcctcggcctcccaaagtgctgggattacaggcgtgagccaccgcgcccgacctcagtgcacacagttctaacatgcctagggggctggtccctcaggccacaggccatgagaagcagcaactacaagggaagagccgctgctggaacacgcccagcggaacagggggaagccaacaatcccggcagatgaaggaaaggaaccggcaggcacaccgctctcacgccaatgcgtgcggacagcctggtgggatcagcaggaccatgacctgagcctgcctgccaggcacagaacctcaggcgcacccaggcagacccacgatggggtgcactcagccccgtatcattcatgctgcaggtcagcctaggaagggatcgtgcagtttggtaggtcaccttctagaatggattgaaaaggattatctcgcctaataagggcaggtattactttatgaggctcatttcaagcgtgcatgggtatatgtgtgtgtgcagatgtacgtatgtgtgtcgcgttgcagcatgaaatgattttccactatggattctcttccaacaggtggaaggagcgtgaccacccctgagtaagccgccatttattcctgcaatggaattccaggcagctttgacggtgcacagtttagagctacaggcaggagcgaagatgaacctaaaaacataaatttaaccagaaaagggcagctcacaggaacatgcttacaatgtaattcttcttctttttattctttttttaaatttgtatttatttattttttttaaagtagagatggagtttcgccatgttgcccaggctggtctcaaactcctggactcaggcaatccagccgcctcggcctcccagactgctgggattacaggcgtgaaccaccgcgcccagccgtctcgttagtctttagtaaaccaaacccagacattgtatgtgctgttttgcatattgctacatttcacatataacacagaaaatggctgggtgcggtggctcacacctgtaatcccagcactttgggaggccgagacaggcagatcgcctgaggtcaggagttcaagaccagcttggccaacatgatgaaaccttgtctgtactaaaaatacaaaaattagccaggcgtgatggtgggcacctgtagtcccagctactcgggaggctgaggtaggagaattgcttgaacctgggagttggaagttgcaatgagccaagaccgtgccactgcactccagcctgggtgacagagcaagactctgtcttaaaaaaaaaaaaggaatcaaaagtgcgtagggctagtccaacccttacatttcacagctgaggacacagagggctggcatgggagtggcggaggtagaataaaaacccagatctcctgcctcccagtgcagccaaagccaccgttgtaaccacagcctaggattacccagagaaggctgaagcctgttcagactacagggagcctgtttgggactcacagtcctctggcgatgagcagagactcttcatgctttcgtgccttggacccacagcagcctggtgaagccaagggacctttctctgaagaatgttttgaaatgcgtaaaactaaactatgcaggatgacaaaggaaaccaactatattaaactactgtcttagtcatggaactctcaggagtccaagagaagtaggaatgcagtactcatacacaagagaagaatgcggtactcacatacaggagaagtaagaatgcggtactcacacacgggagaagtaggaatgcggtactcacacacgggagaggtaagaatgcggtactcacacacaagggaagtaagaatgcagtactcacgcacaagggaagtatgcggtactcacacacaggagaagtaagaatgcggtactcacacacgggagaagtaggaatgcggtactcacacacgggagaggtaagaatgcggtactcacacacaagggaagtaagaatgcagtactcacgcacaagggaagtatgcggtactcacacacaggagaagtaggaatgcggtactcacacacgggagaagtaggaatgcggtactcacacacgggagaagtaagaatgcggtactcacacacatgagaagtaagaatgcggtactcacgcacaagggaagtatgcggtactcacacacaggagaagtaagaatgcggtactcacacacaggagaagcaggaatgcggtactcacgcacaagggaagtatgcggtactcacacacaggagaagtaggaacgcagtactcacacacaggaagcactcagtaaaagccagtgacacttacgaccattaatcttcagaatcccttccacgtccttggtcgtgggtccacgatgctgaggagggaggcccagggacctgtgcctttgagtcagacctgtgggagcccctccagggcctgatctcggcgagggatgagggatgctggccctgaactgcaggcctcacacgtgacgctgccgccgcttggggaggtgccttctggagggaacaggtcccttggggctgagaggagagggacccacagcaggccctgcctggagacagggaggtagggcgcaggaggaaacacttacaccaataggagcagagccctggggtctagggccgctgtacctctcctctctggtacaaggttcaagaattgcttgaacccaggaggtggaggctgcagtgagctgagattacaccactgcactccagcctaggcgacagagcaagactctgtctcaaaaacaaaaaacaataacaaaaaaaaaccacacacacacacacacacacacacaaaaggactaacacagcctcttatgggccaggcactcacacattatttaagcaaagttcatgaaatgtcagctctgcaactgtacagtcagtaggaattacaccccaaattcagatgaggaaacaggctcaaagatgtaacagcttcatgcaaccagcattgacacctacgtctctctgactctaaggagaactgaatcccagtgaatgtccgttcattcatttttcattcattcattcactcaccaaacacttctcatggttcaggcactgttccaggtgccaggggtacgacggagcagcaaacagaccaaatgtctgccctgtggagctgagttcacacgacagccagacgccgagcgcgtacgaggctctggggagggaggcggcgcagatgactcagccagggccacccccgaggagctcacattcaggttaatggaggtgttgccattctctgttgaagaagtgggggaggacagacgtggcgcatctgagaacctattctaccgtgaattattaacacttttcacagaggccacgctccacaaagggaacttcagcgatacggaaatctcccaaggtgggacgcccgtgcggtggaggcaacgtcactccatcgagccttgctctctggccccgccacctgtacgagtgctgcagacggtgccttctgagggaagcgggcaggtgtcgctggaccgccctgcctgctaaatatctatgtggattcccgttccaaggacaccatcccttctcagggatacaaggctggggtgtctgagtctcatctccttcccagcacctatcctgggaaggttttgtcggaaatccccgtcacccacaagtccagtcttttttttttttctgagtctcatctccttcccagcacctatcctgggaaggttttgttggaaatccccgtcacccacaagtccagtcttttttttttttaagacaaggtctcattcctttgcccaggccagagtgcagaatgtgatcacagctcactgtaagctcaaactcctgggctcacatgatcctcccacctcagcctcccaagtagcttagactctaggggcattccaccacacctggctaattttttaaaattttttttgtagagacagggtcttgatatgttgcccggactggtcttgaactcttagtctcgagcaatcctcccatctctgcctcccaaagtgctaggataacaggtgtgagccaccgtgcccggtcaaagtcactatttttttttttttttttgagatgaggtctcactctgtagcccaggctggagtgcactggcatgatcttggctcattgcaatctccgcctccagggttcaaacaattctcctgcctcaacttctctagtagctaggattacaggcgtgtaccaccacacccagctaatttttgtatttttagtagagacagggtttcaccatgttggccaggctggtctcaaactcctgacctcaggtgatccacccgcctcgacctcccacagtgctgggatgacaggtgtgagccacagcgcccggccagaagtcactccttttacagccgggccgaaggcacctgttaggtcctctcccacccgctacaccactagctaatggtaatcatagcacccattcccctgggagccccaaaccagcccgggagatgcatttcactgcggaggctcattaagtgactctcccagtgctgcacggactttacatggggacgctgggttcgaatccaggctctgcaatgttgcaatttctctttcctttgccgacacatcctccagaggttagagactcccagcagaactgaggatgtgaaaagactcagttcgtggtgaggacccagtgagtgtttatcaacagcaacaattatcccttactctggcagagaacagcgccgtgaacacacgtcgccagcatccagcttctcagctgatttttacaacagccccaggacatacgtgggacaggcgtttatcaccctcactttgcagacaggagagactcggcaagaacagctgcacctagacacagcctggtttcctggcgtgggcccctccggatcccctctccctgcttctccatcctctcttccaccccagcaggagatgagaggaagacaagggcatgaggctgggatgtggtacccccagctccccactgtgggccacccgggctgtgcacgctcctgcccagaagccctcaccacatggcctctgcctccaggtctaggacacagaccctgccctcaccctgcccacatttccgtcatagctctccccgcactcctcagcctgagtgtggcatctgcttcctgacgggccctaatggatgtggctcacacctctcatcccagcactttgaaaggctaggccaagcacagtggctcacacctgtcatcccagcactttgaaaggctaggccaagcaccccggctcacacctgtcatcccagcactttgaaaggctaggccaagcacagtggctcacacctgtcatcccagcactttgggaggctgaggcaggtggatcacgaggtcaggagtttgaggccagcctggccaacatggtgaaaccccgtctctaataaaaatacaaaaattagctgggcttggtgctgggtgcctgtagtcccagctactcaggaggctgaggcaaaagaatcccttgaacccagaaggtggaggttgcagtgagccgagatcctgccattgcactccagcctgggcgacagagcgagactcaatctcaaaaaaaagaacatgaacattaatcttttgctccattaatttgtgcctctctgttctctcctgtaaactggagatgataagtatcttcttcatagactttgtgaagaataagggagttaatacagacaaagtgcctgcaacagtgtaggacacacagcaagcgctaggctaacgttagctattatcactggccactctgcatcaatcgcatcgtgattttttgtgtcgactctgtatcgaccctgtaaaagcaaaatctcaatgtttctgtgacaattccatagaaacttttcttcagcttggcctctaggagccagggggtggcacaaaagagagaagcaagtcacaagatgagcaagacgcatccaggtgggaccctggcgaagtgtcacacacagcactgaatccagacgcaggggccccagataaactgcaagacgcccagtgaacatggatgtcggagcatccaggtgggaccctggcaaagtgtcacacacagcactgaatccagacgcagggaccccagataaactgcaagacgcccagtgaacatggatgtcggagcatccaggtgggaccctggcaaagtgtcacacacagcactgaatccagacgcagggaccccagataaactgcaagacgcccagtgaacatggatgtcggagcatctaggtgggaccctggcaaagtgtcacacacagcactgaatccagacgcaggggccccagataaactgcaagacgcccagtgaacatggatgtcggagcatctaggtgggaccctggcaaagtgtcacacacagcactgaatccagacgcagggaccccagataaactgcaagacgcccagtgaacatggatgtcggagcatctaggtgggaccctggcgaagtgtcacacacagcactgaatccagacgcaggggccccagataaactgcaagacgcccagtgaacatggatgtcggagcatctaggtgggaccctggcaaagtgtcacacacagcactgaatccagacgcagggaccccagataaactgcaagacgcccagtgaacatggatgtcggagcatccaggtgggaccctggcaaagtgtcacacacagcactgaatccagacgcaggggccccagataaactgcaagacgcccagtgaacatggatgtcggaggatctaggtaggacggaccctggcaaagtgtcacacacagcactgaatccagacgcagggaccccagataaactgcaagacgcccagtgaacatggatgtcggagcatctaggtgggaccctggcaaagtgtcacacacagcactgaatccagacgcagggaccccagataaactgcaagacgcccagtgaacatggatgtcggagcatctaggtgggaccctggcaaagtgtcacacacagcactgaatccagactcagggaccccagataaactgcaagactcccagtgaacatgaacgtcaggtgagcaacagacaagctttcggtctacagataaaatgcaagacgcccagtgaacatgaacgtcgggtgagcaacagactagctttcagtctactatgtcctaagttttgtatgggatatacttacttttctttttttgagacagggtctcactctgttgcccaggctggagtgcagaggcatgatctcagctcactgaagcctcgacttccccagctcaagccatcctcccacctcagcctccgtaggagctgggactacaggtgtctgccaccactcccagctaattttttgtatttttattacagacaagttctctctatgttgcccaggctggtctcgagctcctggcctcaagtgatcctcctggcctcccaatatgcccagccatatgggatatacttatatttaaaaattattcattgttcatctaaaattctaatttaacggggcatccttatttttatttgctgaaaaactcagcagtgctttcagtgtggttggtaagattgttcccattctaaaggtgagaaaaacacagctcactagagcataaataacttgctggaggtcataggctaagcaggtgttcaaagaccaagctcccggcctgcagaggtgcctccacccagccgagcaacaggcctggggccacagaaccgggccctggagcgccttcccacaatccaaaaatgcccctcagtccctggaggggagcctgtgacccggaggagccattttctcccgggcagagggagctcctcacaagccagtgctgggggaagacctcctgcgggtggatggccgggaggaggtgcaagagagggctgcagtcagccagggtggcacccacagcccttccgggagccacccctgcctggcgctgggacctggagacaaaatgtccaggaggaaactcaggaagctccagaggaaacccctcaggaagtcctgaaatagttccacagcccagagtgaaaactttctttttttcttttttctgagacgaagttgtgctcttgttgcccaggctggagtgcaatggtgtgatctcagctcactgcaacctccgcctcccgggttcaagtgattctcctgcctcagcctcccgagtagctgggattacaggcatccaccaccacgcccagctaatttttgtatattttagtagagacggggtttcaccatgttaggcaagctggtctcgaactcatgacctcaggtgatcctcctgcctcagcctcccaaagtactgggattacaggcgtgggccaccatgtccagccccaaaacgaaaattttcaagtgagagcagccttgagggtgccatggtctctctgagtccagggcgtagacccccagtgcctggcagcttggcccggctcacagggccccctccccagagcccacgcagatgacctcagctcccaccccccggagtgtccgcacccaccctccccagcgcggtccccacctccgctctcccagagcccacgcagatggcctcagcccccgcccccggagtgtccgcacccaccctccccagcgtggtcccacctctgctctcccagagcccaaggtggagtttcacttcggtcattctcagctctatttttactcaaaggtggtaggaacaccacacgttcaaagcaggacaggcaagtcgtctgactccacgcggctgcaaggctgagcttttctgtgagcagggacgggggcaggctgcggccccatgcagggcttctctccagggccaagagtctaggtccagtgcccagtccccggtcctgatactcaagcaggtgacattcagcgtcctcttcacctggctgagaaagaccaacagcatccccaagcagaggaacagcacgtgcaaaaggcaccacactatgaatgggcgagtgttgtatcctgggaaaccgggagaggctcagtgtggccggaggcccgggggtgtggcagtggggccaggaggggaggctgcggctggagatgggttggacccagtctctgagaaggctcccacgttgtgctaaggagtttagagtttatcctgcaggaaggagggagctacgaaggcttggagggcagatgctgcaggcgcctggtccttcccatccagtgtgggcagcgcgggcctcacctgggacttgctagaaatgcagaatccaggccgggcgcaggggctcacgcctgtaatcccagcactttgggaggccgaggcgggcggatcacctgaggtcaggagtttgagaccagcctggccaacatggtgtaaccctgtctctactaaaaatacagaaacattagctgggcatggtggcacgcgcctgtagtcccagctacttgggaggctgaggcaggagaatcgcttgaactgggaggcagaggctgcagtgagagctgagatcgcgccactgcactccagcctgggtgacagagccagactctgtctcaaaaacaacaaacaagcaaacaaaggaaatgcagaatctgagctccggacctgccaaatcaaaatgtgcatgtccatcatggcacgggggctgggggaccccgtgataccccagtgatttatcttctcggggtgaggcaaagccttgagctctggctgggcggagagagaggccaccagttggatgtctccagtatccccttctgatggcccttctgccctcctaacacccagctccacctcctgcttggatcctccctgctccaggactctccggggcatccccagtgctggatccagacacccagagccctagagcacttcgtctcttcatagccacccccaactccaaccaatcacaaagcagcatcttcatagccacccctgactccaaccaatcacaaagcagcatttcccagggttccacctgctcggtgcctagctgggtgttgcggggaagggagaaccaccatggtgaaaggctggtcccccgagcggagggagtaagccgaggagcttttcagacatgcagaggcctgggccccaacctgaggtctcatgccccaggccctggcattgggcgcttctggcaaagaacacaggctgaggcgtcaagacagatgtgttgtgtgacctctgggaagtcttggggaagcatgaaacaggataaaaatggctaagaactcagcaggttgccggaggctaaatgagatactgttagcaaagcagagaggacaatgtctggcatcctatcacggaagcctttgttattctccctcgtgcctctaaggagttgagagtctggcagagaagaaatgacaactggcatgaaacactgtgcaggtaaacactataaaacaacacgatatcggccgggcgggtcgctcacgcctgtaatcccagcactttgggaggccgaggcggacagatcacttgaggtcaggagttcaaagcagcctggccaacatggtgaaaccccgtctctactaaaaatacaaaaattagccgggcgtggtggcgcacgcctgtaatcccagcactttgggaggccgaggtgggcagataacctgaggtcgggagttcgagaccagcctgaccaatatagagaaatcccgtctctactaaaaatacaaaattagccgggcatggtggcgcacacctgtaatcccagctactcgggaggctgaggcaggagaatcactggaacccgggaggtggaagttgcagtgagcactgcagaggttgtggagattgcaccattgcactccagcctgggcgacaagagcgagactctgtctcaaaaaaaaagataagaaagtgctaagcgatgtgagccggagcaatcagcattagggactctgagccagggatctcactaaggccagtgctcgaatcaggcctggaggacttcctggagatggtggtagctgagctgaggcttgaagctggttagatccttggagcacagagctttgcaggatggtgagaggccttactggctagagaatgggcagtgtgctgggaaactggaatggataacaagaggttcccccagtctggactgaatgtggtgggaaaggcaatgccccactgaacccactgaaggtttctgggcaaaggagagaaaatggtctagcacagccacaggcagttggaaagggaacagtgtccttcactcagggaggggcttgaggacagacacggcaggcacccacaacaagggcctggctgtgctggcagctgaccagctgcagcaaggtcctccggctagaagcagcagctctcctgacagccaatgtgcgttccatcctttcttcccagggagcaggagaccgaatcagctcctgcctttggtttctgaagattctacacccaaagatggcacttggtgccccagctcatccaggcctcccaagggggaacgtgggtcaggagctgccacggggtctgcaagacgcttgctggcctcgaccaagtcaaggtggctgttccacgcggctgggtggacgccagctggtctctcatgaccctccccgtgacgcactcgcaaagtaactaccaaggctttctgctccattaacaccaaagctggccctgcaggggaaagaggagggagggaggacgtgggttttgtctagacagaggcactcacaaagccagatgatgcctgagcttccgccacgcaggaagagggtgagcagaggagggcagagaagacctggtgcgtccccctcagggtgccccccatggcagaagtcaccagcagaggccaagaacaatggccaatcccccttcttatccttaaaatcagggtaacaacctttcataggtttactgtgaagatgaaatgagatcacgaatgtgagaacgctcgctctactcttgcacccgtgaggtgtccaatcaattgctttgttacttttattcctattgggaaatgggctcaaaagatctgtgtcaggggttacctttcatctggccagaatccagagctacagaagggtctggcttgatttgaagtcccagccaaagggggctccgctaaggtgtaagccccccagacacaggccttccccaggggctgacctctccgtgggggactctctgggctcgagggccgtcgtgggtgtgagcctgggtctggagggtctgccccgtcattaacatgctgcgcgcgggagagttcaaacacagcagctggctctgcagcccagcaggccctgggcctcggcaaaggacctcgatgctcagtggcctgatttatggctgagggctctctttattttccttttgaaatgtggaggtggattttaaaaggctggagagcagggccagcacgcttgggctctgccaaatccccgcgtcctcgcccctggcctcgctctagaaactgggcactggccctgctccatcccaaccgccaaagtctattctcactctccctttctctgtgtttgtgtttgtatgggggggtgtgtttgtgtttgtgtttgtgtgtgtgtgtgtggggggggggtgtgtttgtgtatgttaacaatcagcacttcttgccaataattccaggaacacagcaatgcaggcacgtgggctccaagtgcccatgaggagacctccttaggctcatgcccctaggaagaggcagcccagttggtggatgctcccagtgcttccaggatgcctggggcagagggctgtctcctcatatcacgggggcttgggggcaagacgcagtcttcacaactgtctttctagctagagaaatgaacccagatccatcaacctcagtgaaataccagcgtcaaggagcccccaccagcaccgctgtgaagggtaagagtgcgggagaaagaacacagtttacagcagggccaaccgagcgcacagtccctggcttgtagtctgcgaccttgaattaattaatttagtttgtttatgtatttatttatttattttgagatggagtctcattctgtcgcccaggctggagtgcaacagcgtgatctcaggtcactacaacctccgcctcccggattcaagcaattctcctacctcagcctcccgagtagctgggattctaggtgcctgccaccatgcctggctaatttttgtattttagtagaaacggggtttcatcatgttggtcaggctggtctccaactcctgacctcaggtgatccacccacctcggcctcccaaagtgctgggattacaggcgtgagccaccgtgcctggcctgtctcttccattctttctaaaccaaattaaaaactagtttctatgaatccatcaggactgatggactttcttttcacgggaccccaggatcctgggagacccaaggatgaggtttctatctatgtccctctacagaacccagacacagttcccaaagaggctcccgtgggcgccattgcacagaacaactgcagggggcactcttgcatagcacacactgccacgctgaccccacaactcccagaggggtctctctcctaaaacttcaccttcaatagcacacactgccacgccgactctacaactcccagagggatctttctcctaaaactttgcctccaagggagagactccctcaaaaagatgacgtatgggctgtttaggcccgaggtaacgcgaacggggtaaccacaagtgacgaagtcaattgcggctgtgaggagtagatgttcccagccagagaaataactggcttaattacacggcgtctttggtccccgtaatctcgatccattaaacctttgctgctgaccaggagccgctgcccaggaggaaggggttagcccagaacactcacagaagcagcccttcaatcccacgaaggtaatgatggccacatccttccccaacagccccgagtaagcccacagatccctgctcaataccaggcttctctaggcagcaccagctccaccgatgccccggggagtccagcagccaagctgcccggagtgacaaggactctgagcttccttggctctggtttacctgaggcctcccagccacccaagacttcctggagaccctgctagccttaggcaagatgcccaatcacgtgtgccatgtccacctgtgacctagaggcacaccaaggcatcagaggtgagggcagggacaagaaggaggtgagtgaggccaggcacggtggctcacgcctgtaatcccagcactttgggaggccgaggtgggcggatcacctgaggtcaggagttcgagaccagcctgatcaacatggagaaatcccttctctactaaaaatacaaaattagccgggcgtggtggcagcacctgtaatcccagctactcgggaggctgaggcaggagaactgcttgaacccgggaggcggaggttgcagtgagccgagatcgcaccactgcactccagcctgggcaacgagagtgaaaatctgtctcaaaaaaatgaagaaagaggggagtggcacccgattaatcaatcaggtcaccacagagccgaccacatctggctctatctactgaagcccaggctgactctgacattttccatacagccagtaaacccagattcatctttcggtctagtgtgtgtggggaggaaggaagggcaggaggaggacacaggataaagcctggacaaaaaactgggcgagaggccccagtcaggtctcgacccggggacagagaacccgctgctccatccacaagtggccacggcctcagatggtcccgcctcaaagggctctttgccaaatgcccaggcaggggtgggattgggcattatcttcagcctccatacgggggtgccttccgtagcctgcctattggcctgatttctttctccttcccccttcacaaggtctctgggtcaggttctcctcaagcttcagggaccagtggaacattcccgctgctcccagcagcgtcatgtccccaactgaccatatcttgccctaagaaatgcaagctactcctgggccgggcacggtggctcacacctgtcatcccagcactttgggaggccgagatgggtggatcacgaggtcacgagatcgagaccatcctggccaacatggtgaaaccccgtctctactaaaaatacaaaaattagctgggtgtggtggcacatgcctgtaatcccagctactcaggaggctgaggcaggagaatcgcttgaacccaggaggtggaggttgcagtggagccgagattgccccactgcactccagcctgggtgacagagcaagactccatctcaaaaaaaaaagaaaagaaaagcaagctactccccacagcagcaatggactttctcacatgtggggacaagccaaggtcacatgtcacaaacagcctcccctatcacagccccagagatgggtgagctgcagaactctccccctggtacaaacagtcacttggagaaaagtgccaagaatatagaacagagcaggtaatccaccccccccatcacctcagcccacccaacacatcacctcagtccacccaacacatcacctcagtccacccaacacatcacctcagcccacccaacacatcacctcagtccacccaacacatcacctcagtccaccccccccatcatctcagcccacccaacacatcacctcagtccaccccccacacatcacctcagtccaccccccacacatcacctcagtccacccaacacatcacctcagtcaacgcaacacatcacctcagtccactcaacacatcacctcagcccacccaacacatcacctcagcccacccaacacatcacctcagcccacccaacacatcacctcagtccaccccccccatcacctcagcccacccaacacatcacctcagtccactcaacacatcacctcagcccaccccccacacatcaccaacacccgccaccaccaagggcctggcaggggcagtgggcgcagggttgtcttgaagccgcctgccctaggtttgcgcccaaagggctcaagctcagccaaacagctgccgccaacgctggcagtgaagtcctccaatcataaaccctggcaaaagcgcgagactccctttgggggtctctgactccactacgagcgagtacaatgaccaaatccacacagccggaaacgcatggacgggccagctgacaggtttcagctaacaggggtttctgctgcggggaggagctcaaggagccaagaactcgagttttctttttcccacccgtactcagacaaccaacacctatggagggcctgtgcgggagccgctgtgggaggcgctgcctcagagctggtctgataccctgttcctgccggtcctcctgccacattccctgccccttcctaagtcctgtgccggcctctcccagtccctcgaggctttcccggatgaggagcgcaatgagctggacagctgagctgctcaatagctctcctcaccttcaaagcactttataaatatgaattaatccacacaacacccacgagagccatcatgccctccctctacgaaggaaggtaccggaattgtcccagaaagcagatcatacctcagacagagaacaagtcttccatcctactcgcaagagtgaggcagagcctccccgccattccccatcttccatcctcctaacagcatcttccagccaattccccacaaatttccttccttttcccgaagaacaacagtagccaacaatcacaaccacagaaacctaagtttctctgagtagatgacttaattcttctgccagccccacctctgagactccagcagccatgaagattatgggccggtgttgacaaaaaggaataaattactgggctattccgaaaacaagcaagcatctgccagcaggcgctcactagcacacacggaggggtctgatgcggccccgagaactgaactgctctgatcaaacgcacacaggctgtcagaccagtggcttggtccctggtgtagagaatgtggggctcagatgagaaactgaggtaggctcatgctcacctggagacaggcttacatctccactgctccaaatactttcctggcccatagatggggcactgaatctataaagggcatgaaaatatcacaagagaatgaaatcgcccttggaaatgttgcttggggtaagagaagtgagctccaaaaagcaggctctagtaacaacagatggtcacgttctgccttccatgacggccaagccactgcaggctcttgcttggctcagcagggaaggtatgtttgacaccaggactaaattacttgggaccaaatggaggccgaagtggcaaagggagaggctttaaatacagcctctgcctctcctctaagtaagtcctaaacacacatataaagattttccagttgaagaggtgccagatgatcaacctgcctggggcacacgtatgtcttgatccagatctgcttggagaatcccagggaccaagaaagtgtcagagcacacctccacccccattttgggctactccgctcccatttaatccaatctaatcccatgggattgggaaaataaaaataaaaaaataaaataaaaaaataacaaagagaagatgatacgtgtttagcagaaagggtgattaaagacctagaggcattatgaccaagaaaacatggccgggcgcaggggctcacgcctgtcatcccagcactttgggaagccgaggcgggtggatcacctgaggtcaggagttggaggccagcctggccaacatggtgaaaccccgtctctactaaaaatataaaaattagccgggtgtggtggcgggcacctgtaatcccagctactcaggaggctgaggcaggagaatcgcttgaaccggggaggcggaggttgcagtgagccgagatcgcaccgccgcactccagcctgggcgagagagcgagactctgtctcaaaaaaaagagagcctcagagagagcatcatagcaaccccagggagagaaaggtaaggtactgaggggtgaaactgacattgctacattaatacaggcaaatgagtggcgcagacacaagaactgggggatgtctgaaaccatctgtcactccacagggaaaggactctgctcccatcagccccagggcccctggcagctgggatccaactcttctccttgaggcagacaaatcacacttaccgcagcccttcaggacttctaccataggagagatggagggtttgctgcccaaccctcatcaaatgaccaccaaacctgtgatggaagtgggcacactcctcctgtcaaaaccagaaagaatgaactgccaaccccaaaggcaggaagtgtgttcagggccgggcgcggtggctcacgcctgtaatcccagcactttgggaggccgaggcgggtggatcacgaggtcaggagatcgagaccatcctggccaacacggtgaaaccccgtctctactaaaaacacaaaaaattagccgggcgtggtggcgggcgcctgcagtcccagctactcgggaggctgaggcaggagaatggcgtgaacctgggaggtggagcttgcagcgagctgagatagtgccactgcactccagctccagcctgggtgaaagagcgagactccgtgtcaaaaaaaaaaaagaagtgtgtgaggggaggggctggctggcaggctggcaccttaggagcagagagccaccagcctcagtgggttcagacagcctcagctgtccctgcctgggctccaggcccagcccccaggtcctgcaagaggcacagggccaggttggggtcagagccattgaagccatttaccctgctggaccgtttcagggagaactctgcaacagaggaccatagagaatggcgtcccccattccgtgacatcccaagaccttgaataaactcagacatacccaggtggtactcgggatcctcctcattattctagggtacaacctgaattccagctcagccatttgttacttatgtgatcttaggtctatgatttatgctaactgagcctcactttcctactctgtaagagttgcagagttgtgagatttggagagaatggatagaaagtgcctagcacaggccgggcgcagtggctcacgccagtaatcccagcactttgggaggccaaggtgggaagatcacctgaggtcaggagttcgagaccagcctgaccaatatggtgaaaccccatctctactaaaaatacaaaacttagctgggttgtggtggcaggcgcccataatcccagctactcaggaggctgaggcaggggaactgcttgaatccaggaggtggaggttgcagtgagccaagatcgcaccactgcactccagcctgggcaaagacggagaccccgtctcaaaacaaaacaaaaaacaaaaaacaaaaaaaaaaaagaaaaaagaaagaaagagaaagtgactatcccagtgcctgccatacagtaggtgctcaggagacgctattatcattgttaccaggaacaatgctcagagagaggaaggcagggaacctctaacaccgagtcattcccatctctaagtcacactgccaccctgtgccctgggtataccccctttacagttcccgatggatctggcatttgtggagatttgtcaccccaggactgtgagccttgtaagcaaacagcttcctgagaagcagaggaacttcctctgggagccacaaaaccttgctgccaggcaaatgacagctcgggtatttgttttaatttaggctcttgtcaagaggaaagttgatggctaacagcccaaacatgactgcacagcacctccccgggaagcctcctgctacagctctccactaagctgttccgaagagggaggcagggactcctcacactgcggccacatcagtgccccctcccacccaccatccaggccaccccaggagccgcccagaggccagggcagcagcaggagggtagacagctcaggtgccaatctgcctgaatcagggctgcccaacagaaccccctaagaggccttggcctaattcccttttctggcattcctctggtcaggaattttcaaggtggcctcaggcaattttgcttttttgctccaggcgtgggaggaagagggtggggtatggaagacttggaaatgatcagctcagaggagtcttctgctgcagagaaagctagagacagggttccatacgattccaggcttcgggaaatagggaaacaagaactgggttttgcaaagagccagaaacactcaggaacataagcacgcgtgaatctgaggcattgttatgacggctgtttgcaagcacacagctaagagagggccactaatcctgcctccgggtcaggagctgatctgcatctgcgctccgaacagatgtgtgcccccattcatgcagacgcacgtgcacgcacatgccacacagccatgggccctgaccttcacccaacgacgctggcctctgcaggggaaggagcagatggagcggcggcacctggcacaggacctatgcccaggggatccggctttgcccctttgatgttgagaaaccaaagcagaatgaaccatcacaaggacagctcctggggggaggagaggaaggaacatggatggaggaggaggcgggtggagaagaagatacagggaatgacctggacccaaggggatgctgaggtcagaggttgaatgttgggtaccacacagcctccagagtaaggctttggggctcaaggcatcacccttctctactccccccaccccccccatatgacttatcaaggaactctagctgggatgacccttacaaatgcccttgttggctcacgcctgtaatcccagcactttgggaggctgaggcaggtggatcacctgaggtcaggagtttgagaccagcctggcctcatggtgaaaccccatctctactaaaaatacaaaaaattagccgagagtggtggtgggtacctgtaatcccagctactcaggaggctgaggcgggagaatcacttgaacccgggaggcagaggttgcaatgagcggagattgcgccactgcactccagcctgggcgacagagccgagactccgtctcaaaaaaaaaaaaaaagaaagaaaacgctcctgttccatggcatccagtgcctagaatcaggctgaaccaggctccacgtggccccacgtgcctcccccaactcctgcctgggagatgtgctgagagagtgggagggtcccactcacgtgggccaggaagggcgaaatccactatgtaagcccaggaggaccctcttcctaatccctgagagctttcgggaaaggtgtctcagggaagggtggggagaaggggcggtgcctttctagcaacggagcaggagcaaggtgcggtggtgggggcggggggcggctctcggttcgccccaagcccccccacaccattacccgtgatcagttacgcatcccccggggccatgcaagagcaatcacatgatccagagagatttgggagcgagggggtggagaactcgagaaggtttgttttttttttcttctgagggtggtggtgatgatgagggtgggggtggtgatgaggctggcaggaaagattgctgagcccgggattttcagctcccgcatccaaacggcccccgcggatatctgcaccccccgtctcccctcccacccgatcccaccccagcaccgaacccctgggccctgaaccacacatgacccggtgcccctggggtggcaaactcgggtgccaacgactgctcccaaaacggcctttcggcttcagcctggacagagaagctgccggtccaggggcgggggcagcacccagaagggcctccctcccctgaggctcgcggaggccgggttcacaacaggtgggaggggggacgcagctctcggctcggtccgcccacggtccccgcccccggaccgcaggaatcctctctggggaccccccgcccgcgccccccagaccagcccggctcctgggtcccgaccccgatcccgattcccaacccgaccccgatccggaccccgatctcgcccccgcccgcgctccccggaccagcccggtgcctgggtcccgatcccgatcttggggtcccgatcccgatcctggggtcccgatctccatcctggggtcccgatcccgatcctggggtcccgcccccgcccggcacacgtactgctgtagagggtgtcgatccaggacaggcgcggcaggccccggtggctgagcggctccatcccgcggcggcggctcggtcagatccgaaacccgaccctcatcgcgcaacaaaggagggagagcgggcgggagccgggggaggccgaagttgcgagcgcggaggggcgaggaggccgggaaccaggtccccgggaggagcgcggggcggccggggcaggggcgagggcggggcgggagcccccaaaaccctcccgaaccctcccggccccagcggccgcgccgagcccagctgcggatcccggaaccgatgagcaacttcgcggggggcggggcgggggtggggcttcgtggtggggcggggctttggtgcgggggcggggctttggtgcgggggcggggcggggagggaccaatcggctcgaggctccgccctccgcaggacgcccccggccgggctaagggggcagcggggctccggcgctgggcgaggaggggccgcgggggtctcggggggtctccaggcggcggcgcagacccaggtccccctcgtcccccccgcgccgggctcagcaggatcctggcgatccgcaaaccaggtgccgtggggggcccgggagcccacaggggtgacatcacctcccgcccgggatctccaagcgcggcttcgcgggcgggagcggcggccgggcccctccccagccagacccgctgcgggacccacggggtgaacgtcctgcgcgccgcgggacgcgcctctctcctcccgaaccttcccccgctcgtccctttccacacccctgacctctgagcgcggccgttcccgccacacatggaggggggcgggtggagacccgggaggaccgaagtcacgggggctgtggggccaggacagtcccacatgtgcccctcctgggcggaggacaaactggagccaggagaagccccaagggctccacgcgttcccctccaggacccctcctggggaccccgagccgcggcctggaaagcccatcgtgtttgcatcatcacctagaaatggtgggaagtcgggtcaagaggcctgagaaatgaccgtttagagacgaaattccctctaaggaagaccccctcgcccaagggcagtgaagagattgggggccccatgcctgtctcctgtgggctgattctgtgggagccatggcagcttccccacagacctctttgggccaagcgaccctggagcagggaaggacaggaggggagtcaggccaggggggtccagggcagtggggctgaagccccttcctgaacccagggaaagggaagcagtggggcccacccagggggcccggtaccccagatagtgacatttcagataccggagctgtctccaccccaccccatccccaggcagcttaaggggaaaacttctgggagcccagccctacagaggcctaccaggaaggttaagtcagcctggcctttgccgggggcagtgtggtcggcacccgcagaacgctggaggggtgtgggggtcggtcctcatcactccaaacagacacacacacatctagttcttaaggggagaagcagctcctcccccaggatgctgagaggaagccccataagctgcttgggcagaggcctctgcagctgccccaggggagatgggggtcacccactcatcacaggctggggagcccctgggagacgcacaggatgatgctctgggtggggaagcctctacaggtggctgcagcagaagtggttttcaatattattagcccgtccctgcgtccccagggctccctccgccccaatcctcctggctcaggcaccagcgctgtctcttgccgcccctccctgcagctgtcaccctcccaccgtccctgactagcacacaggattgggagggccaagcaggcacctggagcttggcagggagggggcgtgcatctccaatgagacgctccagaaatagagcttcggcatgggaagggaacgagcaggctctcggaggaccgcgaggccggaggagccatgaggggccaagggcatctcttcttcccacctggaactctcggaagacagcccaggggaaaggtggaaacgggcgtgagctgccgccaccaggagccaccagcccaggaggcagcagcaccgtcccctcctcaaaacaacaacaagcaagaacgctcgggccctctccccacactgtggggttttcctgatggccacatccggcgctgactgtgagggagctatggatgtatgcttctgcgtgagtcacatacatttgcgtacattttacatttttatctacaaaggcttgaacaagctattttcagcatcctccaagctaaaatgtggcagttgctttccttcgcgttgccatagtttgcttttttctgtctacattctgtccaatcctggcactctcggaccctccactccacaacacgatagagggtagagggagagacaaatcttgagggctctacagaggaaacttctgataacgaacacagaacaccgactgtgtgcccggcttagcgtttcgttcactagcgtgatctcaccgtgaatgtcactgttatctctgttttctccattttccaggtcagaaaaccgaggccctgagcagctgagtaacccactcagagggtaagtgagggctgggacttgaaccctggcactctgttcatgctctttttctgtttgtttgtttgtttgtttttgagacagagtctcgctctgtcgcccaggctggagtgcagtggcacaatctcggctcactgcaagctccgcctcccgggttcacgccattctcttgcctcagcctcccgagtagctgggactacaggcacgtgccaccacgcctggctaatttttgtatttttagtagagacggggtttcaccttgttagccaggatgatcttgatctcctgacctcgtgatccgcccgcctcggcctcccaaagtgctgggattacaggcgtgagccaccgcgcccggcctgttcatgctcttaaacaccacgcatactgcctccacggccagctaactggtgatcaccgggtgctgaaggtcctgagaaatctctgcgggtccatggggttagagaccaccctctgggaaaccctgtcaaccctcttccatctccagacgtctgtctcagacaacgtgtctcaggaaagggcagtcacttcgagattcccttgatgcctttgttggatggcttccagtagatgttaacaccacggccagatgctaaccttggccacagagacaagtgtgtgagcctttgagcaccacagtgatttgggtgggaacagaaacctccgcatccctggcactgaggagttggggagatccaacgtcacgcgctgggaaggaaggagttaaagagtccttctcctccgggctttgccaaaggtgatgctaccctgaagtgctctaaccccagcgatcaaccccaatctgtcagaggagcggggagctgtggcagacagaccttcctgattcagctaaatgtggaccgggtggggaccagccagtgctccccaaggcactgaacccccatctatcacgctgcctcctccaggccccttctaagcattccccagacagtccctggggccagtgctctccaccctcccagccctccctccagcctgtgcactcagactgtctgcggctctccaaccccagggtgacctgcctgctcctgcctcatcactggacttaaaggggatttcatggttgggtgcaccgccaggagcactgggttaatgacgaggggctgagtgggaagaaggtacatcccattttcaaggctatttgccctgctcctaattcccaagcacgtgctactcacggcctctccaacgaccaactcttgcttctaccaatcaaggtagaagccttggttcttggccaggacagaaaaaaggggacgggccctagaaccaaaactgggtatctccacatttcctcccttctcatgttagcagctcagctccactgcacacgacaggaaggccccaggagtctctgcttccttgatcacccagaggtcaccgctgatgacaaaaatatgttcccatgcgggggccaggcagggagccccggtgcgtgcagaggctgaatacacagtgggtgggagggagtggggccctctacattcaaatgaaaaaccaaaaccaaaaatagactgtgatgaccaaaaaaccgagagtttgcaccctcactggcccatcaggtccttaaaagctgggactggccaggcgcggtggctcatgcctgtaatcccagcactttgggaggccgagatgggcagatagcctgagtctgggagttcgagaccatcctggccagcatggtgaaaccccgtctctactaaaaacacaaaaattagccaggcgtggtgcatgtgcctgtaatcccagcagtgagccgagatcctgtcactgcactccagcctgggcaacagagtgagactccctctcaaaaaaaaaaaagccagagccgggcacagttgctcacgcctgtaatcccagtactctgggaggccgaggtgggtggatcacgaagtcaggagatcgagacgatcctggctaacacggggaaaccccgtccctactaaatatacaaaacattagctgggcatggtggcgggcgcctgtagtcccagctactcgggaggctgaggcgagagaatggtgtgaacctgggaggtggagcttgcagtgagctgagatcacgccactgcactccagcctggggacagagcaagactccgtctcaaaaataaaaaataaaaaaaccaggactgcatcttcctcactgggcagacccagtgctcagcgcagtgggtgaacaaggctcaggtagactcccagcacagctatgaccacatggtgcctccagatcagctttctgccgagcgcccagcagatcggcattcaataatgcacattgaacaaataaaattaatgacagctaacagttattgagtgcttttttttttttgagacagagtcttgctctgtcacccagtctggagtgcagtgggcattctcacagctcactgcagccttgaactcctgggttcaagctgatcctcctgcctcaccctcccaaagtgctgggattatagatgtgagccaccgtgcctggtctactgagtgcttcttaagtgtcaggcactgctctatctgctttacgtaggttatttcacgtaatccttacaataagccaatttactattatctccatttcacagaagaagaaattgaggtgcagagaggctaagccattggctaactagcagatggcgatgcttggaaatgaaccaagtctgaatccagggttcccgtgtgtaatctctgcattgagcggcaattagtgaatgaatgaataaacagaatgaagttaaactcagggaggaagaaatcggagctacacgagggaggcaggcagcgttatttcagaaccctcccagggccactgatgataaagtagaaagagaactggtatcccaagaaaaccatatctactacagcaggccagatgaccctggagacaagctgaacaaagtccagtgacaatctcccaaatgccagtcccggccaaaccccacttcttcaatgcctccggccaatctcaagagtttccagcctcagtgttcacatctgtagacagtatgcgcccagggccaggcacagtggctcacgcctgtaatcccagcactttgggaggccgaggccagcgggtcacctgaggtcaggagttcgagaccagcctggccaacatggtgaaaccccgtctctactaaaaatacaaaaattagctgggcgtggtggcgggcacctgtaatcccagctactcgggagactgaggcaggagaatcgcttgaacctgggaggtggaggttgcagtgagccgagatcgtgccactgcactccagcctgggtgacagagtgagactccgtctcagaaagaaataaaaaaaaaaaaaaaaaaaaaaaaaagaaggtatgtgcccaggtggatcaagaagacgacctccaggcctcctatgagcactagcagaatacaaactctcctgtcagatcctggggtggcctgttttccgtgctttgctctattcccatttccttggtacagtaaagcagcatttactattcttttttttctttcttttgagatggagtttcactcttattgcctggctggagtgcagtggcaggatctcggctcactgcaacctctgcctcctgggttcaagcgattctcctgcctcagcctcccgagtagctaggattacaggagcccgccaccacacctggccaattttttgtatttttagtagaaatggggtttcgccatgttggccaggctggtctcgaactcccaacctcaggtgatccgcccgcctccacctcccaaagtgctgggattacaggcgtgagccaccatgtgcggccagcatttactattctaagattcatcctcagccctccagtctggggaaagaagaaaattccccaggcctccacagtgtcacctgtaagggtgaagtctcagcctatgagtctgtcttttgccctcttctcacctgccctctgctcagcctcccggcttttccagcagccagtgagatctacaggcaacagaggtgaactggaagcccttcccagttagtcatttctgcaccaaacttttgtgtcagcttgagtcatgggaagacctgctgccctggcaagatgtggacctgctccccggggagctgcattcaccccctcactgcctccctaggcatcactgcaggataaagcacagtgacatcaggtccttgcagctgtgacactccccacacgcccccacacacttcccaggggccgagttgaagccccgttcccatggccaggggccacagcaagggcagcatcctgggcagagccgctggcttagattatgcactccccgagccaccgttttaggagggtctctcgccaagccccagctcacgtggccctcacctgacatggctcagatgacaccacccacaggtcaacagcagagttttcccaaagggtccgtccgagggctcgacagcagggcctggagccccctactcatttacttaccaccaagtccccatcagcattcagaaagacgccagcagaagagtccaatggattctctaagtctccaaaacccagagattcagttcagtggctccaatctccttagccccaagggaaacaagagcacgtccagctggggtcagagctcacgggctggccctctgccctcctgtggtcacgacggccccgaagctggccgtgctcctcgctcgttcagccagaattctgcagacgcatcccaggcctacgctgctctgccaggacctctgacaccacccaccaggctggccctgtccccatcaggcccaggagtggctgcaggagccgagggcaggctgtcaaggagacgggctccgagaggcagcggctcaccattcagcaaggcgagggcaaaggaacctcagagcctagccaggggcgcctgccatcagtggagcctctgctctggggctgccggtcgggccgtgtgtgctgtgtctctttaaggaccaggcctcttcaaggcaagttccctctgcagtccagtcctgcctctgcccgtcctgcggcagagagtgggggctccccagcgccatctggcggccgcacagcagcacctcggccaccagaggcttccagccaagcggcccgcaagtgcctggacaaaaatctccagcttggacacagggctgcaggctgctgttgggaacacagctgggggagtcaggaggagctccgtctgggaaggagagagcagaagcccccaggagtgacatggggagaatgatcatcccgccggacaaaaccttcactaaaatatcctcaaatgggccgggtgtggcagctcacacctgtaatcccagcactttgggaggccagtgtgggcggatcagctgaggtcaggagttcgagaccagcctggccaatatggtgtaaccccatctctactttaaaaaaatacaaaaagtagccgggcatggtggtgggtgcctgtaatcccagctactcgggaggctgaggcaggagaatcacttgaacctgggtggcggaggttgcagtgagccgagatcatgccaccgcactccaatctgggtgcgacagagtgaggctccctctcaaaataaataaataaataaataaaatattatcaaattgggccgggcacagaggctcacacctgtaatcccagcactttgggaggccaaggcaggcggatcacttgaggtcaggagttccagaccagcctggctcatgtggtgaaaccctgtctctattaaaaacacaaaattagccggacatggtggcgggcatctgtagtcccagctactcaagaggctgaagccggaaaatcacttgagatcgaggctgcagtgaactgagatcgtaccactaacaccccagcctgggagacagagcgagaccctgtctcaaaaaaacaaataagtaaataaaaataacaatgtgtgggagcatttaaagaggtcacaataggccagctgcagtggcttatgcctgtaatcccagcactttgggaggccgaggcgggcagatcactaggtcaggaatttgagaccatcctggctaacacggtgaaactccgtctctactaaaaatacaaaaaatcatctgggcatggtggcgggcgcctgtagtcccagctactcaggaggctgaggcaggagaatcgcttgaacctgggaggcggagcttgcagtgaaccaagatcgcaccactgtactccagcctgggtgacagagggagactccgtctcaaaaaaaaaaaaaaagaggtcacaataactaggggtcgctactagccttcagtaggcagaagccagaaatcttaaaatgtcctacaggacttgccctacagaacatctgttgtaagtgccaagagcgttgagaactctacctggttggggaaaacaggatggcggatggcgagttcccatctcacccccagctggtcctctttccccatcacactgctttggatgtccttcctactaaatttcgccttcataaacgtaggggtggatggagggggcagtctgacccagctgccttcacaagggaagccggtgcctctggctgcccctcccagaagccaggcacacacacccctgaaatcactgcaccagcttctcttaggctgagctgcacccaggacatgcaaattttccataaagcactttcgggttctgatcgtgaaacctcgtgactcctaatttcctcttccccaagctcttggcaccttgtcctgagctggtcagctcagtctcatgaacacacagtccggtgccaggagctggcacgagaaactagcacacatgactcgtgttctcccgaaaggagagtgaagaagggtgagactccggccacagtggccacgttttggctgggtccgttggttggagcagtcccaggctcacgagactgacatcaaagatatgaagatcaattagaggaaagagtttcccagtgtctaacagcaactgaaggcttgctctaagacatcctaaaacacatgtagcatgtcattcctctcttactaagacctgtctatggcttcctttttttttttttttttagacagagtctcgttcttgtcccccaggctggagtgcaatggtgcaatctcggctcactgaaacctccgcctccgagttcaagtgattctcccgcctcagtctcccgagtcactgctgtcgggatagagacccgcacatccttttggtggcctaaggaacctgtggccgggcctctgcacccctttcagcttcatctggcacattctgctccttgctctcttctactttttcctgccttggaacttttgcataggttgacatcgctggcaaaaacgctctacccccactctgcctgggtaactcctactctcccttctggtcttaacttaagtatcttgtcttccagggagctttcccgacccaccagaccaggaaggcctgcgtcgttccctgcttctgaatgctcaggactcttgtaaacgttcaatgcctgtctctcctgctagactgaggtctcttggaggatagg

SEQ ID NO: 221 - DNA, 25431 bp, Homo sapiens
gggtacaattaatcctgtcactcaggttgtgaacatagtacctgattgtttttcaaatgatccctcctctctccctccctctcccttctagtagttcccagtgtcttttgttgccatcctatgtctatgagtacacaatgtggttgagaacatgcagtatttgattttctgttcctgcgttaattcacttaggatattggtctccagctgcatctatgttgctgcaaaggacattatctcatgcttttttatggatgagtagtattccatgatttatatgtgccacattttctttatcaaatctgtcattgatggacatctggtttgattccatgtctttgctattgtgaatagttctgtgatgaacatatgcatgcatgtgtccttttggtagagtgatttattttcttttggatatatacccagtaataagattggtagatcaaatggtagttctgttttaagttctttctgcagtgactgaactaatatacattcccaccagcagtgtacaggtgctcccttttctctgaagccccaccagcatgtgtaacttttgactttttactaatagccattctgactgctgtgaaatggtatctcattatggttttgatttgtatttctctgatgattggtgatgttgagcatcttttcatatgtttgttggctgcttgtgtgccttcttttgagaagcgtctgttcatgtcttttgcccatttttaatagggttatttgttttttacttcttcaattgtctaagttccttctatattctagatattagcatatagatgttggatgcatagtttgagaatattttctcctatctggtaggttgtctgtttactctgttgatcgtttcttttgctgtgcagaaactctttaatgtaattaggtcctactcatcatttttgtttttgttgctattgcttttgaggacttagtcataaattatttcccaaggctaatgtccagaatgatgtttcctaggttttcctctaggatatttatattttgaggtcctgcatttaaacccttaaatctttaatctatcttgagttagtttttatatatggtgaaaggtatgggtccgattttattcttctgcacatgactagccagctatcccagcaccatttattgaatggggagtccttttcctattgcttagtttagtcaactttgtcaaagatcaggtggctgtaagtgtacagctttatttatgggttctccattgtgttccattgccctatgtgtctgttttttttttttttttataccagtaccatgctgttttggttactgtggccttatactataatttgaagtccagtaatgtgatgcctccagctttgttctttttgcttaggattgctttggctgttcaggatcttttttggttccacatgaattttagaatagtgttttctctttctgtgaaaaaatgacatcggtgatttgataggaatagcattgaatctgtagattgctttgggtagtatgataacaacattgattcttccaatccatgagcatggaatgttttccatttgtttgtgtaatctgtgatttctttcagtagtgttttgtagttctccttttagaaaactttcttctccttggttaaatgaatttctaggtattttaaatttttgtgaccattgtacatgggattgtattcttgatttggctcttggcctggctgttattggtgtgtagaaatgatactgatttttgtacattgagtttatatcctgaaactttactgaagttgtttatcagttccaggagccttttggtggagtcttcagggtttttgaggtatagaatcatatcagctatgaagagagatcttttagcttcttcttttcctatttggatgtcttttatttctttctgttgcctgattgctctggctaggacttccagtactatgttgaataataggagttgtgaaagtaggcatccttgtcttgttctagttctcaaggggaatgctttcagtttttgcccattcagtatgacattggctgtgggtttgtccttgatggctcttagtattttgagatgtgttccttcagtgcctagtttctggagggtttttagtcaggaagggatgttatattttactgaaagctttttttgcatctattgagatgatcatatgattttttattttaattctgtgtatgtagtgaatcacatttattgatttgtctatgttgaaccaacttggcatcccaagaatgaagcctacttgatcatggtgaattaactttttgatgtgctattggatttggtagtattttgctgaggatttttgcatgtatgtttagtggggatactgacatgtagtttgattatttcatgtgtctttgccagattttggtatcagggtggtgctgacttcatagaatgagttagggaggagtccctcttcctccatttttgggaatagtttcagtctgatctggtagaatttggccacaacttgctaaactccctgataataagagctatcagaccccctcctaactctgatttacaacccagatcactacaactctgactgggcagaggaccagccttataaacattctcttcaactgaagaccataagccagtttcggccaatatataaaggttatgtgcaaactctctttgtgtcctatagttcacttttggtgtaaatcgccaaatttcacttcattttaatgctaaacccctgccccaaagtgaacatgggatgtacattacatatatgtttacctattgtgcatatcttggatccttcataaatatggacagcttccccgcacacctgctaaatatgtatgacatggttgtgtaatatggactgtgtgagtcataaaacccaacctgccctttccttcctcgaagacagagtacctttggtccagactggagactatttcttcctggtttgcaaactgacatctacaataaagctctcctttctactatgtagccattcctggtggtcttttagatgacagcccttacccactgtaccctaatccttcccacttgtttgaagatgtctaaaattctacctagtcatttcattcatttgaagagtaatgcagatcctccagtaggtgtgatcacataggctgttctcaattcaaattttagtttaaatatgtttctaatacttcccagagttaaaggaaaacagatataatatatagtgggtggtgttccaccaaaacgcttgcataatacaagaaaaacatcacacgcacacacaacccttacccaagaggtgtgttcaggcactcatgttttttttccctgagctgtagcagctccatattcttatttctcttggcaactttttgccttctttgctttctcaacccatcttggccaccatctgctatgtgtcagttccagagaccacaaacaactaacagcaccacctgtgcttcttagttccagctaaagagaggaaaaaatgtctgattggttgctggtccttagatatacaagtcctcatgccagacatattcccctctggttccattagacctggggccatgcatgaaacaaacttgtctgcctagggccattccttcaggaggagttacatgagtaaatctgtgtaggagagatgggtacagttcatttataagggggaactgaagagatagagaatgcagaatgcctgctgttcctgatggttttgcagttctaaattcccatttgctatgaagtctaagtctactttatatcttcagattttaggagttcctctatatctctttaataaactcccttcctaacttaactccctagtttgaggagagttctgttccttgagactaagagcattgaccaggatctagagccaaagaacatgaagcccaaatccctaaaaacacaaaagaaattccatgaggcagaggcatggcacaaagccaggaagttgagtgggagtaggagtagggacagtgtttctccctaagtgcctgctcctgtacagatccagctggcaggaaaaggagttagttggaagtcttggcttgtggagtcaaattctctcatgtcaacttatttagacaatagatggaatatttgtccatctatgctgattccatatatacaaagggaagagaggaaaggccaggctctcaaatgtgggtgagaagggcatggggagaatagtgggagttgaagagcacagaaaaacagcaggcagatccttttcacatggccatcagtccaaccctctgttgattgttctcacctgtattatgtgtgggagcacacactcacatgcacacacatagctgctgctcctcctgcccacaccacgactctctgtaatttgtcttccaggtctccaagaaagagactttgtgttcctctttgccttcctttacatcctgttataaatgccctttaatttttttcttcccactgagctttctattccttcatttttcctattcatttttcctattctcaagagaaactcaatgtagagaaaccataacaatgtgatttgaagagacttccgtagcccacctctgcccctctccaacacctcccaacccagcctccaaagttcatgctaaaaagaaagaaatggggacggaaggaaagtaaacttaattgaataattcagctcatactgggcatggtgctgagtatcttaagcacattttgttccattctcatgacaactctgagaacacgattttagttagcccttctttcctgaagaagctaggtgatttacttaaagaccactcaactcatcagtggcagagctaggatttaaactcaaatctttttgacccgaagcccatgcaacatcaatcctttgggctagtctaataagaaactatatgtagaaaactttggttaaattatgcttgtgttctctggcagggagatctgttcgagcgttcccttgggaacatagtttaggtaagagattgcttaattggcacagtctgctctttgaaggatgcaggtaaaagatggatgataaggtttgaatctgtgtccccaccaaatcttatgttgaattgtaatccctaatgttggagggcctggtgggaggtgatttgatcatggaggtgaatttctcatgaatggtttggcaccatccccttggtactgtcctcacgttagtgactgagttctcatgagatctagtcatttaaaagtgtgtggcatctccctgcccctagctcctgctcccaccatgtgagatgcctcactccccctttgccttctgtcatgattggaagcttcctgaggcctcctcagaagcagaagctactatgcttcttttacagcctgcagaaccatgagccaatcaagtatcttttctttataaaatacccagtctcaggtatttctttttaacaatgtgagaatggactaatacaacaggtaagtttcaatctgtgactggagtgacagggagaatgtccgagatggccagcattttgtggaagacactggaaaagacgactaaagtgtacatcctagagttcaagaggctttaggaaaatttcactatttcgcctaaggcagagctgctcttaaacttcctacatgatgcctgttttttcatatcctgacctccatgatgcctccaggccacttgcagtaatagttccaaagttccccaagtcatcttcctgtgttaaacgcttaccctgttgacccaattccttgcttacaattgactctagagtttgcttcttatctactatttaagccctgttttaattctgctttacttcagccttcccttggggtagttttctttctgtctcccctctttagtcatgacttccatggaagttacagtaaaacaatgcaggaaaataagcagacaatgatgctgaaggacatgcaggccacccctacttaactctcagctgacccagctccccttcacttccagcctcaaccagggaggggagggggcccagaaccacaagaactcagagaactatagttgaactgaagctctttatcctccgagtcaacctttcttgcatctgctgcacccagggctaatgaatgaacttcaaagaacgtcttcaaacatcaagttcatcagtgaccagaggtgtacttttgcaacctctccaggagctttgttttggatgtcttcctaccatgagtttagttaccatagcaacagccagagaagctctgcctggaagagagatttcttgtataatgagcctggaagaccttaaggtgaatagacaacttttgctgttttaggcctaaaagacctatattttttccctccctattagttcctggtatatatttatagcatttatatcatattaaccataaaatgaatctgacttattatttccttttaaaaatccagatagtctgatcatatagagatcactgggtccctgggtcctgaggccatactggaatatattatccaaaggctctctgtcttgctgcctagatttgtttgcatgaagtcattgctcttctcaagtccttctcaggacctgtcaaatcaaaactcctgagctggaaggtgggagccatccaacaatcaattcttcccctacaagccaccagaattttttcctcctctagctcactgggtatggtgtttgcactattttgtcctcttcctttggagaatcacctctcccctgctaaatagtattgctcagcccctgcagtaagaatggtatgacttggttcctaagcctgaccaggctcagacactttcctgggacttctgccagtactatatgggaaggtattcttttgtctcagaggctgctaagttggtaaatcctatattacctataggatggtggagaaatcctatattagtctgccaaggctgccataacagaataccatagacttgggtggctgtattagtctgttttcatgctgctaataaagacatacctgagactgggcaatttataaaggaaagaggtttaattgactcacagttcagcacggctggggaggcctcaggaaacttacaatcgtggtggaagtggaagcaaacatgtccttctccacatggtggccggaaggagaagtgccaagaaaagcggggaaaagccccttatgaagctatcagatctcatgagcactcactcattatcaatcatgagaacagcatgagggtaaccgcccccatgattcaattacctctcactgggtccctccacgacatgtggggattatgggaactacaattcaagatgagatttgggtgaggacacagccaaaccatatcagtggcttaaacaacagacatttacttctcacagttctggaggctggatgtctaagatcaaggtgtcagcaggcttctttcctcagcttacagatgggtcgccttctggctctgccctcacatggcttttcctctgtgcttgtactcctggtgtctcttctccctcttagaagaacaccagtcttattggattagggcctcacacttatgacttcatttaaccttcattacttccttaaaggtcttgtctgcaaatacagtcatattgggagatagggcttcatatgagttttgaggaaacacaattcagactgtaataaattctatgggagaactggaaggaaaggtggagacccagtcacattgttcacattgtatctctggatacaataagtcagccctacccctctaaatattttattttcttcagtaatatttcttttctctccactgtactctcctaaatatttaaacacatctacataatggccattgtttggtcaaaataaatgaagaagtggtgtttggaggtattagaaactacaaacaatactttattataaattaagaagaaatataatttatatagttctttgtttattgcactttaaccaaagacgtaggcactatccatgtctcagttattgtatacatatgaagattaccttaagcaaacatttttgtcttagtaccttccttaagcacaatttttaagattcaattgttctaatactttataccctataatcaagcaaagatgagaagacctcagaattcaacaagaatctgggtgcttacctcttctgatataaatatcagaagctgattcttaaagcttctacttttacatagaaataaaaatgtcctctccatttctaatcacagatggaaagaaccagaggtgataccccagccaatcatctacagttaaagcattaatactgtgttcagaggatacaattcataatatttatgcactcaattgtacagaggaaaagaaagagacacaaaaactagtgaaatcatacctccccatgcatggcttttaaaccagttcaactgtgctataggatacaatggggtggtgggggcggggggcatatgtacaataatgtttgcaccttatctaaataaaatgccaccaagttgatgtattatttagcctttattgcatagaaggccttccatttgaatatgctacatacagaactctaaactctgagctttttattcacagaaaatgtgctctcatacatctttgtgtcccctgcccttaatactatgcccgacccagagtcagggatcaaaagatatttttggtatgaataggcaaaaagacacacataggaccttgaatgacagtggcaatgtattacaatttattaaagatgtctgatgagtccagagtactccaaatattgaacccaaattctcaaaaggcatgtgatagaatggggttacccttgataaactataaagttagaaagattattttagagacaccatcagagtaggtgtcagaaaatctgagttcctgtctagcacattccacaaataaagtttataacattgcaccagttgcttaatctctgtgtcttgaatcctcatcaataaaattcaattaagtctattcaaacacttctgtgaatgctaacagttcactggcaattaatttgaaaacaaaaatctgtaaggcttctgcaatctagttgaaatctacctttcccagtggattttctaaaattcatcagcacctaccagcctgccccatgtcttgtatcctggcttctgccacacttccttctgctgagatgtcctctctgctcttctcacctccctaattcctgaccattctctaagacccagacccacatacatctccttaaagcctccaggccacacgcactgggggattatgtgtaggtgtgtgaactcctcgaggatggaacacattcaattcttttcaacgctgcccctagcagccttcccaccatactttgcagagagctctgcacagagcaaagcaaacactgtggctctcgcctccccttgctccctcaggacctcgcagccttcagttcactcaacccaagatctcaagatttcaaagaaacgaagagattgaaggcttctgtctcgcaagttagtcactgatcaggcagaagtgtttggctcctgcttcctcacatttgttttgcacacacacaatggtcttgatatgtttagagggtatttgcaatgggatgtggctggcccaactgtcagctaaccttcatgtttctttcatagcccccaggaagaaaattgaagagttcaaagaattgaaaagttaagccaattcatttaaaataatctttgactttctcattatcaatatatgtgtattttctgcaaggttacaaaaacaactggaacatatgttaaaataatcttcagtgtcatctgcagcaactaattctagagaactatcttattcaatttcatttcttacttatatggaactaaaccttaatctgcttttcaggtatgaaatatattcatgattctgtctcaaaatatgaaatcaaaagttagcattataactcccagctaactgtcatattaattcatctggatgaaccttgtggtactgaactttgacaatgctcagggtgtcaaagcaaacacctgccccaccccacgcctaccccaaaaacaaacgagaggcttttataggttgcaagtcctggtctggtttatttataaagcaataaatattagaagcacaaacaaattgcacgtgtgtaaacaaactgtacaatgattgatgaaagatgagggaaggtggtttggaagactccaagaagcataataccgtcatcctgactggaaggtagatggagagagaaggcatcttagaagcatttgcggtggacaatggatgggcctgcctcatcgtactcttgcttgctaatccacatttgctggaaggtggacagagaggccaggatggagcccccaatccagacagagtatttacgctcagggggagcaataatctgcagaaagaaaacaaaaacttccagtgaactctgaagttccaagcaagggagcaaataacacattgggaggattcacagaaaaaaaccattagatattaattcgctataatgtgggatatgtcataccacgaaataatgtggccaatcaagttatatgaactcacctctatttcatcatttatattattaaagatatattctattattaaaatggaatttctccacttacctagagtgtaatttggcaacaagctaaatgtgtagtggagcctagcccaaaagttgggagctttaaaaatgtattcaaagattttgttgcgtgtgtgtgtgtcttttttttgtcaaagatttatttttattcactgcttaaaagcattttggaagttacctatcttgggaaaagtgctaagaaaatcagaaaaagtggtagaaaagctaacaggtaaagtttgtaggagacaagaaactgagtatgagggaaaaggaatttggaacgtagttctgcttagaataccaagacttgcctcggatctcccactcacaaaagttctttaccttaatcttcatggtgctaggagccagagcagtgatttccttctgcatacgatcagcaataccagggtacatagtggtgcctccagataagacattgttggcatacaggtccttgcggatatcaatgtcacacttcatgatgctattgtaagttgtttcatggatgccagcagattccatacctgggaacgagtcacacacacacacacacacacacacacacacacacacacacacacatcacagtgcattcaggtcaaggtagagggaagagaacagaacttctttgtgtgggggagctgtcaccatttgtctctgaaacatatgttcccctataagacacactgcagggtggaatgggtgcctcacagttaatccacaatacaatgccaagaaaggagcaactgtgcttagcacctgtttcaagtaaacacctcctgaaactctcagatgtatgaagatgtattggaaaaggaaaagatacacgtttaaactaaaatgaatgtaatttttgtttatggacttaaatcagatcctgacaaagttccttatggaaagcattgcttaggaaggatatttgttgacatataagtgcccagttattaatatgagtaggaatgttattgcatttaatgatgaggaacttggaaagtccagctacttggtagtgaaacttacgggaataagtcagctcttgtgaactagcccttttcctgcagatacgtgctattcagttactactctgtgtcatcctttattttgagatgaactcagtgtgtcatcctttattatatcactagagcagaacatagacttcccctttaatgagccatcaggacttgaggttgagctgtgtgggaatccaaactatgacttcttttaactcaagggcttcttgagccttctagattttactctgggagaccctaagatttccagggaaaatcgtgcctctgcaccagaccctacaactcaccaatgaaggagggctggaagagtgtctcaggacagcggaagcgctcattgccaatagtgatgacttggccatcaggcagttcatagctcttctccagggaggaggaagaggcagctgtggccatctcattctcaaaatccagggcgacatagcacagcttctctttaatgtcacggacaatttcacgttcagctacagaaataaagagtatcacagtcatgctctgaagcaagaagtcaattatagggaggtaggcggattcagtgagagaggaggaaagcagacccacactgtggcagatgagacacacacactcaccagtggtgacaaaggagtagccacgctcagtgaggatcttcatgaggtagtcagtgaggtcccgaccagccagatccagacgcatgatggcatggggcaaagcgtagccctcatagatggggacattgtgagttacaccatccccagagtccagaacaatgcctgcccggggaagtagacaagaacaaggtaaattcctgaggacaacaccactgctctagccacggcaaagcccgcttccaatcttggctaagagatgctagcaatgggcattgatccagataaaattagattccttacacacaaagaataaaaatgcgcatcaggaatactaaatctgaagcaaactgcagctcatctttttaactattatagtagaaaaaattcccgaggacactttcaaatgaccatctttcttgtcagccacgagcacattatgtaagcacccaagggtgtttttctttgctcctattgaacttacacgtttctctctcttttgactcagaccctgtatggaatgtattctccttggggatgcttgcccaggtgatgtgatggtttaaacacataacaatgactgctgcactccaagctgctacactgcgctgagctttaaatgagggaaggacctatctccacaagctatcagctccaacaataattgtgctccgaaactaacctcagggcactactgttaactctttctcttagcacagaccttgctagggaatgggaggaaagggattatccctttttcaactgggggatctgattcacagcaaggtcggtgacttgggaatgtgattcatcagtaactgtccccagagcccagcatacctgtggtacggccagaagcatacagggatagcactgcctggatggccacgtacatggcagggacattgaaggtctcaaacatgatctgagtcatcttctcccggttggccttggggttcagcggggcctctgtgagcagggtggggtgctcctcgggagccacacggagctcattgtagaaggtgtggtgccagatcttctccatgtcgtcccagttggtgatgataccatgctcgatgggatacttcagggtcaggatgcctctcttgctctgggcttcatcacctacgtaggagtccttctgacccatacccaccataactccctatgagaagaaaaaatgagaaaatcatgctctcaccatgtcaggaatataatcagtgtcttgtccatttatatctaactgcccaagtcaaggaacatatttaaataccagaaataacaagcaatacgattttaccccaatttagaagaattatttaaaaatcaatcttctaccttctccccactcccccaaagatgtataattctattgttgagaatataactcaggagagaatgaagctattccactgaagaagcagagcctcacctcaccttaaaaatatcatatgccttcattaagttattaagctcatcacccatgtcaactggaatatagatgactgcattttggaatgactgaattaatgacacattgtatttctcctaagaaaaagattttgacattcaagtgaacacataatgatgggctgatatgccatcctcactccaacagtgaaattcagcctgtccagagctgttctggagtcattcaccagctctgaggactaagctctcctgcttggcagcctgtctggccaggcatgtgacaaacccagagagcatggcatgtcttttaacaaacgaggtggtatgtcactatcaccatggcacttgctgcctctgtcacgcctggcttctaaaaatgcaacagccaggaaggagatagattgattacacctttggggaaccctgtaaactggctgtgaacatgagagaggaatgtggatttggtcctggttggttgggagaggtgatattgttagaagttttaaacaggactgaaaagagaggacaaggaagaaaatgaagtgtataaggcagagaagacactaaagactaaaagtccaaaaggccattagtggagagaagcaggtggctttcacaccagggagtgggacccttttagaggcgtgccactcaggtgtacattcctcagtatgttggggttttgtggagtattgcttgccttggcttggatttgaagtcaatcagccttctcttaatttggcctaaagagttcatcgaacaagagggtcaggtgagagccatttcctagatcgctggactgaaggggtcccgagtgggacggggggctcggcgggaagtttacctggtgccgcgggcggcccacgatggacgggaagacagcgcggggcgcgtcatcgcccgcaaagccggccttcaccagcccagagccgttgtcgcacaccagggcggtggtctcctcgtcgtcacacatcttggcacagcttcagggggttctgcaggttgaggaggggagggcggaccacgcttagctgcctgtgcagctggccttctccgcacccagaggacaggacagagcagaagggggttgtggggactggacagggggttgggcggggaacactcctgccacctcccttcccctcgaatcataaaagggagggaagaagccgcggaggagactggggacagagaagggcagaggaatccacccaggctccctggccaggagttccagctagggtgccaggtgcaaggagggacccaagaaacccagccccttagtcctccccagccctttaactttcttccttttcacgaactgggaactcgatctccagccctgtccatatcgccatgcctgtgccccagatggaggggaaagcgcacgagagtagggacccaaaagccccttggggagccacaaaattccccttcttagagcccctgcgaggtcctgcgaggaccaacgcccaggacaaaacaagttagaaccaaatcaaaaagtgtgggctttaaaaaaaaaaaaaaaaaggcagtcgcagagcggcaggagctggggccttggctgaatgcgggccgggctggccaggtggcggcgcggggctggcgtccggcgcggcccgcggaccaggcgaggagtgaacgcggagggccgggcgctgactcaccgtcggcggggcgggtcggctcggctccggcggcagcgggctctgggtggctggctccaggagggccgctttatagaacgctgatggacagggtcagttggagcagccgggggcaggggtggggggcccggtctgccaccttgccttatttggtccccttcgcacccgctaggactgccgaggccattcatggagccaagggcaggggagaggatcagccagggagcccccagaccatgtaaggaaggggagggggcagtcagggggatggccaaatagggagctggggaggggcaggcgctgaagggtagggggcaggggaagactaagtgacgccagcccacccctccccctttctggggtgtgggtgctccctggatggtctgtggattcggtcctccgcagccctgccagccttggggacaataagccacatgcagtgggaaggcttggcgccctgccctctgctgaggggtcctgacagctgggccagggcagcaggggagcaacagcggcttctcatcttccagggctgccaccagcacaaaggacaccgcagcagcacatctgagtggctgcaaaaggggcacccaggacagggcacccttctggtctagtccccgccagcctgaatggctttactcagagagctggtgctgggctcatctaggtcagaaagctgagattaaccaaggccacccgagttccaacccatgcatggatcagggtctggccagggaagagtcagaaaagggtttctgtgagagcttggccaagtcttgctggagaagggaccaggtttaccccagcccagttattgggtagccctcatccatgctgcagggttttgctcaaattcagactctggtcttcaggccagaaaaggatcccctgctgccaaagtgaataaaggaacaaatgccaaaagtagcttgcccacttgatggtggggagatgagcatctttaaactgggggcagaggccctcactccaggtggagacaagactgcaaaggcaaatactttgatggagaacatagcaacaacttaaactataggactacaccaatccttgctactcaaagtgcagcccatggacaagcagtattgtcataacctggaaatgagctagaaatgcaatctcaagagccatcccaatccgcttttcagcaagatcctcatttgcttggtatgtacattaaagtgtgagaagcattggcataaatgacagatatcatctcctctgtggaaaacagattttgcaggatcttgaacttttgagaaggaaaaagaaaaatgacatgaaatgaggagagggagaaggaagagggagatgtaagaaggacacagatcactagtttgccctggggtgccctgcattctcagttcttgactggagctttgatttttaatgcttgtgtttttcctccagttcacaccagttaaaaatagaaaactgggcactggcatctctctctagagtggtcttgggctgatatgctgaggaggcctgctgattagatacttgtcccgactggggaatgctgggccctcccctctgaactccccaaccatgtttgggttggtctggagaagaaacgcgatgggcagctgtgtggtggggtcgggtaagagacctggctgagattactctgtgcagcacagcaggcattttacagtgaaaatgtttattgacaggatgccaagagtagaactgccttgtctcgtgaaaatatagaaaaaccaaggaaaaggagaaatgggactggtgtcagagccagacagaactgggctcaaatgctgcctttatcacttactaactatctgtttggtcttgagcaagacacttaaccttcccaagccccaagttttccctctcaaaagtgataccataacacttgttgcagaagttattgtgtattgtaatagttagaaacaaatgctgtaagtaatatggaagatacaaagcaaattgtatgtgtaataatgatacttttggaggcagtagtagctctgccttttaaagaatcaggttgatttcattcttcattgattcagcaaatctttgcaggacaagaactgtgctagttaaggattcagtgataaataaaacagagcaggactcatcctccgtggcaattacagaaaagtcagacagctatggcacaaactgggagggaagaagaggtatcagcaggatagtcacaaaaagggaatggaggtctgaaagagttgccgagaaagccttccccaggatgtgttgttcgtttttaaaagtagagcagaactgaagtttatgaacatttgtgtgagagaaagagtttctgcatgggagtggctggtgagagactcccactatgactgctataggtgcaaagactctcaggaatggaaaaccatgattattgacctttgtccttcgcacaggcttcggggatctaggaggccacttccagccccctcatctcaggaccattggctctagtgggaggccagtagaacagtgcaggacacaacagcagttttgtgaaacaatattcacccttaaaatgtttgaaaaatgtgtttcctattccgctcaatttcattgcctaacactcaaaacagtgtattttcatatgtgttatgtgtgtagcaagaacgaatgcttatttcttaaaaatttatgattgtttgatatttactatttgtattaccactcaatttccacattttatttattttatttttatgtatttgtttgtttgcttcagacagggtctccctctgttacccaggtataatcaggtgcggtggtataatcagggctcactgcagcctcaacctcccaggctcaggtgatcctcccaccttagccgattctcccaccttagctgatcctcccatctcagcctcccaaacagctgggactgcaggcacatgccaacacaccccgctaatttttgtattttttgaagagacggggtttcactatgttgcctaagctggtctcaagctcctgggctcaactgatctgccagcctcagcttcccaaagtgctgggattacaggcatgagccaccaagcctggccttgatttccacattttaaaaactttgaaccctattttatatattttaaaatgtaaaccaacaggaaagtaagatttcatgactgagttttatttaaactactttttacagatccacttaatttgaaaattgagattggctttttaagcatataaaaatgacatctcaaaaaaaattacaaaacaaagaagaaaaaaatgacatctcctctttggtacattctagatttttttttaattatggtaaaatatgcatatatcaaatttactatcttaaccatttaggaatacagagttcaaaagtgttcagtgcattcacattgttgtgcagtctccgagtgttattttttttattgctaattgtgactaaattgtgcttcctgcagtttgagaaagaccagtttatatcctatgaggtagggaaccactgagccttttttgtctgaggtcacacaggtgagcaaatggtggagtgacaattcaaactcaggcacctgattttaagccctattcccaaccaccaccaaaaataccttcacatatacttggtctgctatttctcagaatgtgatgctagaaccgcctccagccaaattacctagactgcctcatagaaattcagattcctgggttccaccctggaagattgaatctgcattttaaatgagccctcactgttctcccctaggtatgtttctctgcagagtgaaaaacttagccgcactgcttggctgttctctctgaagcccacagagctttgctggatgctgcccaagctgccagtgctggctggagtccaggttggctgaccttgtagatcccagtgggatggcagagctggggcgggtccccagggctcttgagggccagtgaagcccttttcggcgtggactggccatgagggagacgtgcagggcaaactgaaggaacagaaggtgggacagttcccactgcccttgcctcgggggaagtctgtttcatccaccatctgctgggatctggaagggagcggcccagcctcctccccggcactgggggattagcagtcacttatctcagctgttcctccgttcggaggtgtcacagtatttacagagaagccagaaacagacagagccacacttaattcctccccatgagccctccccatcacctcctgtccctcctgcattctgtgtgccgggggagggagagcctcggtttagatcagaccggggggaggatctagccttcctaaacattcctattttctttgcctacacatttgttcacccccactgccctctggctggatctgggtttcagttttcattgaaaggagaaagtgacatgatggtgagggctgcaggcccccacacatcctggtgttcagagtccaatatatgaggcatggctaatcttcacagcatacttccccgtgttttatatgcaaccaccaaggggattaacccaggcagagggtatttggccccagatggattctgttcttggcaggtcccagccgtcactgtcttctaacatgataggaccaactgtaatgaaccatttaataagactcagaaaaggagggcaggggaaggaggaaggggcacggaggagggagaacatagaagggaacatagaaggaagatgcttctctggatcctggtgactacatttttttttttttttttttttgagacagagcgttgctctgtcccccaggctggagtgcagtggggcaatctcagctcactgcaagtttcaagttattctcctgcctcagcctcttgagtagctgggaatacaggcacacatcaccattcctggctaatttttgtatttttagtagagacagggtttcaccatgttggccaggctggtctcgagctcctggcctcaagtgatctgcccgcctcggcctcccaaagtgttgagattaaaggcgtgagccaccgcactcagactaaagaccacattttcagtctcctctatcctggtgacgtcagcgggaaagaatcagaaaggatttctagatagccttttaaattccttaaaaggagtttgtctgtcaagaatgaaatgctcacgcccatgagtttctgcttggaagttactactcttagctcagatttgacttgctctgcacactggcagtgactttatttatggagtttcagtgtttcaagtattacctggagcaaatccatctttcctggagagcccaaccatgacaatgtctgatctaagcctgacctgcaagcagaagggctgggagacgtgcatcagtagtaagaactgtgagctcagaaaacctcctgcaggctgctttcactcacctgcatcatgtagagcccatctcttccccagcaaagatcaagcactcatctgacacacaatattggtgatggtaacactaattgttgacatttcctgagaatttcctagaggctggcactatcctgccactttctatgtgtatatggtcaacatggtcagtttctagatgaagctgggcagacttccagctgtagaatccatttttacccaactgttctctttgttttgttttgtttttaatttttttgtacatagagacatggtttccccatgttgcccaggctggtctctaacccctgagctcaggtgatccagttgccttggcctcccaaagtgcgggattataggtgtgagccaccgtgcccagccccaactgttctttgatatgatgtcaccagcctatgttgaggggctgtgtaagagtaggtcaccatctctattgtaaggacattgtaaggatgttttcatggatgttcatcataggacacaatcttctttataagcctccttgggagaattccctgtctgactctggtaccaagggcagaagcacatctaccaacgaactagtttgttttgatttgtgttccctgaatctagtgaccagctaaggtttcacttttggtgttggctaagaaaaattttagagaaccacatatgtggcccaattgttacagcgattataggtcattttgatctgttttacacacccatctctattttttatttttatttttcttctaatttagttttcatttttctctctatctttgtaagctggcataaatcttgtgtgggacaaaacaaagaatgaatgaatagatagataagaatgaatttgtaggaacaatggagaacatttgaaattacaattgggatggccattttacaagtagctaagagtctgccatgacttgcgtatatatctgtagttttttccatcccagtgaaagcataggccaggtgtggtggctcatgcatgtaatcccagcacttttggaggccgaggcaagtggattgcttgaatccaggagttcaagaccagtctgggcaacatgacgaaacccccatctctacaaaaatacataattagctgggcatggtggtgcacacctgtggtcctagctactccagaggctaaggtggaaggattgcttgagcctgggatgtccaggctgcagtgagctgtgatcacaccactgcactgcagcctgagcggcaaagcaagaccttgactcaaacataaataaataaataaatagcatatattgcttaatgaaaaaaacccattacctgtaaactataatgtcattttgattttcctcttaacatggtaagtacaactggcaatttaaaacaatatttccctcattattaatatagtatgtgtttattgtgataaactaggaaaaaacagtaaagctctatattgtaacctccctaaaataaaactaaatgtggcataaaattcataaggccttggcttccatatctacttatagccgctgggctgagaaaagacaaacagcctcctattctggtagtctgcaagaatgtccacttgttcttcaaagagagacatgcaatgcaaagaatttgcattaaaagcatttcttggtcctactattataaagtaaattatctctagtcaacagctggaactaaagaatgtcaaactcagagcaggctctgcccttgggattataccatctttatatatcccacttatgtatttcagagggtgggttctggtttccaagtcagctgttgaactgtttcaaacttgtagtttaaaaactggtctaccacaaacataaaactaaaccatatgaatatactgctgaaggcattgtcttcatgtggagggtctgaaagcacttcttttagaaaaacatctttacagctattttattatcaaaattgttcttaatttagactacagataaccagttcatcttaaccacctcttatttaatttcataaattaaaaataataacaaaggctttatctaaagctagcactgtgtacctacagaacttgtacgtacaaaataaaaacaactgaaaagccttcttaagccgttacttgtgcgtgaatgctggcacccatccaaataagtaggcctatggcttatgatattccagagagaagagccagcctttgaggactgagaagagaaaataatcagccattaaactatgatatgggccttgaaaagtgatcagaacaaccttgagcatgacccaaaggacagaacagagtaaaatactacatcatcaaagaaatacctgcaatggttgggtaaccctaaggtgagaacattctttaaggatgaacaagcaaagtgctctctattcagttaatgtttttgcaaactctctttaaacatgcaattttccagtgagagattctagtgaatttaatattacagcacactacttatatttttcacaaaagattcacactgggctcattccttcaccaatgtatgtagccatctactttctgtgttccctgttcagtgatgataaggagtccggagcccctctcttgaagtttcagagggagagccctgaagctttaatttgagctgatctcttagattggcataattgaccatttctggtgtccacccaaggatcgcatcactaagctgctgactcaaggtagtgggcgaggcggaggagagagggatgagggtagaaagagggtgatgggggagtggcctacaacacctcttccctctcatttctttctgaatagaaaactgaaaatgctaaatcagaatcacagacaaatgcagttacaaggggctcaggctttgctttcatacctggcagtgcaaaactttatactgagtttattttgtccaactcagggatgtgggccccaaaaatgataagagaaaaggcaaaagtgatcccatgaggcagaaagccttatgtattagaacagctccagtgttctgggtccttctaaaagtgtgcacacctcaggcctaaatatcaaaccctaaaatattattccataatttacatctttatgtagtcagagttttccttgatctatctggaaactaactcttattttgactaaatgtgaaaggttaaatgttaaatttgcctactttctcacctggaatatgtttgtgtgtatctgagagaatcagtcatgaatgaaaggtttattgtttctgtttcctacatttatttcattgcaatgtcaaaaggatagattgagtacatctttccaaatcatctgattcagtcacaatcacataaacagggtttaaaaaccttaaggctggtatcaggcagcagccaagaatgaacagatgttctttgttttctcaaatatttgtgaatgtaaatggtccagataacatctcataatcaccacactgaaagtgtgaaatgaatatacctttacaaagaaatgtggcatgataggaaaatataatgctctattcttagagcatgtgtcatttccaatgaagtatcttttaccctcctggtctccctgaacgctatttaaattctcagcattaaccaagaagacattcagatctcagcgactgattttgaacaaagggtttcaaataatttctttgggagattcaaggcttgctgtcaccgtagaaattcaaatgtgtcccaagtgtctcattttgcaaacaacttagcaaaatattacagatgaataaactctttgatttgaaacatcatactttctaactaaatataatcaaaatagtgatgcttatcatacaaatgtagatatgaacaaaaggaaaaagccaattcggtggctaaattggtgttcccttgaaatcaagatgtggtttattcaatttcttcattcaatcaatatttattgaatgccttctctatgcaagacattgtggcaggaacagtgggaaatattagagtgcatgagatggtgtatgcacaccaagagaatgttttcattctattagatagtacctaaacccagcaagccaccacaaagatctgtgctaagcagcacgaaagggtattaaacaaagcctgaggggctggaaaaagggagcgagcccttctcatgagggtccttgggcaagacttcatagtttatggattttgagctgagtctatgagggctagttgatgaatagattatgtttgtaagcttttgcattattttctgcctgaatcatgtttatgaggaagacaaaaatatgttgttccctcttaaaataattacagttcgttcaacagatactcactgaatgctcactgtgtaccacatgctgtacttccaagaagacaacttccgggttccaagtaaagtcagaaataagcacactgctgaaggtgcactgaactggtcctttcagatgaaaagtatgtgaaatgtgtgtgtttctgtgtatattttaaagtgtagccacatcttattctttacgaattgaaagctggaacagacccaagagaaagctcttccccacttttcctaagtcatttgccatgattggttttcaaagtctttagggagtgaatgatttcaagttctactgtttacataaatctttgactactgaagcctatttcaaaaaaaatctaaccaaacaaaccaaaactcttaaccatgggaagagtactgaagattaagggaggaaggaattattacagtttccattttttacttaggtattatttgaatatttttccagaagcatatattaattttatctattaaagaaagaaagaaaacaatctaatgtaaca

SEQ ID NO: 222 - DNA, 194318 bp, Homo sapiens
tgtgtgtgttagtgccagttgtaatttggataataatctgtgtgtgcactgatgtttctaggtgggaagaatggctatttagatatgcaaatagtttagactactttttccaaaacttacttgttgttattaaaattcttttatcagcttttccttatgtcctaaagcctcagaaactctgtttatagtttatcccagttcacccaaacatttgaatacctggaagaactcaatggtttttttgcatgactgggcattttaatgtgcaatctttcaggtaatttatcaaaatagcaaataaaaagtcttagatctagagaatcctagagtttatcttttccttctggagaagtgactgctagtctctttcatttgattcctgcctttaagccatgtccatatccatgtcatgaatagtcaaatcccatgacaatccaacagaaataatacagctagttcagcactggcctacgcactgcaatgcactaaatgacgttaggtgtacaaaagcatgttgtgtggtttaaggagccatacaaatgttagctgttttttttcttaggacaatagcagaataaaagtatttaattacttctgttcagggcttaagcttttacaattatgtctttagaaatctaaacatcttaatatggcaaaagctgatgttatctgatatggggaggtggttaataaatgttgctattataattgatcctattaaatttaatgggtagctatgttggttaacttaaaatttagaaaaaaataaattatctggtaagtggagatcttggccttctcttatagagaggtattccaacgtaagaaacaaattaggttttgttttgggattatacgaagaattgtatagaatggctgcattcaaaaatctttaatgtgaagttaggaacataattcagaatagttctgtgtggggatgaatgtgtcaatggttttttgtttgtttgtttgtttgttttttgacggagtctcactctgttgcccaggctggagtgcaatggtgcaatctcggctcactgcagcctccgcctcctgcattcaagtgattctcctgcctcagcctcctgagtagtagctgggattacaggcacacaccaacacgcctggctaatttttgtatttttagtagagaggaggtctcaccattttggccaagctggtctcaaattcctgaccgcaaataatccactcatctcagcctcccgaagtgctgggattacaggcatgagccaccgcgcctggctgtgtcagtggttttaaacagacaaaaataaagtgtaaagttggtttatagccaagaaccatgatttcaaatgttatatttcctttgaagacactgtttcaggtggtttgctttggggctgtagtcaaatagattagacaacatcagtgtgtgtggttttttttttaactctaattttaaacgaaattgatcactagtgaaatgtggaattggtagaagattgaattctgcagtttttttaatgtgatttttattattacacttgatagattgatagtatttgtgagtcattatggtatggttgggagtttattctttggagtcaggcatacacggatttctgacccagccctgctttttagactttagacaagttatttaccttctccaagcctcagttctctcatgagtaaaattgagagtaacaatagtagctccttcataaagttgtaaagggagtaagtgacattatccagctaaaacagttaacaaagcatctggcacacagtagatgctacatacatgattccttttctttctctgccttcttcttgttattattttatttttattatttcctgcattcttttatgtttctcaccaaatttggtactacctaaaatggaatttaagaagctgcagttgttgagtttgtaagacataataagggtaatataagaaactcatctgataagaaaattgttccttggaaatcaccttgagatcttttgtatttgagatacaaaagacaggagaagtaggagaaagacaggtgttttatttgggtggattacctccaaacatgtgggactttccttgcatactgggctttcttcatgctgcagaatgagactattttatcctttcaagctgtggaactgggcttacaggaatcggtgatgtagggacccagacctcacagctgtatccttcttctctttacaaagcagtgtcacgtggaagactggaaatggattacatggcaggctgactgggatttttctaagccaaaacacttttttaaacaaaccttgtactaaacactatggaaagtactggaaagccagaaaaaggcttgaatgttagtcccagctctgcacagactgttgtgtgaccttgggaaatgagctgaaactctgagccgttgtttccataattgcacaacaatgagtttggactcctagatgatctcagagataacttctggctcaaatattttctaattctatatttttttaggtcctccagcaattatattaaacttgttttctatctttctttatccaaggttaacttgtgataaaagcagaaataggaaagaaaaacttgggaacagcacaggattccaattcagggtttgaattccagttctgatgctgagcagctacgtaacctcaaggaaatcttgttacccagtgtgtcttaactgtggttgcacattttattaatctgggaggattttagaaaacactgatgttgagccctagtcttgaaaatcctaaacactcaggaattggtagagtatcagagctctctatgtgcaaaataaattcaaaatgaaatatcacctcacatctgttaggatggctactatcaaaaagacaagagataaatgttggtgagggtgtggagaaagggaactcttgtacaccatcggtgagaatgtattaagttggtgcaaaagtaattgtggtttttgccattacgtttaatggcaccattacttttttttttgagacagagtctcgctctgtcacccaggctggagtgcagtggtgtgatctcggctcactgcaagctctgcctcccgggttcatgccattctcctgcctcagcctcctgagtagctgggactacaggtgcccaccaccacgcctggctaattttttgtatttttagtagagatggagtttcaccgtgttagccaggatggtctctatctcctgacctcgtgatccgcctgcctcggccttccaaggtgctgggattataggcgtgagccaccgcgcccggccggcaccattacttttaatggcacttctgcaccaaccaaatagattagtgcagccattgtggaatacagcatggaagttcttaaagaaattaaaaagagaacaaccagccgggtgcggtggctcacgcctgtaatcccagcactttgggaggctgagactggtggatcacctgaggtcgggagttcaagaccaacctgaccaacatggagaaaccctgtctctactaaaaatacaaaattagccaggagtggtggcacatgccggtaatcccagctactcaggaggctgaggcaggagaatcacttgaacctgggaggcagaggttgtagtgagccaagatcgtgccattgcactccagcctgggcaacaagagtgaatctccatctcaaaaaaaaaaaaaaaaaaaaaagagagagaaaaaaagagaacaaccatatgacccagcaatacctcttctggttatatacccaaacaaagtgaaatcatcaccttgtagtaatatctgcactctcccgtggtcattgcagcattattcacaattgctgagatatagaaacaactgaggtgtctgtcagtggatgattggataaagaaattataattgtgtatgtatgtaatttttttctttcttaattgctgcataatagaggcatgtagtttcagggtacatgggatcatttaatacattcatataatttgcaaagatcaaatcagttatacaacgaaattttaatcagcatcaaaaagcaaggccatcctgccatttgtgacaacagggatgaatctgaaggtcattatgccaaataaaataagtcagacacagaaagaaaaatactgtgtgatctcgctgatatgtgggatctaaaaaataaaggttgaatttatagaaacagaggctagaattgtggctaccaagggtggagggcagcagagggcaggatgggagggagacttaggggagatgtagtcaaaaggtacagagttgcagttgtgtaggatgactaagtctagagagctaatgtacagcatgaggactacagctattcatattgtattgtatactaaaaatgggtagctatgtgagtgacgaatatgtcaatctgcttgactgtagtaatcattttactatgtatatcaaagcatcacattgtacacctacaatgtataaaagtgtttttaaaaaagctctctaggtgatttgaatgtgcagggatcgaggatccctgcaaagagctgtgaatcttagcactcttacctctaaggtggggctcctaaaaacaataacagtaactgccctgtgtcacaatgttgaggatcacgtaaaataatatagacaaaagcactttgcagtgtgtaagtgcacagtaataattaaagcaggcattgttaaaggacttagccattgctattatgcaagcggatgggattacattagcatattaattctgtctgctggggttctaaccttttcatatgcaattcagctgctatagtttagcccccactcccacccccagtaggacgtggtaatttacttctgtagaaactcctagtgctgctctgtgacccagtgaggacttaatgattatgtgttgactcagcgattattcttaataaacacaattcttccaagttttgcagagcacatattatcaccacgaatcaccatgacatgctcatgtatccctttgtgcccagcttgtaaacacacaaaactgttagataaacaaacctaatgttttagagtgggggaaaatcaactgttttcaaatttatcttatactatctgaattcctaattaaactccttttaacataatttcctttaagaactcaattttaggtttcttctgtggttacctttcttcggatattttcatgctcgacattgtaacacatttttgtctgttccactactcccctagaaatgtccgttgccattggtcttttggtattgaatactttttcttttcccagtcgtgttgaaattagtcacacagtgacttttgaaattgtcccactttgtcctggtcttcagaatgagcagtggtgtaattaacacagacctgcagacttgcagactaattttcatgaacttgaaggttgcctgtgacatggggtgtggctctgtgtcaggagtgtgtatcccctgccgcatggccgctctacaggattgagtttgaggaacacaggcagatcccagatggtgacaggctctgggaaggactagagtgcatgtattactccattctctgaccactcatggctgtagcatccattcagcatcccctactcacaagaaagtatagcttggaaaaacaaaagaaatgtctagaatctttttgacatctgtatttttttttttggtgaatgatttctgacttttctcccattatcatcatctgagaattggcttcaaaaggagaaatacttctttcctaagggatcccttcaaatgatgaacatcttttgagaatttagtgactacttactgattaaacaactatctaaattacaatggagagcaatcttttctagaattagagccctctatattgtggcacacgcttccttcgctttttctgcttatatgcacaggacataatacagttgatgaaaaaaatttaaccttacatatatatatatttaaggtgtatatatatagtatatattataaggtatatatatttaaggtaaatatatatatatatatatatatatatagagagagagagagagagagagagagagagagagagatttaaaaatggctagctgacaaaccaggtcctgtaggctgcatggttttcacattcttagaggtttgtaaagaaaaaaaaatgcagcagagaccatatggcccacaaaacccaaaatgtttattatctggccttgtacagaaaatgtttgctgactcctgaaccacgtggcaagtaccaataacgaagcacactcgctttttactttcatgaagaaatgcattgtcttttctcctttgaagtatccacttccgctggtaaaatcagtcttcacagctattctaaaaggaggctgagaaaccttctctagctggctctgtaacacaggctgtcccagcgagctcctgggtataagctgctcttgagccagagctgctgtttgaggcttgttcatgctcttgctttcactccctagatctctcttagtatcagcaccatccactaatttgctgcacaccttctttgaccttgactttttgggcaaatgcttattccattccaattgctcttgtaagtctgctttgctaccttcccctgcttttttacttattttaccctctggacctctcttctgtcatccccttcttctactttctcccctagcatctcagccctcttgaggccaaggcctgctacatctaatatttctatttctgtcctttgcttgctcctgtccagacccagtcttctcactggttgcaaagtgggtccagttctaccactggaaacagattttggcaaatagagaccttctgatctcctccctcaccagaccaatggaccatttttgtgaacagtatgacgacccttcctgggtattgctcacatgcacccctcatggtgcttacctagggtccatattgcctggtgtaatttccttcccatggaccttctggccacctgccttcacctacgactgcagcatttctccatgtctgccactgtgactagatcactccagtgatcctctgatggccttaggatccaacacacattggtaaccagggccattatagcactcaagcttctggtatatttctttattccagtccatcttgctgaatccctctgtttcctacctgtgagtgcccctctatgaatgctgatttgattccaggtactatactaggctgtggagtcagagatgaccaagatacagccttgctctcagtattttttgatggaagaatgatgatatgcacatacacgaatacagagcaaagcagtaggtggcaagtgattaagcaagtcactaaatcttatgaaagcacagaggggaatatttagaagtaaactctataaaaataaaaattctgaactacctaataagaatattactaactctaccaagttgaccaattaaattatttaatcagttaatatttgattctgtttttaaccttcccttaaatatatggcttaaagactaaacttccagtaaattttttctaagtaatgtactctttctctgactcattatttcatttattgatatcttattttgactctagcaatgtctgtaaccattaaagttctgtaaataaatgcagtcttttgactatagtacataagacaacatccctctttgtaaataccccaaccccttattagaaactatattgaggccaggtgcggtggatcacgcctgtaatcccagcactttgggaagctgaggtgggtggatcacctgaggtcaggagtttgagaacagcctggccaacatggtgaaaccccgtctctactaaaactacaaaaattagccgggtgtagtggcacgtgcctgtaatcccagctaatcccagctacttgggaggctgaggcaggagaatcgcttgaacctgggaggcagaggttgcagtgagctgagatcgcactactgcattccagcctgggtgacacagcaagacaccatctcaaaaaaaaaaaaaaaaaaagaaaaaaagaaactatattgaatcctcattccataccccaagtgcatgaaatgatgtgttgtaactggtgggtgggtttggtcagtccaggttggctgataggtttatttatcagaacagactttaagaggttgtcactgaattgcaagagatgcctttcaagtaacttgcatctgggtgctttgcacctttcatttccctctcccttctcattgcttgtacatctcctttctggcttgctttctctcaggccctttttcaggatgcatattgtgtcaaatataaatttggaaaacctagccagagaatacttgacttgagggagacaaccctaagaacattgacctgcagtgggcactccggtggggctagagtgttcactagcctgccccaagtgtgacttctgcttgtgtgtatcacccatttctttattcatttagtacatattttccaagcgatttctctgtgcctcagacactgtgtgaggtcctagggacacaatggtgtgcagaagggaaaactgttgttgccctcacatgggggaggtagcaacaattacaaatttacaggaataaatatgtgataataatatcctagctcaacatagaaaggaagttatctcagtatttacctaacagttttgtaatgtgtgtgtgcgcgcgcgtatatgtcttcttcttttctctttgttaagtgtgagtggagaagatgatggctaacactgagttctgtcatggccatggcacttttatacccacattctttcttttaatcatggaattctccaccccagccctcaccccgtggatgtcggagtaagacaacattgttatcactcagattgtcattgggagggtgaataaatgaatgcttgcattatgagagtttgggggcagaaatatgccacagactcttatctgaagccatcagatttagtggctgcgaacccaccgaagtcagggatttacattttttacagcaacgagagaaaacttcccctttcctctgcagaagtcaggactggatctcaaaaatagaaatgtgtcctcctaaatgtgtgcccatccccgtggttgacaaacaacggatttcccaagatagctgccacacacttggtttctaatctctgtattgcttccccgccagaatgtcgaagtccttcccgaatatgcccagtcatactttctgaacttttgagcaaacaccgtccggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccctccctgcctgtctttccacccttctcgttcccaaacccccattcatcccagttcacttttggaagtccatttctgttgcattcgcgaaaaacccattccaattcttgttggttccactgggaggtgtttagtggatcctgggtccctcagcgatctctgtgcaacttgcggaggggcaaccagtggatgggaaatacagcgagggagcaagttgctacttgcgtggtggaaccttaatgtgaatgcggggaggatgtagtgataatagtggtaatgggctgtttcctcaaatttcgtatccggcgcattcagtgcggttggaattaaggtgggggaggcacacttcggggaccaaagaattaaggtgctgaagacatacttcatgcacgacctttggttctgatttctcaaagtgcttgtcattataatgaacaattaatataataccatcttctatatattgatgattggaagtcactgaaagcagaaagctggctttgtcaggaaaataaaaagaaattgggaagctgccagcatctgtatccctacatggcaaagtatgtttgctcatcttaaagttaaaagagaagggaattgtccattttgttaaaagagtcgattaatattcggtatccataaattcagtactcaagttatcttaggagcgttcttagctcttggatgggatgccactaggcagagtagagttgtgcttctgtggactcagagaaggggtggagatcgggggcaggacccctgaacatgttcatttaatgactcttcttccctcaagttcattctaccccccccccaacacttagaagtatagatttgagtctgactagaaatgtatatataagacataaatcaaaataaatagtgcacagttgtataagccttattggctatttattaacttctccaggccattttattgttgaaataacttgctttactctagctctacttcttaactgcttataaatagaaaactttgtgtttgaaattaaaggaaaaatgcattttagtgcttatgtatttatggggtaaatatgtgtgtgtttgtgtatgtttgtattttctgctcccccacccccctacctccaccagctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggtaggcaggaggctggctatgcaaaagtaactatcatgaagagttttcctttgatttgattttctgccagaatctgagttcacaaattttactgcagcattttattaagaaagcaattaatattatgataggggagaaactggaaggaattaacttgggatctactgggataagactgttgtttctcttctctgactaaactggaactagaattttctgatacctgaaatgatatccatgtatctttcaggtacattgggcactgaacagtagttaagtgaatgtgtttatgattctaacttgtttctgtgaggctttatgtaagggtgcagtattctgccttgatataaaactgtctcccatgatataaaaactgctttcaatctgcacatgcaagattgcttcaagaagctatttggctgcagtgtctccatcagtctttccacttagaaattgagtgtttaaacagtctgtttctttaattgatcagtaggaggaaaaaaaaattttctgttgtattttcaataggtaaacaatttgacatttaaaaagattatggtgactagacacaaattatttgcataatatgaagaccaattttgattggcataattcttcagtacctactctgcattgattatgagcagttgctttactttcaggttagttcagaaagtggaactgatatttaccaaggtatcagtagaagacaaatgtttaatatccaaagagtttaagggatctttttccctgtgttactattctttacttgaattaatattattttgaaccccgagcagatttaaacaatggattatcggttcttctgttgtttatcgggagcagaaaatagagtctgtatgttaaatgtttcattttgatctgtacttgttcaggtgagaacaacagttagcaattaactgtctaaacatctagaatttaagaaagtatctgcagtttacatcattgttttttattagttttctaaaatataggtgagtggtaacagtatttatccccattttacaaatggggagctagaaatttaaggcttttgggtgattttcctatgttgtaaagcagctaatataaaattcaggtgacctgaatgtttaatttttactattttttacaagttaggtctctgagaaagtgctttcttcaccttgaatattactggagaggtgaactttctttcacattattttgaagtggctgctacccaccgtgagataaatgtgtctctgttctcagccagcccttttctccataagctcctatataacttaatggggtgactaataggtcatgtctaactcatttgtcttattgataggagaaatgggtgttgtctttaaagaagagaaatccaaggcccttttgataaaatgcattgaggcttttatagctttccttatgaatgagaccttttagagttaagtggttagttctcaaactccagcacctttgcttaggatgctggaggaaggaaaaacagctgcctcaaagcctgtttcaaagaatgctcaagccctcctcagcagagacttgaaatttcagtggcactttttaataactcagatgtttgaggctatgactaatgcttgccttatagtttaaccttatgtggctgttttctttggtgggacgtggtttgactgtaatatacctgacttccgtgataataaggtttgttaaacctgtacccaccgcttacctagaggaatagttgggtttcttttatactgtactttgaaaagaatgtttctacagaaatcgtatttgaaagcatttttcttattagtttaactctataaacatttgttgcacctttctcatatgcaagcggtatgctaagtattcaaagataagagataaaggttaaaaggatgaaaagacatgatctatcctccaggaggcaggaaaatgagataagcaagattctaaaagtgctcccgtacaggtatagacagtgttgttgtttggtgggtgccttgaaattaccctttgtgttctgtgacctcccttttacttctgtttttaagcatctcttgaagtagttgataaaaagtgttccatctgctttctgctgtatcttaggatgacttgcttaataacagtgatgagagacacttgccagttctgctgctttagaaatgtttcagtaagaaagtatagaatttcatttctgcttttatgtaaagaagtttttaatatctgtgttatgtacctttttttccctctcctgatttcattgcactgaagcacattttaatgaaagccttagaaatgctgaatcactgtgcctttctcatggatccctagactgggggtagaggtggaaatggaaattcccaaatataggttgcaaggccaagctccacatttatgtctgaagaaatttcgtaaatgttcaatgttgatcaatctttattactttatagctgtgaaagttaacatgtttattaactcttccagaattggtgagtgtaaaagcagattgtgcaaaccacctctttgcatcctaatgtttctgaatgccttaatgtttctttgtcaaacaatgttgaaaaatcttttttatctgcatagagtgatgtataaccagttgtccaaactgtgccattttttaaagtagaagtgggcactcctaataattatgccaggttagtaggcataaaccaaggtagtctagagcaggcagggagttttgacaccttggatccaaatgctgtattccttgatttttggtgcttactcaaattcaagattctttaaagacaattttattttctgatgatttattataaattctttcttgctagctaggaagtcagattcctgccgtgtagcagtattagggtctgaaatggaaaaatttaattttgctttgtgtgatattgtgaaatgtatttggtaattatcctgtttcctggtacacagcttcgaagaccgttggaatctccagagtgatgagtgtctttcatatgccaatgagatgatgggtggctgggggtccctaaatagcttcaggatgggagctggtcaccagaaagaccagcacattattagaggtttgggatttgcaccccacaaccccaaagagagaggcagaaggttgagttgatcaccaatagccagtgatttaatcagtcatgcctatgtaaggaagcatccataaacacccaaaagactgggttctggaaacttttggatagctgaacatgtggaacttcctggagggtggagttcctggggagggcattgaagatcctcgccctatgtgtctcttccatctggctcttcatctgtattctttgtaatatctgttatgtaaatggtaagtgtaagtaaagtatttcctgagttctgtgaaccgctctagcaaattaatttaagggaattgtggctaccctagtttatagctgatctgtcaggagcacaggcctccatctggggcttgagattggcatctgaagtgggcatttgtaggcttgtgggactaggccttcaaccagtggatctgacgctgtctccaggctaagagtgtcagaattgaattggaggacatcgaggtggtatgtgatggagaatctgcagaattacttggtgtgtggggaaaaccctcccatacgtcagatgtcagaagtgttgggttaagtgttgtgtgagactagagaaggaaaaaacattgcttttttcttatatctcttactttgttatcaagatcgatcgttttcacttgtggagacttttatgggcgtaaatggaattgtatgattactaaatataagcattttattaaccattaatgcaatatattaataaaatggaccatacattttaaaagcaggagaaacactttagattcattcattcattctgagataatcctatgtggtctgttcctaggagagttaaggaagcttttcctgaaactttagtcaaaaactacttgtcctgctgggcgtggtggctcatgcctgtaatcccagcactctgggaggctgaggcggttggatcacctgaggtcaggagtttgagaccagcctggtcaatatggtgaaaccccatctctactaaaaaaatacaaaaattagccgggcgcagtggtgcgcacctgtaatcccagctactcgggagactgaggcatgagaatcgcttgatcccgggaggcggaggttgcggtgagcgtcactgcagtccaccctgggccacagaatgagactctgtctcaaaaaacaaacaaacaaaaaacccccctaaaaaactacttgtcctatatcatgctcccttaggattctcgtctcttctggttgggaagggattgtggagatgcacgatgcatagcaccggaccttggggaaagctgactttagttgacctgtgtggctcagtcttttgctttctctactacctaccaccccaggttgaagagagaagagagagaagtttaagtgaatttagatcttggtgattatttttgtttccttctctattttaggataggactggttccacatttcttgactttccagaaaccagttgttccattgttgttggtatgggacaacagaaagaggaacataggatgaagactcccacctgtctctgccatgagatgttagcacacgtttttacaattctggaacataaatttttatgacctttattataaggaattaattttaaaaatcaatagaaagttttatactgtggaacatggggaaaagatttcccttctggaagtttctttagcaagcctagactttatctaaagagctgcctttatctaaacagccttcccaagttttccaggtcttcctaagcagtcattacaaaattgtaatatatagaattcaggcttgtaatgattttacttgtaatgcttggcatgtagtaggccttctgtggaatgaattgatgattgaacacttatatgttagagtataggggttcccatggaattcatgttataatcaaactaaaattcaaaaggaccctcaaaatactcaagtatttttggcactgtgctcctcactgctactgaggagagataattttggtcttgagtttttagcactgcataagtcacactaactatatgcttacactacctaaagtagcaaaaatgcctgtatcaacaattcttagataatgtctctcactgctacccatcattaatgtgattgtgataatcaagagctggtagtttttgttatttttatggtggagcaagatgtgtctttctactcaaatagtttccagtaaatcagatttacacatagtaggtgttcagttttgtttgattcagcagacatttattgaatacttcttttgaatcaggcgctgtgctagactctggggaaaacgaagaagactaacactttgtccctacctttgctcactggtggagtgtcagaatcaaggtagccgctgatgtgtggtttatgttagtgcagttactagtggaaggaacagaaggctgtaggcatccaaaggagagaataaccgttgcctagggaagtcaaagaaaacctcatagaggaagaagcaattgagctggccctaaagagtaattaggagttaagtttgtgcagaaggtggagaaaggaagagccacagaatcggcagaggagaggctccaggtgcaaaggcctgacttgcttgggtagtagcaggttatttgggtggtgagtgcaagaaggggaaactcaagtgtaggaaacttcaaagacagagtctcactctgttgcccaggctgtagtgcaatggcacgaccttggctcactgcagtctctgcctctcgggttcaagcagttctcccacttcagcctcccatgtagctaggactacaggtgtgtgccaccacacccaggtaatttttgcgtttccagtagagatggggtttcaccatgttggccaggttggtcttgaactcctgacctcaggtgatccgcccactttggcctcccaaagttctgggattacaggcataaaccactgtgcctggcctagtgtaacatttgtaatcaatttttaaatatcctacttagttcctctaagaacccagtgacataggcatttatagacatagcagttgagatttatagttagtatcttcagtaaggacaaatagctagtaaatggcagagagagccaggatttgaatccaggtcttccctttgcagagctcatgctgaagagaggtagggtgtattgggagtggcaggaagtgaaggtggaaggttgtgaagactgtgaagacacaagggggtctggatttattctatatcaaactgtaagtcctaggaagtcaagagatgagcgcatattgattgagcatagatgagtgccaattatgtggctccccagcgagctttacttctagtaggaagagacagaccataaacatgtccagagcagcaatgacaaccacatgaagattttaggtattgacacgtgcttgcagaagataaaaaggcataatatggtagagagtggtgggtgtgatgatttctcttgaagaatcagaagattgggcttacggccctggatgggagtaattcacctagggagtaacccacctacaggtaagatgtggctcctctttagataggatgacacatgctgtttactgcagtgccctcattctttgttgctaacactaacccttctgcatttctggtccctttgggcatttgagtttggatccttgtctttgattattctcttccataaagtctagaccatttttggacatttcatcctggtttggtccaactgctaactgtgctttccagcagcctacagctgagctgtgctgttgaaagtcttgcttcagcatgtgtccctaaataatgctttctgctcacgggttgactcattcctgctaactatgtaactattagtgtcattctgtcttcacttattctcaggctttgttagcagggtggaccactgtccttctctttacagttggtgaaaaaataacccaggaggccaggtgcagtggctcacacctgtcatccaggcattttgggaggctgaggtgggaggatcacttaaggctaggagtttgagagcaactcaggcaagctagccagaacctgtgtctacaataagttaaaaaaattaaaaagaaaaaataacccaggagcatttgcccaatggtgatgccctgtgtgaaggtaaatcatgcaggaagagagctctccttcctgccttcctcatctttctcagccatgcccctcagttttcccagctatctaagagtgaaccttgggagtcatctttgactcctccctctcctgcctataaatagtcgctgattaagtcttgacgtgtctcccatgactccatccctcccctcttctctgcattgtgttcttgtcatcgcctctggtctctctctctgtcaatccatcagtcccactgctgacagattaatctttatggaacacttatttcatcatgtgactccctttatccacattcagcaagcataatttcagctagatgaattttcctcttggagccagggagaggatgtaaaagtctcttgagaagaactgctgctttccttcttacaccacacatttgctgttcccttctcctttcagcacttttccaggcctgtttacccaaaggtcagtccatagcaggttataattttggatgattctattcatttctgtccaaaccctggggctagttatagaaaacccctgtgaccagtggcaagaaccgaatctatcaggaatgtgttcttagactttcaagtccaaattctgttaaattcctgcttcagaacatcatgtcatctccatctttaagatctgaataattaattgcttgtagaatatcagttttctaaatgaaaatattttattcctttcaagaatgtatacaattataaggctttattcatacaaagtattcagttcacaattgatatgggcaccctttaaccttatgaaagactcattcattcatataattcattcattcagaatctactgagtgaattttcaattttacaagggagtctttgtatttagaatttgtatgaattcagtatgattttaattaaatttaatggtagaaatgctattataaaaaggctagatccagttatgttttactcagaataatgagaaattaaaaacaatcatgttaattcatggccagtttgaataaaacttttgctttctataagtgacatgagaggttcattctccatcacagggcaccccagcctgggacagatgtgaacctgtgaattagcacaatgtttcaaataaagttttgttatatgggtgtcctgtatggctaaagaatatagagaggctaatttcctcatctggaacattacacattgataaattcaagccatgtgtattgtgaaagatgtttgttaccaagatctaccttaagatctaagtgttctctaagccttttatttggaaatgaaaaggatggaaattcaaacaagtcttctctgctgataggcactaattacagagtagttaagttcaaacaaaccagtgaaccaaagtgtaaatagaacctttgtattagtccattctcacactgctataaagaactacctgagactgggtaatttatgaagaaaagaggtttaattaacacatagttccacaggtcgtactggaagcatggctaggaggtctcaggaaacttaaagtcttggtggaaggtgaaggggaagcaagcaagtcttaccatggcatagcaggaaagagagagagagagaagtgccatacacttttaaaccatcagccctcgtgagaactcactgtcatgagaacagcatggggcagtctgtccccatgatccagtcacctcccaccaggtccctaccccaacactaaggattacaattcaacatgagatttgggtggggacacagaaccaaaccataacattccaccctagcccatcccaaatctcctgttcttctcacatttcaaaaccaatcataccttccaacagttcccccaaagtcttaactcattccagtgttaactgaaaagttcaagtccagagtctcatctgagacaaggcaagtcccttctacctgtgagtctgtaaaataaaaaacaagttagttacttccaagatacagtgagggtagaggcagtgggtaaatgctcccattccaaaagggatacattggccaaaataaaggggctacaggctccatgcaagtccgaaacctagcaggacagtcactaaatcttaaagctctgaaataattgcctttctcacatcagggcacactgatgcaggggatgggctgccacagccttgggcatctctgcctttatagctctgcagggtacagcctctgtggctgctttcatgggctggcattgagtgcccgtggcctttctaggtgcatggtgcaagctgttgatggatctaccattctgaggtctagagggcagtaactctcttctcacagctccaataggcagtgccccagtggggactgtgtatggaagctccaaccaaacatttcccctctgcactgccctcatagaggttctccatgggggctctgcccctgcagcagatttctgcctggatagccaggtgtttcgtacatcctctgaaatctaggcagaagttctcaagccttgacttttaccttctgcatacatgtgggcccaataccacgtggaagccaccaaggcttgaggcttggacccactgaaataagagcttgagctgtaccttggctctttctagccatggctagagctggagtagatggatgcagggtaccatgtcctgaggctgcacagagcaatggggcccaggtctggcccaagaaaccatttttcccttctaggcctctggacctatgatgggaggggctgccatgaaggtctctgaaatgccttggaggcattttcattcacctcctcttaggcaagcttctgcagcaggcttgaatttctcctgagaaaatgggtttgtgttttctgccacatggtcaggctgcaaattttccaaacgtttatgctctgcttctcttttaaatataagttccagtttcagcccatctcttcattcacgcatatgggcacatacttttagaagcagccaggtcacatcttgaatgctttgctgctttgaaatttcttccacaagataccctaaatcatctctcaatttcagtgttccacagatctctggagcagggcacagtgcctccagactctttgctaaagcatagcaagagtgatctttactccagttcccaataagttcctcatttccatttcagatcacctcagcctggactttgctgtccatatcactatcagcattttggttaaaatcattcgagaggtctgtatgaagttccagactttcccacattttcctgtcttcttctgagccctccaaactgttccaacctccgcctgttacccagttccaaaggcgcttccacattttccggtttctttataacaatgttccactcctggtaccaattttctgtattagttcgttctcacactgctataaagaactacctgagactaggtaatttatgaagaaaagaagtttaattgactcacagttccgtaagctatacaggaagtatgactgggaggtcttaggaaacttatcatggcagaaggcaaaggggaagcatgcacaccttaccatggtggagcaggagagagagagcaagcaaggggggaagtgccacacacttaaaccatcagctctcatgagaactcactcactctcatgagaacagcatgagggaaatccacccccgagatccaatcacctcccaccaggaccctcctctaaaactggggattacaattcaacatgagatttgcgtagggacatagagccaaatcatatcaaccctggactggtgactatgagagcaggatgtgggaaatccgtccccatgatccagtcacttcccaccaggtccctccctcaacactggagattacaattcaacatgatatttgcatgcaggcacagagccaatcatgtaaaccttggaccagtgactatgttgctcttgagctttgatctgtaattatatagctgggcacactcacttttgcttatctgcatgacagtgagggagtcatcctgccacattaaaaaaaaaatcttagatggtagtgagaacaaggtagtcacgtattcctggaccacttctttttgccctcagtggggctaaagattaaatttagaagtagtcaaatccaagcacagctagagacatcataaagaacattccagagtcatggagatagaggtttttgagtatctgttgaattccagtgcctgttttagaacctcctttcccttagtgtggttatttaataatttactgcatcaagttgtagtctgaatcacttagtcgggtgctttgtgctgtcttttaattgtaagcaggcctgctaataccatatactataatagctgtattgcagatgggctccattaacaatgtgaatcaatcaatgcttaagagagtcctctctccccatgtttatccttgctttttatgttttcaggtaagtagaatgcatgaaatcaactttagctcaactctccaatgcattggtaataaatataatatattgcctttctatggaacctgaatggttttattgaggcactttcatatctataatctcacatggtccttgcagcataactgccaagatgattattatttctgtgttctggatgaggaaatgcaaccagagaatgagtcaaaagcccaaacaagtcaggtcagtttgctagaggtcttaagaattattagcgtgaccaaaacgaccaggactgtggtttatagacttccagtctcttgtttcttttttcacacatctgtgggttgaatagggaagtttctgtcctttgtagacagctttcttcttgatgataaagacctgtgaactaactgcagctgaactatatgcatgtgtacacacctcacttggccttcctctatgaccagctggttttctcatctttttttttccttccctaaatgagtactccagataaataaccttgtttaaactactagcatttttagaatattttgcttatctgcttacctttccttctttaattttcactttcctctagcagtttttccttctttcttgtatatggaacaaagtggttatgtttggtgtttccaaataatatgtcagacattcgtaccattctagaagtagattttctttttgttttgaaaaatattttctaatacagaagtatgctgcttgaagaagtaggtcttcaaaataaactgaatttaattataactggttaatataccctttattttttactaattaaggaaatgatatacaccaaatttaaactttttgtcagcatgtgaaatgcagtatagccagtgtttctacactgacatcatattttggtgcaaagcaaggaaattggcattttaacgatccagtgtagccatttatttgcaggataaatatgattgtgctgctaggctgtatagaatgtcagaaattcctttgacttctctcttctggaggaagaatggttggaggtcaagtttctggaggtctgacagatcagctgttaccaactatctggaactggacaagttacttagcccctctaagccccagcttccttatcaatcgcacagtgcctggcatacaggaggtacatgggaaatgttaccaattaatgactgaccagaggcttagggaatccaagttgtgaactgctctttcatgaataatgtatttctttcattaaaaaagaaaggagatttaagggtaattgtgagacagttgtggcgaggggtgattctcagggtctttctggttgtatggctgcagatgagcttgattggtctacctcagacgtaagtgaacacctaagaaggagagactacattgggatgcacatgatgtctcagaggctgcaagccctggaccacattgaggcagttgtactgtaggggtgtaaagaagttttccataaacctttgcctataatcagggcactctaagtcaggcttggatattaggcattttagtgggttgtcaaggtgaaccatttgcttcttggagctaattgtcaggatgggtatggtatggccccaaatactcatactataaatagcacacgttcagatgataatttccccaagatgtattccaattagacatccacccacctcctctcttttccccaactcaccaaacgaaaccaaacctaagaaatactttcatctgcctttggtagttttctggctttggaatgaaatggaacaattataaaaccatgacaaatagaataggacatagacctcccaacccagaagaaatttaacagggtagaaatatcagacataaattctgtttttatttggacactaggacaattgaatatgttatgacaaggagataagattttggtttttgcgtcttaacagtcttaaccaagaagagttaatacactgattcccctcttcttataaattatggctaaaattatgagagttagtaaacttggtaattactgtggacagccctgtgtaatgtaatggagtttcatctctgcagaacgtttagactgtagttagaagcatttatcaccgttgggctgcataagtactgtcacttgttcccttcagaaccagtgtgatactgagatgatgccgtcttattacttttggctttgcagtggtttgttaaacagtttttggaaatggttaattattattctttacccttctgattaactataactatatccttatttattcttttatttgggatgttaatccttttaagacctactaatgcattttaggattgttacccaaatagtatatttatgaattatcttgtctgccatcagatcttaaatttgtttttccatttagtttttcagagttcttggacttcccttatattttcacaccgtaatgtgttaaacatttattaacttacttgtatgaaacacttgtttgtgatgtaatcgtttgagaatctttgttctttcacagaaagcataatctcttccttgatacacagacctacatatccaactatttaacctatatctccacttggatgtcttataggcaactcaagcttaacatacccaaaatggaactcttgattgtactatcatctaccctagcccgtccctcccaaatccttcccatctggttaaatggaacatcaccttccagttgcttaggccaaaaaccttttgccttctcttcctctcaagcatcatgccaagccatcaagttttgtgttcccttaaaaaactatccagagatccagccacttcttctttgctgccaacctggtctaacccactatctctcacatgcaccattagagtatcttcttctcttctccctgattttgtccctctcctatcactctggttctcctctgtttcacacatatcaggcagaatgatcctttttaaattctgattggatcatttcactcttggctcaacctccagggatttcccatctactcagaatgactttttttttttttttcccacctccaatcataatgtggtcactgaagaaaattaggctactgttagttgttatagttggttggcaggaagtgctctttatgtttgtgtatttaaacacatgccctagaaaaactaatgagatataaaaagttgggcgcttataattctatttttaatttttggaggaacctccatagcattttccatgatggttgcaccattttataatctcactgatggtgcacaagggttccaattctccacatccttaccagcactggttattttctgttatttattttttaaaaaatattagccactctaatgagtatgaagtggtatctttgtggtttggttgcatttccctaatgattagtgatgttgaacatcttttcatgtgtttattggccatttttacattttatttggagaagtatctttcaattcttcgctcattttctaatctagttgtttgtgttttttttggttgttgctgctgagttgtaggagttctttatgtactctggatatcaatcccttaccagatacatgatttacaaatattttctcccattctatgggttggcttttcattctgtggatagagtcctttgatgcacaaaagttttaaattttgatgcagtccgatttatctgttatttattttgttgcctgtgcatttggtgttatattcaagaaatcattgccaaatcctatgttatgaaggttttcccctctgtttcctgctgagtttagtcactttagctcttatgtttaggacttaggtccattttgagttaatttttaaatggtgtaggttaggaaccaactttattttaattttttgcatgtggatgtctagttttcacaacaccatttgttgaaaagaccatcctttcccttgtgaatgttttcccatttgtttgtgtctttaatttctttcattctttttcttcttctttttttttttttttttgagatggagtctccctctgttgcccaggctggagtgcagtggagtgatcttggctcactgcaacatcgcctcctcggtttaagtgattctcctgcctcaacctcctgagtagctgggatgacaggcccccaccaccacacctggctaatttttgtatttttagaagagatggggtttcaccatgttggtcaggctggtcttgaactcctgacctcaagtgacccacctgccttggcctcccgaagtgcgtgattacaggcgtgacccatcgcgtctggcttgaagtagtttccttctatctgtttttgcatattttatctcataagtttctttaaaagggagaccagactatgagtagaataattgactggctgtgcaatagatagccagttttgggtaagacacttatatctagatttaaatttcctaattttaaaaataaggaggttgggttagatttgggaatctcaaactttagtgtgagttggaaccacttggggaagttgttgaaaagattttgagtttgtaggtctgtatggggtctggtggtttgcatttttataagtctcaggtgattttgatctggatgcgtttgttctctagaatcccttatggctctaaaattctttgaaatatcctccagtaaaaggcatttgggtatttattagaggacatgaaatgagggtatgggccattgaattagggattgtttgttattccaaatcatggttgcatttgtggacaagctgcctcctgagatttgggcatgttagatggagagtaggaattatgaagtgaggacatttattgcttgaaaatgaaaagagtagctgccttcaggagtggctggtgtgagatgattcagggacaaaagagcttttgcaaaatagaagcagaggagaggggctaaggaacagtggtcagcagagaggctgttggggggatcacactgcctcgatttatcactaggaagtccagaaagtcctgatttgccgccaggaagtccagaaacagacagtctctggtctgggaattctaaacaggagtgctgggagcctagagcaaaggaatgttactggaggtgaaaaactgatgaccaatttgcatacacatgcacacttacacctgtaaagttagtataaatatgtcatataaaattggtggttactctggtatatttacttacatggtctaagaattcagagttcataaaaatataatatgaaaagtgaaaatttctctcccagcacgccccaaaggctgttacatttctgtttttagttctcacaacgttaaataatttatctctaccctatttttagatccttcaacctaagtactatcttttgtctgcctgctctgaaaggcaaagactgtatcacactatggtgttcttccccttttcgccctaccacttcgatttttcttccttacttattttgaatttgctgtggtcattttacatttgaaaaggacttggagcagcgggacttagggttagaattctgtgttcagttgttgtcttctgcccctggggagaaaagtaaacttggagactcagcaagaacagctggaacccaagtacccccatttaaggatttgccgggagctcctgcttggcatacaaagcctcagaaggttgatggtgagggatggagagacattttgtgaaggaaaaattgcatatttcctgctctgttatttttttttaaagttaagaaggggccagaggaggaagagtctatacagattttgttgtggtttcatcaggaagccactgatgggttttaaacaaggaaataacattacctgatttatattttaataagatcattatggcagctctctggaagacggactggatggggcaagagtggctgcagggataccagttgggaggggtttacatttgtccaggcagtgatggtgtggactgcactgggtgatgagcagaggaattgcagggatgcaagtagatttgggatacattttggattattgtaggctagaagaggagaggagttatagtagacagattcccctaaagatgtccacatcctaatctccaacacctgtgaatatgttctcttgcatggcagaagacactttgtagatatgactaaattgaggctactgagatgggagtatatcctggattatctgggtgggcccagtgtaatcacaagggccctgatacagtcagagagaaggagatgtaatgttggaaacagaggtttgagtgatgcgaggaggggcccacaagccaaggaatacagacagcctttagaaggtggaaaagattaggaaacaggctcttccctagaacctccagatggagccagccctgccaacaccttaactttaaactttagactttgattttggacttttgacctccagaagtgtaagatgataatttatgttgttttaagccctgacatccagggaaatttgttagggtagcagcaggaaataatccagcagtcaaaaatgactactattctttgtcctggggaatagtgctgctatgtcccaatgtggggccgaaaaggaaggtttaggaggctgacaggaaactgagcctgttcagctcaggaggactgttggtcatctgtgtgcatatgttaatgacctcgttgtccccgggatcaggggcaggtcaggatgagatggaaatgtgggagccttcaccaggtaaatggtatgtagagacctcggggtttcacccatggagagactgtattacgtgaattgtggaaaaacagcttagtaatttctttcagaggctacatagagacctattccctctcattgcttgctgtctaaattatagttgttttcttttgagtcatcaaatgacatttcaaaagacaatatgaagctgccactttgggagaaagaaagcaatattaagcagctttttcgaagatcaaatttctggactctgtagatagttgcaatatttcttctgttattattttttgaaggatacatatgagctcatttgacagatttaaacctgtagtttaatttggggggaaggcttgtatggctatatatttttaaaaatctagttcttttcagttggattatatttaactgttgaaagaacgaaacttcccatttttgtttgcatcagttacttcttgctgttttgtttcaagggccttggtgacagctgaaaataagctttgaaaataaagttgaattttgactgggcatggtggctgacgcctgtaatcccagcactttgggagggcgagacgggtggatcacctgaggtcaggagtttgagaccagcctggccaacatggcaaaaccccgtctctattaaaaatacaaaaattagccgggcgtggtggcacgtgcctgtagtctcagctacttgggaggctgaggcaggataatcacttgaacccaggaggcggaggttgcagtgagccgagaacgcaccactgctctccagcctgggtgacagagtgagactgtctcaaaaaaaaaaataataataataataaaaagaaacaaaagttgaattttgtgttgaggcaacacatctagaggaagctatacatacatcttctgtacatagagagtaggggttctcaaccagtttgctccccgctgccaacactcccccataggacatttggcagtgtctggagatatttttggttgtcagaactgggcgggggaggctactggaatctagtgggtggaggctagtgatgctgccaaatgtaccacagggcacaggacagtcccctaaaatcaaagaagtatctagcctaacaggtcaatagtgctgaggtagagaaaccctgcagtagaacttgtaaacttatcagttaggaatatggcaactgttatctttctgtcactcagcactgtttcctacattgcatctagttgctcagtgaaccagccagcttagtttttttctgccctaagtactacaacattttctttctttgtttttcttagagatgggtttttgctcttttactcaggctggagtgcagtggtgtgatcgttgctcgccgtagcctcaaacttttgggcttaagcaatcctcagcctcttgcgtagctaggactgtaggctcacaccaccatgcctggctatttttttctactgtttgtacagaaaaggtcttactgcgttgaccagcctggcctcaaactccttgccttaattcatcctctggcctcagcctcccgaagaattgagattacaggtgtgagccactgcatctggcctacgttcttgcagattctataatttttattttgtgggaaattggctaatttagtattcactggaataggaagcagaaaaaaaagagtttgcttgaagtcttcatttaaatggattataaaattttctttttgccaagataaaagtgttaaatttattatagtcctctacttttggaaaaaaattaatgtactgtaagtagcttttattttgagctcttaatcaagtattaatagcattatgttttctctaattatggctaattaaatattgcccagatatagttatttgcttatttcaggtaattaaaaacatcatctgaaataaccgtaattgaaataatataaaattgtaaaaattgctctgtttgttttttattctttggcactattacaaaattttgaagcactgtgaatttttttaaaaattcaagaaaagtcttcttgctgtcatttggtgacttaagtagcagctcggagaacagatgtaggaatgaagtgatttatataatgcttcagaatctttttgttcctgaatttcacaatataaactttaattatgaaattggtaagagattttgagaaacctacattatttagtaggatgtgggatatatcttaatttctgtgacttaaaatgaggtctctaagatgggagatatagttagtaaataaaaataaataagtttatgcctttaaaaattcctaaaatgagatattgtatatgacaatgtatatgatgatgtatgcctaaaagtagtgacatgtttgaaatattagaagcagtagagatatcatgacttccagaacatggaagtgaactttcggaaaatcaaagataaacattatgttgtttcttaggaatgtttaatatatatacattcatgcatgtgatccatgtggtttgttagagagctgtgtcttcatttgctgatcattcttttgaaattttaacatgtatgtgcaagacataagaaagtgatgctcttggacttgaattctttttgggaagtttatagtgcataatatctcttggttttcaaagtgacactgtcctaattaaaaatgttgattttaaaacccgattagtatgttgctttacaattgacttctataattttttctctgttatcttaggtttctcatttaaactctagctctatcagacagtaagttatccacagaattatataccctcctttattcatttactaggatttttttatccctaatatgcccttatttactcattcatatgtctctcatttactcacttgtccattactacgaaatttattcactcagtaaacattaaaggatatatctttaattagtgtattagtctgttctcaaatcgctataaagaaatacctgagactgggtaatgtgtaaagaagaggtttaattggcttatggctctccacacttttaaacaactaaatctcatgacagctcactactgcgatgccagctccaagggggatggctctgcaggctatacaggaggcatggcagcatctgcttctggggaggcctcaggaaacttttactcatggtggaaggcaaagtgggagcaaggtgtcttacatggcaggagtaggaccgagatggggggaaagtgtgacacactcttaaacaaccagctctcatgagaactcactgttgtaacaacaactccagtgggaatattgttaaaccatggaaaaccgcttgcgtgatcaaatcacctcccaacagtccacacctccaacactgggtattataaatgaacatgagatttgggtggggacacagatccaaatcataaaattccaccctggcccctcccaaatctcgtgtccttttcatattgcaaaatccagtcatgccttctgaacagtcccccagaatcttaactcattccagcattaactcagaagtccaaagtcttttctgagataacgctagtcccttctgcctatgcacctataaaatcaaaaccaagatagttacttccaaattacaatagaggtacaggcatttggtaaatactcccattccaaaagggagaaatcagcgaaaagaaaggggcttataggccccatgcaagtctgaaacccacctgagcagtcattaaaccttaaagttacaaaataatctttgactgcatgtctcccatccagggcacactgttgtgaggtgtggctcccaaggccttggcagccctgcccctgtggctttgcagagttcagcccccaaggctgctcttaagggctggcattgagtgcctgtggcttttacaggcacagggtgcaagctgctggtggatgtaccattttgaggtcttcaggatggtgaccccttctcacagctcaactaggcagtaccccagtggggactctgtgtgggggctcaacctgacatttcccctctgcacttccctactagaggttctccatgagggctccgcccctgaagcaggcttctgcttgcacatccaggcttttccatatatccccttgaagtccaggcagaggttcccaagcctcaactcttatattctgtgcaccggcaggcttaatgctacatggaagctgccaagtttcatggcttgcaccctctgaagcagcagcctgagctgtacctgggcctcttttaaccatgactggccggagctagagtgcctgggaagcagggagcagtgtcctgaggcagactgcagtgccctgggcttggccagtgaaacaattcaattcttccctcctaggcctctgggcctgtgatggtctgctgtgagagtctctaaaatgccttgaaggcttttttcccattgtcttggctatcagcacttgactcctttttccttatgcaaatttctgcaatccccttgaatttttctcctgaaaatgggcttttcgtttttcaccacatggccaggctgcaaattttccaaacttttatgttctgcctcccttttaaacataagttctagtttcagttcatttcttgactcatgcatatgagcataagttgtttgaagcagccacatcttgaacaccactgcttagaaatttcttctactagatatcctaaatcatctctctcaagttcaaagttccatggatccccaaggcaggggcacagtccagccaaagtataataaaagtgacctttgctatagttcccaataagttcctcttctccatctgagacctcatcaggctggccatctctgttcatgtcactatgagcactttggtcataaccattcaactagtctctaggaagttccaaatgttcccccatcttctgtcttcttctgagccctccaaactcttccagcctctgcctgttacccagttccatggctgcttccacattttcaggtatctttatagcaatacctcactcttggtaccaattttctgtattagtccattctcacattgcaataaaaaaatacctgagactgttaattgataaagaaaagaggtttaattggctcatggttctgtaggctgtacaggaaccatgacagcatctgcttctggggaagcctcagggagcttttacccgtggtggaaagcaaagtgggagcagtcattcacatggccagaacaggaggaagagagatgggacgaggtgccacacacttttaaacaaccaaatctcatgacaactcactactgcgatgacagctccaagggggatggtgttaaaaccatgagaaaccgtcctcttgatcaaatcctcatgatcacctcctactagaccccacctccaacattggggattacaattgaacatgagatttgggtggggtacaggtccaaaccataccatagtttaaaggatttattctttatatctaactgcctattcacaactccacttgggtatgtaatgtgcatatcaaacttagattcagagtcctgaattcctaccaccacctccttctcctgcaattttccccatcttaataaattgcttgctccttttggttactcaggccagacattttagagttttcttgtctcctctatttcattataatccatgtctactctgtaagtgagtcctattgactttgccttcactatcttcccagaatctgaccaagtctcatcaactctattgttatttcccaagtcaaacccctatcacctcctacctggattattttgcaaaagtctcttaaggctactctgcttctcccttgccctctgaccactttagtgcatagtccgcacaatagcttccagtgaattttaaaaaatggaaacctgatcatatcattcctcactcaaaattctcagcaaattactatttcattcagaataaaaggcagagttcatacagtggcccacaaggtgctacacaattgacgcctcattggttctgtgactattgcctgcacaactcctctagtctccctccacttgacccacactggcctttttattgctattctttgaatacaccaagtgtgcccctgcctcggggcttctacaactagctgttccctctgtctgggattctctttccttaggtatttacatgacttgcaccttcacctagtctttgctcaaatatcagcttttcaaagactccttctttgaccatcctatttaaaactatcacctctttcttctaaaaactccctaacttattttgactcttgtctactttaatctttttacctatatcactcatcactatctaacttactttatattgttggttgtattagccatcccccacaaaacacacaccctaaaatgtaaaccctggaaggccagggcttctgcttgaaatgtggtagacacacgtgattatttgcttaatgagtaaatgatttcatgtatgatgtagaagccaacaaggtaatatataatctgaggaaatagatatattcctcagatacataatagacatattctatttttatttctatatgtcttcaaggctccatctaattttctaggttcacatttagaaaaaaaaatggagttttaataggcctaaaacattacatggacgtggtgagacctatcatttgcgtatgaaaataggagattctgcatagtggtcagtattctaaatgttagttttaaaaattgtgcaaatacaggttgagtggttgatcgtttccagagctctgtggaagttcgatattagagaacatgaggtcacgtatcaatattagcttttctacatctagctttgggtaaagtatgtgtagtacacatttgttttgagtaaaattgtgaaacaggacagttgtgggcctctatgttgaggaacaggccttaatcatgttacttaggaagtctactggcacctgcatttttgtaaaatggagaaatccatttttggcatgactcccaatgtgaaagttactcttttcatccaaaggggtagaatacaacccatccatagtcgtagatgaggtcagaattcagtgcaaaggacagagccagacatggctgaggaccagagaacactgaacttttcctaatctgtagctgtagttctctgtagataaaagggatctctgccccagtaatgtgcaacttgctgagggtagtcaaggaaagcaaagaccacttaggaatatcattgtcaaacagctgtatatttaacatgaactttgagcagtctcataagcagagcctgaaaaattctgcaaatggaaatatcagctctggtatagagatcccaacataaatcactgggtagaaacagtatgaaacctatcaacaaggatcagtgaatcgaggtatttcaggagaagagagctctggcctggacaggtctgctcagccttctttgattacatgttttcagtaatttattagtgagggagaattggaggttaatatttgaatctactctatatcatttatggtttgctaggtagaacaatgctaaaatgaactgtataattactgtaccataattttcattttgtatttcagaatttctcattcttaacgaatccttgtgtagtcatcataaagactcaagttaaagaaccttctattgccttggattgatatttgcattgacatgagtccactggattgttatagtcaaaattccaaggaccagagtaggcagactagggaagtaggactccttaaggagggttgcctcacatgaggctttttttttcttttagaatagtattcacattatataagcaaatttaaaaaactgccatgtaatgagtcacagacactaagcatggtgcttggtgtcttgctttccaaaacttatattttatttccattcttttatttaaattatttagtgggtgttcaataattctggctagaaagacaaaatatgttcttgctttatgacacaagtgttagcagagagagaagtgttccttggagttgtgcagtttggtgatgtaggaattgacgaggaaaaagaacaaggtgaatcacacctcagctactagattaatgcaccacattaaatgttactattcaggaaggcagttaccaagaagcttccatggtaactgttgtcatagttgtatttttactcatctttcaaaaaatatatgaaagtgaaataatactgctgtagtgatacttgtgctgctttacccattttaaatagcaagtgctccaaaggcttgtaattcagtctttctccttagttggcattgccagtttaatatccagcaaacattaatcactaacagtaaatgtatagaagacgtttcatatacatgtccaaggatgctttgtcagtgaaagtgtattgttacagagtcctccagggttgctaaataatcactagggaaaatcttagtttgacctcccccatacccaccataagattaaatgtagcttctcttctttggctggccatgaagaattttaaaaagaaatatttagtgtggctaatgtgattgactggaatatgtatttggattatcagtgcctacttcctctttctcttcagcgtccatcttttgcatatttaagagtacttcggctgggcgaagtggctcatgcctgtaatcccagtaccttgggaggccgaggtgggtggatcacttgaggtcaggagttcaagactagcctggccaatatggtgaaaccctgtctttactaaaaaaaaaacaaaaattagctgggtgtattggcgcacacctgtagtcccagctacttgggaggctgaggcacgagaattgcttgaacccaggaggcggaggttgtggtgctgagatcatgtcactgtgctccagcctggatgacaaagcgagactccatctcaggggaaaaaaaaaaaaagagtacctcaaactgaggtacataagaaaagagaggaagatgaatttggaatctctttaaaattgatttatttagaaaagagctcttgtataagatttggtcagaagttaaaattgacaaatccataaatccaagctttccttttttctgtaccatcagatcgcataatcgaatattggctagatttcttttagagtagaagttccatctttttcggctaggttggcacagagaacaaagtcacacggtgatctgcttcctttaagtaggagatgttcatcgtgggttgtgagaagagtgtgctttgttgatgctttggtcttgtttctgtaatagccttcaaacggtatgacttaagcttcctaatttaaggccaaaagatagattgattaacattttcgggcatgtatgttttcgggcatttttcgggcatgtatgtttcccccctacttgtcattcttgtaaaatgctttattttatgataaactgtcatgtttaactcacaccacaatccacattgcagtataacactccagaatggaaggcatcttgtgttttactttaaaagcatgtttcttaagcatttatttgttagcaaatacttattaacactttataatttcattctattaaataaatcctagaagagctgtctgaattctttctttaaatgcggagaaagtcttcctcataagccattctcagctctctccagcccccagcagactcactccacaaattcaaatgcgcttgttgcccttactccaaatttggtaattaatcatgcttatattgtgtgtggtatctttacaaataatatttatgccaggggtagtggctcacacctgtaatctcagcattttgggtggctaagatgggaggattgcttgaggaggccaggagttcaagaccagctggggcaacacagtgagacccatctctaaaataataataataataataataataataacaacaacaacaacaacaataacgattcttatttaattgacatattatatttttcactcttttcagttactcatttgatttccttaaccatattataatctttttgatctaagtgttaattctcggccaggcatggtagctcacacctataatcccagcactttttgggagatcaaggcgggtgaattgttgagcctaggagtttgtgaccagcctggacagcatggtgcgaccccatctctatgaaaaaataaataaaaatattagctgagagcagtggcatgtacctgtggtcccagctatttgggaggctgaggtgggaggattgcttcagctaggaggtcaaggctgcagtgagttgtgattgcaccactccacaccaacttgggcaacagagtgagaccctgtctcaaaaaaaaaaaaacaaaaaaaaaaaaccagaaaaacaaaactaactctcctatactaatctgctctagtatcttacataaggtaggtatttaatacaaattgttgctggttagcccataatactatcaattggaacatggtagaagaaaacatgataatatttttctccttcaaactacctgtttaaatgcatcatggcaagaatgttcagcaaattaccctaatttgcagaaccgccttcatgtagcatttgcagctgtttcacttctgtggaaaatgattcatattattttgaagacatgacaacttgaacaaggtcaaagcataatacataatggtaattagcaataaaaatacaaaatttgcaaattttgctgagtgtaaatgcacattggaatttgctagatggtggctaactatcctgggagggaactttagggtggggttgattgatacccttccaaaatgttactgtattcttttttctctttttcctactttactgtctccttcctaaatgactgagctttttcactgtggctgagctacattggtcacattattattattgctattttctttgagaatgggtctcattctgtcacccagactgagtgcagtggcatgatcttggctaactgcagcctcaaacacctgggctcaggtgattctcctgccccagcctcctgagtagctgggactagaggcatgcaccaccatgcctggctaatttttgtatttttcatagaggcagggtttcaccatgttgcccagcctggtcttgaactcctggcttcaagcgatcctcctgccttagcctctcaaagtgttgggattacaggcatgagccactgcgcctggccgtcagttgcattattgtattatttaatcctcgcacacatcatgttgttaagctattattatttgtattttattgaccggaaaacattgaggcttgcagatgtaaggacttctggcataagtatggcacttttttgtcatttaactaaaactaacacctcatgtttcttcctttgatctatgaccttggacaataacattagttaatctctctctgccctttaaaaaagtttcttttctataaaagggtaataaaaatgtctgctgtaccaattgcatggggtgctgtgttctagatagacatgacagtactttgagatgattaaaatgtaagaaatgtgaggcattattatttttatcataacacaaacctgtgcaatcaccagtgtatcaatttagaatgagggattagaacaaaattacaattaaaaatggtctgttgatattttcttttggacttcaaaacttttaagatatatttacatatttggatttttgcattatacagaaaaagattcacaagctggactttcatgtttctctagctacaggataggtccaaactagtcctctttagaaaaacctctgtgattgaaaagaagtgacttcttttcctcaaacttatttcaatttaaagttgacattttattctcattgatatttaattatctgggatgctggattctgtgcctactgttttcgtatgaaaagaaaaacataccaaacagccacgctgatgaaagtcttcctggtgaagtggactcttgttctcagcagctcaacccatgatgacaaaggcagggtccctctagcatcaaattagcgaattttcctcctcccatcttgttagttggtgaattttcaaatctgccttctctgaaacattataaaatgtcctgaatctcaaaaaaaggtgatgttttatattctatgacctttctccaccatatttgaagataatggagtggaaactcttgaagggtctattgaaaaactgtaaaggtaaggaaaagaaccgtatgcaacaagataaaggaaataaaatacttcctgaaaaggttatggttacacacacacactcacacacctgtcacatgtatacagtgtagctgctgtattcagtgttttaacagacatagaataaacattgttttttctatgttagaataaacagagaagacaggcatctgcttactgacttttgcggtctctaatgccctctttcctgaagccgagacctgtagccctcttctttacgaagttgaatgtgaatcattccactggtgtttgcttaggcctgcttgataccctaaagggcttcttacctctgtttgtaaaacattttcttgtctattgatattccactttgggcatgtttcgttcattacttaaatgaatatctccctaaataaactgaatatatcttaagatcaggaaaccacttccaaattctgttatgtttctcacaccacctatagtttagagcaggggtccccaacttccaggtcacattgatatcaggctgtggccggttaggaactgggccacacagtaggaggtgagtggtgggtgagtgagcattactgcctgagttccacctcctgtcagatcagcagtggcattagagtctcataggagcatgacccctattgtgaactgcacgtgcgatggatctaggttgcatactccttatgagaatctaatgcctgatgatctgaagtggaacagtttcatcctgaaaccatcccccactccaccccatccgtggaaaaattatcttccgtgaaactggaccctggtgccaaaaaggttggggaccactggtttagagcatactaaggtgaaatatatgtctcagaagatgtgatgatccatagtgtaggcactcagttacccaagttgctcaatttctactaaattttacaatttagtagaaattcagccttatgatattttttgaattctgggaaaatgttatttcccattttcagttccagttatgggtacgctctacagaactcacaaattcttgccaagtagtgaagaatactgtttgaacacctattatgtgtgaaacatagttgcatgaaaacatgtatatcctgcaaatggctgccttttatttttatgattagatatagagttatttttcttcttgtttttatgtctatattagctattctagaatataagtcccaagaaaacacaatagtatctattgagcctatttaatgtaccctacacagagttgagcatgtatgattgcttaatgtcataacattgcttgatgataaggtgagaaacaagtcttagccgaagaacccaatagctttcttaaagttatttaatataccattagatgccatccactagaaagaaaaaataaaaacaaaagcacattgctaagacgtgtaaactgttctccagtgaaggaggtttgtgtatataattgagtttaattgtttttcttttcagagctcctgtaatttccctgtgccagattctgagttaaaagaaaaatactaaagtggttaggcagcagctgttctcagtccttcagggtggtaattctgagcccagggacatgctcattcttgttgtgaaatgatgttctttggctataaaaccctgcattcttccccagtgctattatagtgaatgtccttataaaagcaaggctgtttaacagatatcccgaaagagaaaataactgattatgacctaatatgtggttcatgaactcttctctgaagcattcctaggatctgattttgtattactgaacacatttctaaacctcactgtatagttcctttgtaaaagaagaacaatactgtaggtagtctttgtatttttaatggatttcagtgatgctggtcagttcattatctctaaaatctgttaaatcaactaaaaatgatatggctgtatattgtaagactttgtactcatcccagccattcttctaacttttctaccatttggaagaagcaagccaatattctgttaaaaaaaaaaaaaaaaaatatatatatatatatatatatataaaacaacaatgtggtttataaaataatgactcactttacatgatttgaaaacatttaaaatgggcatatataaaaactgtgtaatattttgttaaagaaaaagtgacaaattgaaatggactgcatagcatccagaagttaaacactattttaattgtgtctaagacagggcagaaataaaatgatagggaaaagtagcacttgtcaggtatttattttggtatagagaagaatctgtactgtctaagcacttgcagaatgtatagcaatggaaagagaaacagaatgtaagcaaaataacatacatcaatatatttaaatgacttaaaatggatataaatgtattagatgaaactaattccatttgatacattgacaaagaagatgaatatggtgaggaaatcttaaatcattttatagaaaatgtgcttcctcttagaattaaaatattaaaacattcttactgataaaggtaataaaatcaggttttttttttcctatggataaacagatatcttgttgctggcatgataaattgcttcagttctggagagtaatctgttaagatgtttgaatcataatgatatgatgatgatgatgatgatgatgatgatgatgatggcgtgtgccagaaatggtgctgagtgagtttgagggagtggccatttaggagaaggctcattgtcttggccacatgttcttgtttgcgatcataaatgtcactgatcatgtcacgtgaagcctgccagtctccatcccaccttttcagattcattgtttgacatttcatctgaaaaccattttcctacaggccatattcattttttaaaaaatttaaaaagcttatttttctcacattcattttgactcgatttttataaatgttttcctccatgccttgagtgtcttttctttctctgacacgtggattcttattcatcttttgagttgttgttcaaatagcaccttgtcagtggatcctttctgcacctctctgtgcctggatggggttcagccatggtccctgtggcccattagacaagctgaggctgacagttgtacctgcccctctggagaccatcacttcttagagggcggaagctgtgtcccagctatctttatatgcaaagcaggacttaatatgtttgtgtggaatgattgaatgcaaaagcaaaaggaaaacccagtatgatttactagctctttgattaaattctattaaactgaagctagtcacattgacttggtataaacctattctagcaattatcaaattgtgtaactcctacaattctgtaaaatgaaggtactacatttaccaccagattaccttattttgcaagagtgttgtcagtgtttgtacttgtcacatcacttatttgctataaaataagccttttactgagtctctgtcaagttcttcttagtgtttataaagatgttcaaggaggtatatttatcagctcttttagaccagggtgccactaatgaactcatctctactgtataatattcttaagagaaactatacttaaggatttatcttattcttaggaagtaaattttacatacttaaagcttttttgatctagagctgaaaaatctctccttgtacaaattattcatcaatataaatatctttatgcaaaaattaatgcttcaaggtacagaatgaatttgaagactagtggatatttgtattgaatagaggttctgttgtggataacagagaccacacttgacagaagtttctctctctctctctctttctctctctctctcactcatagttgtatggatacaggaagcccacaagtatggtgaccctgttctagaaggttgtttggaatttgacttggtgtcctatggcattaaggatttaggagccttgtttctcattgttctgtatttaaaatttaatatttgttaatttcctttttacattttatggattattattgagtgactatctgatttggcagtgtgcttgactgaaagtataagtcatggtttatttatagtgttttatgggtttggtatggcaaaaagatcttgacaatgaatatttggtgaattacttggaaggtcagatatgctggggaagagtcattaatctagacctgtttgcaagacccctgtgatatatgttgtggagcttaccacccaggggagggatgggaaagggagagacagggaagcacaaataaagtgcttccaaagccctgaacgtgaagactgtgtgaagaaagacttcatgaaaagcattgcaggtgggacgcctttgaaggatggggagagtttcaatcatcataaatacagggaaggcaaagaggagcatggggtagtattggggggaaggagggaatagaaagtactgggagggagatgcctggtgtgttcatgctggtgtccagttaccatgcatgaagcacttcacagatgatttgcagcacccactgtgccttaggaatgcaattctggaggaaggacgttagtgagtcaaggaagtacagtgtaggtgtttcatttagccttgttctttttttttttttttcctgatagtgtgacaaaggagagttttatgttagctaatactttgacaaaactttattgatttgttaatttgcaatattcaagatgcttctgtgagctataataatctttaacatctagtaaataggattcatgtttagatggaattatctttgtagtttgaattaagacaaaataatgacaatatttataaacatatgactcttaaagggggacataagctctcagtattcacaaaaggccaggttctaagtgctttctgaagttacaaggttgtactctcccattttactgtcatattctgctgatacatcatttagagaacgttccaagaaagttctaattcctgctgaagagcagagcactgacatgatttttcacttaggtgtgcagaaagagttgtttagctttatgcacaaaacgggctgaaatcaagctttaattagtcagacttttgcataattcgtcacggtcactttgtaagtccagcagaatatgctgttggtttttatcttagtgggttcattttcaaggatgtgttgtcttattagctctttgctacccaaatatttagattttcctagcaaaaccatgatattgtatctagtctcctaaagaaatgaattgctatatgatgatacataaggaaatgaactgatacataaaagttattcgtcttaaatatcattcttgataataatctgtcttaaagacaggaaagtaagttaaggttcttctgtctttttgaatccataggctgtccatctggcccaggcaagcttccagattgaagccttcggctccaaattcattcttgacctcatactgaacaagtgagtatttagacataatcttcttaagaagcaggtgcaataaagctttgtttttataatatcggtttagtcaaaataatgtctgttgtttaacaactattttctagcagattattatagagcatgtaaagtataaaattctgaatggtgaattatatatttttttccgaaataaaagatatttaacatgttaagcatctcaaacccagcacttacatattataattttaaatggaataaatatttgaagtaatccagttaattaaatgttaattataatcatcactatatataagaagcatgataaatttactgattcaagtataatttgactacagtctagaaatttcttccatttactctttataatgcaattcgcatgacttctgtgggaagaacagagtaagtgatgacttgcaaatacctattttgagaagattctttgctttataatttgctctaatatggtttcttagaaattttggtcctgatgaaaatttacccgattgtctctgagcatgtgtttgttgatatttaaatgctgtttcctaagttcaaatcagttgtacagatgtctttgtacaaagtgtgaacaagagctgttgacttaactaaggctcttcagcctcaaatagatctagcagtgagcctttctttggtgaaagagattttctatgtggttttcttgagttacagaaattatagtcagtattttaagcttttgtcagtattttgatcaggactgcatctttgcaagaaaaatacctgttaatgctatcaaacactataatgtaagtgaccacaaccaatatttgagaaattgcaaagaattataaagaacaactattaaattttttgtatgccaaattctgtgagctctgcagaaaaaaatgcaaagtcagcttgggtgttccttaccaagtgttattgcagctttaagtcagaatgaatcagcagaactcagaattgcctatgtaaaggtattgcaggttttcctctttggttgagttccgtttcaccatgctgtgtcagcagtttgtctgcctaagggacttgtcttgccaaatcttacactatgttgagtggcaagatagagctaattttagtgtaagtcctcaattcctttaactcttactgcggtggagaccatcatttcaaactgtagcgagatgatcgcaaccaaccctgctgtgtgttttgagcaataaaatatctcagccatagcagagcctcccagtcaattagtacatggcagagaaagggtcatatgggatggccagggtacttagaggtctggaaatgtgccagaagttatcagtaacatttagcatgcaaaggaatcaggttgagcacctattatgagcagtccctgacttgaggaatttagagtctacttgggggaaggttgatagacaagtacgtaattttagaagagtatgaaatatgctggaggttaaaatggaatgttatggtagcaccaaggagtggcagctctcaggctggaggagtgtgaaaaggcgtcttgggaaaggtgatgcttgagctaaatcttgaagtgtgttctaggcatgtgagatagtatatctgaagaggcaaggccacgttgcagtgtggcatgttagaggagcatgagccttttgttgaccttcctcataaatgacaagattgagacgaggaagatgagttgggagaggtaagcctagggacagctcagctcatggaagttctggtatttcacgtgtcagtgctgggccattatcccctagactgaaaaatcaagtcaggggaataaacagaggtcctgttctcaggaagtgctaagaggcgtggagagggaatactttcaataaatctgcagttgataaaaattattaggattgctccatgtggataacaaggcagagaggatagttaaagccaacagaggtacctcgattggttggttggtttgagggtgatgtctagctgaaatgggcagtaccagggaacaaacaggttaaatggtgaagggaagagaatgtggcatcagaagagacatgatagatttgaggggctttgggacatacatgtggccatgtctaggaggtagctggatataacctcaggggagagatgggagctagagatagtagacttggtaggtatttttatataaatgttaatgaccaacatggctgtgaatgaggttaccgagggagggtaggtagagtaaggagacagaagctgagaagacaggtaagaggaggggagaagaggaggcacccatgaaggaaattgagaaggagtgattggagaaataggacaatcaggagaatgattaaacagagtttcaaaatgggaaggtgtgatttacagtgtcatctgcagtagagccatctactggcacatgctgtggaataatctaatgaggtaagaggcaaaatttgccctttggatttgccatttgagcagtcaccggtggttggaaagcagcagtttcaatgaaactctggggtggaggaaatgagaggggacagaaaccgggttacagtaggctgggagtgaatgagaggagatgatgtggaggcagcaaatatccattgaggaggtttggatgagaagaaaagagagcagaagacattgggatcaaggcagggctttttaatgatgacagagcaagttggcagagcaagttaacagagcaagtttggtggactgagagacggagctgataagagtgggaggttgaagatgcagaaaggagagaggagatatctatagggcaagagctgggtagagactgaagggaatgagatcaaagcccaagggcagaacttagttttgaaccggtaaagacaggttgtcctgcactggtgtgaagctgtagggtgtgtgcagatggagattgacttgcaggtgaggggatggagttgaagaaacacatttctgaagttatctactgtaggggttgggatggagagggaggttgggttggggcttgaggaaaatgacaaaattgctgggaagaatgagtgaggaagcccatcaaggtcaaatgcaagaatttttgagcaaccttcattagaaatcatgtgctatgtgttagtctttgtgtatttctttctggtgttgttttttatattttatttgtattatttttaaaaattggagtgctttgtcactgcagagtgtgaatgaaggaggcagactgtagtgtggacccagggctcaatctctgtggtagcacagaataagaacagtgtaggcaaagctctttgaatactcatgaataacttgcatagttaagtatcaggatccagtctgggttagaagggagatgaggtcaagaggaggctatgaactggggacaaatggaggtctctgaagggaaaactaactgcagtgagagagaggccatgagagctgcactcaagtgctatctcccttgatatggtttggctgtgtccctacccaaatcttactttgaattgtagctttcataatccccatgtgtcatgggagggccccagtgggaggtaactgaatcatgggggcgggtttttcccctgctgttcttgtgataatgaataagtctcacgagatctgatggttttatgaaggtcagttaccctgcacatgctctcttgcctgccgccatgtaagacatgcctttgctcctccttcaccttctgccataattataaggcatccccagccatatggaactatgagtccattaaagctttttttctttataaattacctagtctcaggtatgtctttatgagcagcatgagaatggactaatgtaatacatcccccatgctgtcctgagctttctgagtgcaacctgagtgtgcaaggctggcatgatgaactggaaatgagggaactgtgttagaacatgagatgtgttgctgggggtgggctctagtttagattacttctgtctgggattaaccaaaaagtttgatatgtgttagaataaaggtagagagtcaggagaatgtttaagtcagtaatagaggacccaaaagagcttctgaggaaagagggacctcatttccactataggatgatcattgctacattacagacagaggtgttaagttatcaaaggagggaaaggtgtctggtaagtatgtgggctcagggtgtggaggaatgagcacataaaggtgttaccataagttaatccaggtggtgaccatagaatcttcagagttggtgacctcaccaggcccagaagcccagcttgtgaggactaacctgacaggagttcctgagaggagagcctggtttgcatctggcttgtggaggcatctcatggcagtgctgtgtgttttattcatttgttcagcaaatgttgagtgagcatctgctatgtgcctctggctgttataggtgctgatgttgctgagaataagatagacaagacttgtgccttcccttttagagcttcattccagaggaggaggcaaacagtgggccaccacataaagacatataggatggagagggactggaggtggggtgtccagcatgatttagatggtcagaagaagcaagaaggcctatctgaggagggaacctgagctgagccctggttgtcaaagaggagccacaacacgttgctggaaggctgagggttctgcacagctgggacagcaagacagccagagctaaggaggatgtgggatgttcaagaagggcagaggccattatgcagtgcagggcaggggatagtgggagaacgaggagacgagatcagagaggaagcagctgtgcagtcaggcgatgaaggactgtggtccatggtgaggagtgtgggtctgaagccattggatggcagtaagcatggaagagacatggtcagatttctattttatttagccccaaaggtcttagttatggccttagaggtcctttaattacactcctctcagggtgctcctcttttaaaattttgtttagtgtttcctctaaaatagccgttattccaggttacagaagattttgaaaagatcactagggtaacgtttcttgtctttccttttttttttttagtgtcaaacaagcattttagatattttttattttgatttttattatccactttattgaggtatgattgatgttagagcaacaattcttaatgtttatcagtccttggaagtctcagaaggtctgaggattgattgtctcttctctgtgtgtgatcagaattatgccaaagcctatattacccataattatatttgctggtgttttcagcaaatgtttactgagaataaccatgattagagtggcacaatggttgaaagcatgggtaactctttgatcttgggcaagcttcttaacttcttccttttcttcatttttcctcttcctcctctttctccttttcctcctcctcctccttctcttctaccacctccaccacgaccgtcatcacctatcataaaactcacttttctaaagtttaccattcagtgttttaaaattacattcacaaaattttgcagttatcaccacaatctaattctagaacgttttcatcatccccaagaaaccctgtacccattagcagtcactccccattcccttcttccttaggcccctggtgaccgctaatctacattctgtctccatgcattcgcgtcctggacatttcatacgatatgcagccttttgtgactgacctcttttacttagcataatgttttgaggttcatccatgttgtagctgagtaatataccattatttggatatattctaagcttcttaagctttagtttccttccgaagctgtaggttgttgcaaggattagatgagataacatgtggtgcttgcacgtgtttgttgacaatgaattattattacctccgtgaggcagtcactgcgctgagatgttgggggattctacattgaggagaagaggcattgatctcatggaacttatgatctggtgagagcagctcaggtcataagaaatgctgcttgtcttccctttggcttcagtcagtctttttctgactttagtaagtgagaagggaggggtccactatgtaatcttttctctcttcaaagtcggctgaagaaaaaaaaatggagacaatttggtaggccctgggttgataggtgctcaaggtagtgagcactgggaattcagataacatacttccattgagttgaaagcatgctcgcgagacacttggtacttgtccagttttcccagagctgctcaccagacatccattaaagaacatgacacgacttgcaggctattgcgtatatgtgggtatttaagtttccaggccatctgactggtccgaggtgaacacccaggtcctcagcatgctgtcctgtttattgtgaagtgaaatccctgtgcttcttttagcccctgcccgatgcagagaggaaagaattcttaggatgcatcaagggtaatgccttcttggttaaaaaggcagcattatgttccttcttaatagaacgctactccagcgagagagtgtggtgatgtgacatgtctttgtacattcatcttgaatgatgcccagggagaactccgggtgaaatcagtgtaagacatccacattgggtggctgactccaaaaactgaggagtagacccaaaacttggagagtaaggtagtttcggatttaggaaaacaatctttattctgattttctgggaatcagaggtgtttgatttaagatgaatatctagaaaatgctgatttaaagaaatacatgcaggcagtactttgctcgttaaaagcagttcacgctgtgttttggaaagaagcagacagctacactgatatagtttcagttagcttaaatacagagcccaaccttcttgctgactgacatggttaattcattcttcattcagtcaacaaacatttattgagcttctcgtttgcgtaagacactgtgctgagcaacacgggggaattcagagctgtatgaaagaatttctcgtcttcaagagcctgtggtagagaaatgagattacagtgtacacgaatagtgttaaaacatgatagaaagtgacttgagagatcttggtgatgagggaaggttttctggggaaggtgggattccatgggactcctacaggaggctgccttggttttgggtcccctggtagcagaccctgagacaaggagggaggagctaggaaagggtgagttctcaagctgtttactcctctgggcagctgggattctcactgagagctctgggagtctgtggactcatgccagagagttatcccacctagaggcagggagctagagttttgtccactaactgccaggctgttgttggctgaagtctgtttcttggggcagtaacactttactacctcctcctgggtagagtacaaagccctcaggcccagggtctcaggcagttccagtcagctgccttcagtgtgtggaagtgaatgccaagggcatagtggcagggcccagtggagcccatagcaggtgctttagactttgaaaggtgtgggaaggagaaagacgcagactccacaggaagtggcaggcagaggtgtggaagcccaaaagcaccaaactcctggggtgagtcaggactggtgaggccccctctcttaaagaacctgaattaccaagctgcaaacagaaggcaaactgcctggtgggagtccctggatcctaagggggatattcagctttatttggctaaatgtttttttcagctctgcggatttggagattgaacttaaatatggttgtaagaaggaacatgtggagaagaaacaggcctcctgcctcatttttctcttgtggtcgagtaagaccaggacaggagtcaggagctgtggctggggacagcttgaggcaccttgacctataccagcctgagctgtggtgttgctgtcttacgtcttggtttctaaatttttgtgattcctgaatccagattggcaggccttttgtgtcattgctggcctttttctctccaactagcagcccatcatgctcactgctgtcatttctcttacacatctgagagagggaatcagggaaggcactggccttaggaatttggagtcaagacttccaatttcacctctgcttcagagagctggtcacacactctgggccttagtccgaaggaattagaggagactatgtgaacattgctttccatttcaggagtctcggggtttatgatgctgctaactcgaaggttaaatgctttacttcccagtttcaagagatctgcagaaggaaggctttctattatggtgatagacactgtgccaagccctatgtgtacccatagtctcctatttaagttcctttgataaccctgtgaggaagatgtgattatccccattttactgctgagtaacatgcgggctggcgagattcagtcacatgcagggactccagcatgggctgtctgcttggagtctccttcaccgtggctgctgtggtcacagcactggactaccaatttgcaagtgagctgaacctaattctgatgattgcatatctgttcacattaagtgagaaaaagagtggaattattttggtcaatttgtaactatatgaggaaaacacggaaggtcccaaataggattgaaaataatgctgtttgttgagtagaaccatctgttatgctctgtgtgtctcccactctgcattcgtacgttgaagttctaacccctagtacctaagaatgtaactatatttggaatgaagtctttaaaaaggtaattaagttaaaatgaaatcttttgggtggcccttaatttaatattactattgtcatgaaaagagaaagtttggacacagacactagtgtgttggaggaaagaccatgtgaagacacagtgagatggacggcggctgtctgcaagccaaggagagagccctgtgaataaaaccagccctgctgacaccttgatcttggacttctagccttccgaactgtgaggaaatacatttctgttggttaaactaccagtctgtggtactttgtggcatccttagcaaactaatacaccgttctaattcacttattgctcacctattgcagtgagacattcagcattaagtgctgcttgttaatgggtaaaactgtttgtcccttatactatgattttcaagtgctgttttgagaaattgtggtttcttttgcatttaggtactttaggatgattggaactgttttggtagttttgaaaaagtgtgtgatgataaagaatcttaagaggcaggtatccccaaagttgctgtaaatattgattgccactgtgctgtgtgcaatatgatgtagtcaaatattgcattgtatatgtcctagaggcctgatagtattctaagctttctagtgctggtaggaatgagttgctatggatttttctctcctgaagccaccctttcctgtctgcttctaaactttttaattctagagtgccaggtaactctttttgttgccatattttctctgatcagggtgatcagacatttctggtctgagtcaacccatattgaatgccttgggtattatcatttgcttttgatgactcatctttatgctggtagatcaggtccagaaaatcttgaaaacatatacaataaaagaaatattgtctaaattttagtagattctggttctatttacttagggtgtctatgcaacctactttcaaaatggtttgagaatgacttgcacaattaaacataacaagattattaaaaataaaatcacaaccaaaccattgatacttatatactgattcttgattttcatagatgaacaaaatccagcataactcttgggtggtgaaattcaatggatgtttgccctctgcctgcccctacccctgcttgcctattaacaataattattgtgagtgactgggacccagggagattaagcaccaggctagagaaatgaggagggccacaggagccagatttagattttctaggttctgggagatgagaaaactgggattgcccagaaaagaggaccctgtggctacagtctttagcaggagaataaaaagtatggcaactaagaatttgtagcaaaatcaaaagaatttaattgttgatgggatcatattacactgtttatcttacctaggatataaaagacatctctagtgagtcaggagactatttcttgactggtggataaaaggagaccctttgcgggtatccaccccaatgcagaatgtgggcaaataaaatctgaacttgactcattttttcagagcacttcttggtcttttgaagacaaagacaaataatgtataaaaattccagcagaagttaattgtgacaaaaaattgaaaagcacagagaattagatgtgaccaagcatctgagataagtttattacagtagttactgaaatgagatcttaccttttagtgggttgtgtaattttcattatctgatacaagaattttatctctctagagatataaatgtttccttgtcaaagaggaattatcccttgacgcctgatgtagtagggcattcaatagcataatggttaatgtgtgcaaccattatttttcttaaatgggtttctcatattgaccctctgtgttagccaagtgtataaagttctttctaacctgagttgatggatagatttccattgacagaagccattcatgaatgattccgagcacttttatttcacaaatgtttattgagtgcctgctaagtgccaggcactgtcaaagtttgcctggagaagtccttccctcatgaagcttatagaacaatggaggaggaaagacaaatctgtaggcatttaatgacaatctgagaagtactgtgatggggaaagtacaggatgtttttatcccacataggaggggtacctaacccagattagaggtagaaatggataacaaggtaaatgtttatggagctaaatgtctcaactcaggcctaaagcatgtttaagaggtggtcagaaaaggcttgaagggggagagagtgtggaggcctgaaggtaagcaagaaacttgggacatggagtgagagaaaatggaggctttgagaggtgaacagaaccacacagctagtaagtaacagccaagaacagacctaggaatgcccattgtcaaagccttggagagttgagacattatctaattcgtttgtgctgctataacaaaatgccatggactgggcaatatttatatattgtttatacaatagaaatttacttctgatggttctggaggctgggaaatccaagaccaagccttgatatctggtgagggatctctgcttgcaagattgtgccttgttgctgtgtcctcacgtggcagaagagccatatggaagggccaggcaattctcccaaagcctttattgtaagggcattaatctcattgatcatctcattaatctcattaatctcattgataaaggcaaagctctcatggcctaatcaccctgaaaagaccccacctcttcataggtggggtttaaatttccacatgaattttggagggacctatacattcaaaccatagcagacgttttcagtgataaagaagtctgactaaaaatgtgtttgaaaagctctacaaatgtgaaccttagagaaataaaaaactttatatcatttgtgtcttaaccttgctttattttgaatactactattcattgcataaatctagtcccaaacaataacttattaaattttcctcttggttctccatagatttatataaagtaagggcttgacatcacatgaactggctcattaagactcttgatggtcatctgttgccagtgagaattgtgttgttttagaaccattttttggatgattcatacactagaatctcatcatctagagtcatttctcctaatcttttaaaattaattataaattagaatccccaaataagaatcctaactatggtttattatgggctatttataaaagtactctctttaacaagtttgttctaatgcttcttccatgatgatatccatgagccttaatataatatttagattgtgtttaaaaacaaaataatctatactggctttttatttatttatttttttgagacggagtttcgctcttgtcacccaggctggagtgcagtggcgcgatctcggctcactgcaacctctacctcccaggttcaagcaattctcctacctcagcctcccaggtagctgggattacaggcatccgccaccacgcccagctaatttttgtatttttagtagagacagtgttttgccatgttggccaggctggtctcgaactcccgacctcaggtgatccacctgcctcggcctcccaagtgctgggattacaggcgtgagccaccacacctagcctatattggctttttaaatgaaacaatttctacaaaaagtttcacgtcctttaatataattacaaatatatttttccattttacaggaatatctttcaaataagaaggtggaaatctctaatacattgtagagagcacatttcatttcttcctcctttcttttttgcccaagtgagttcacacatccaataaatcagactaaactacatgtgaccagaaggatctcacagcataagaatagattatatctcttgtaaatctccaggatttcttgtttttcttgaatgtccccctctcatctttattgaagataatggacagataaaaattatgcatatttaaggtatacaaggtgatgttttaatttttgtatacattgtgaaatgatcaccacgctcaagctaattaacatatccatcacctcagatggttatcttttttctgtttttgtgctgagactatgtaagatctccttttgcaaatttcaattatacaatacagtataattaattatagtcaccatactgcacattacatccactgaacttactgattctgcaaaatggaaactgaaaccctttgaccaaccaagggattcttagaaacttactagtgtctgaggctctcccttattactgttcatatttattcattaaggactgagctaatacttgaccctaaaaaaatgtttgctctttaaagctgttcagtggtaaagggtttctttatatgattgctagcatttgccctccctgtgcactatgccagctcatagggaaacaagaataagatgcagttcgtttaaggagcccacagtttagggtgggatcagggaaagctatacagaggaggagatggttgagctgttttgaaggatgactaatttgagggtgagtagttcagtacttttgggtgtggtgagggacaataactttttgagcatccatttattttagctggccattcagtggttgatatcaaatgtttactggataaatggaagtgatggattgttgatacagcttagctattttgcatcttttttcccactagtatctcaacctgacacagctttaacagccagaagttttataagctgcaaaaatgagtactactgatattttagctgaggttaaaaatgtacatgtgaaaaccatggcacgagaactatgtgacgaatgcacaagcctcagtaaccaatgctatcaactggaagaaagggtatcagcgatggaagacaaaatgaatgaaatgaagcgtgaagagaagtttagataaaaaaagaataaaaagaaacgaacaaagcctccaagaaatatgggactatgtgaaaagaccaaatctacgtctaattggtgtacctgaaagtgacggggagaatggaaccaagttggaaaacactctgcaggatattatccaggagaacttccccaatctagcaaggcaggccaacattcaaattcaggaaaaatagagaacgccacaaagatactcctcgagaagagcaactccaagacacataattgtcagatttcaccaaagttgaaatgaaggaaaaaatgttaagggcagccagagagaaaggtcaggttacccacaaagggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagatttcgtcaccaccaggcctgccctaaaagagctcctgaaggaagcactaaacatggaaaggaacaaccggtaccagccactgcaaaaacatgccaaattgtaaagaccatcaaggctaggaagaaactgcatcaactaatgagcaaaataaccagctaacatcataatgacaggatcaaattcacacataacaatactaaccttaaatataaatgggctaaatgctccaattaaaaggcacagactggcaaattgggtaaagagtcaagacccatcagtgtgctatgttcaggaaacccatctcatgtgcagagacacacataggctcaaaataaagggatggaggaagatctaccaagccaatggaaaacaaaaaaaggcaggggttgcaatcctagtctcggattaaacagactttaaaccaacaaagatcaaaagagacaaagaaggccattatgtaatggtaaagggatcaattcaacaagaagaactaactatcctaaatatatatgcacccaatacaggagcacccagattcataaagcaagtccttagtgacctacaaagagacttagactcccacacaataataatgggagacttaaacaccccactgtcaatattagacagatcaatgagatagaaagttaacaaggatatccaggaattgaactcagctctgcaccaagcagacctaatagacatctacagaactctacaccccaaatcaacagaatatacattcttttcagcaccacaccacacctattccaaaattgaccacatagttggaagtaaaacactcctcagcaaatataaaagaacagaaattataacagactgtctctcagaccacagtgcaatcaaactagaactcaggattaagaaactcactcaaaaccgctcaactacatggaaactgaacaacctgctcctgaataactactgggtacataacgaaatgaaggcagaaataaagatgttctttgaaaccaacgagaacaaagacacaaaaaaccagaatctctgggacacattcaaagcagtgtgtagagggaaatttatagcactaaatgcccacaagagaaagcaggaaagatctaaaattgacaccctaacatcacaatcaaaagaagtagagaagcaagagcatacacactcaaaagctagcagaaggcaagaaataactaagatcagagcacaactgaaggaaatagagacacaaaaaacccttcaaaaaatcaatgaatccaggagctggttttttgaacagatcaacaaaattgatagactgctagcaagactaataaagaagaaaagagagaagaatcaaatagacacaataaaaaatgacaaaggggatatcaccaccgatcccacagaaatacaaactaccatcagagaatactataaacacctctacgcaaataaactagaaaatctagaagaaatggataaattcctcgacacatacactctcccaagactaaaccaggaagaagttgaatctctgaatagaccaataacgggctctgaaattgaggcaataattaatagcttaccaaccaaaaaaagtccaggaccagatggattcatagccgaattctaccaaaggtacaaggaggagctggtaccattccttctgaaactattccaatcaatagaaaatgagggaatcctccctaactcattttatgaggccagcatcatcctgataccaaagcctggcagagacacaacgaaaaaagagaattttagaccaatatccttgatgaacattgatgcaaaaatcctcagtaaaatactggcaaaccgaatccagcaacacatcaaaaagcttatccaccatgatcaagtgggcttcatccatgggatgcaaggctggttcaacatacgaaaatcaataaatgtaatccagcatataaacagaaccaaagacaaaaaccacatgattatctcaatagatgcagaaaaggcctttgaaaaaattcaacaacccttcatgctaaaaattctcaataaattaggtatcgatgggacatatctcaaaataataagagctatctatgacaaacccacagccaatatcatactgaatggacaaaaactggaagcattccctttgaaaactggcacaagacagggatgccctctctcaccactcctattcaacatagtgtgggaagttctgaccagggcagtcaggcaggagaagggaataaagggcattcaattaggaatagaggaagtcaagttgtccctgtttgcagatgacatgattgtgtatctagaaaaccccatcatctcagcccaaaatctccttaagctgataagcaacttcagcaaagtctcaagatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggagctcttcaagaactacaatccactgctcaatgaaataaaaggggatacaaacaaatggaagaacactccatgctcatgggtaggaagaatcaatatcgtgaaaatggccatactgcccaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcgagctacttgacttcaaactatactacaaggctacagtaaccaaaacagcatgttactggtaccaaaacagagatgtagaccaatggaacagaacagagccctcagaaataatgccgcatatctacaactatctgatctttgacaaacctgacaaaaagaagaaatggggaaaggattccctatttaataaatggtgctgggaaaactggctacccatatgtagaaagctgaaactggatcccttccttacaccttatacaaaaattaattcaagatggattaaagacttacatgttagacctaaaaccataaaaaccctacaagaaaacctaggcaataccattcaggacagaggcatgggcaaggacttcatgtctaaaataccaaaagcaatggcaacaaaagccaaaattgacaaatgggatctaattaaactaaagagcttttgcacagcaaaagaaactaccatcagagtgaacaggcagcctacagaatgggagaaaatttttgcaacctactcatctgacaaagggctaatatccagaatctacaatgaactcaaacaaatttacaagaaaaaaacaaccccatcaaaaagtgggtgaaggatatgaacagacatttctcaaaagaagatatttatgcagccaaaaaaacatgaaaaatgctcatcatcactggccatcagagaaatgcaaatcagaaccgcaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtgatgattcctcagggatctagaactagaaataccatttgacccagccatcccattactgggtatgtacccaaaggattgtaaatcatgctgctataaagacacatgcacacgtatgtttattgtggcactattcacaatagcaaagacttggaaccaacccaaatgtccaacaatgatagactggattaagaaaatgtggcacgtatacaccatatactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaagaggaacatcacacaccagggactgttgtggggtggggggaggggggatagcattaggagatatacctaatgctaaatgacgagttaatgggtgcagcaaaccaacatggcacatgtatacatatgtaacaaacctgcacgttgtgcacatgtaccctaaaacttaaagtataataataataagaaaataaataaaataaaaaaaatttacatgtgatcttactcctttgagaggtttagttaactctgttgctgtgaaatcactaatgttctcatgtctgaatggaaacatctagtgacaacagtgcttttagaagtaaataatatgtctattttcatgcagctttgaattcctgggttctttgtatacgtttgattcagtgaactatgaaaaaatgagcaaaccttaagacaccatgaagtattttcaataaaagcagtttgagacaaggttttcaggttggcggattaaaggaatcaaactgttccttcacccagcaccgtgaacaacacccgtactacatttttcttgttttgagtttatctctcctgaagatatgctgtttggaagtatttttttattattaaaatattgcacgacttgtttgaaaatttatttttgctggttattttttatgcagaaaattctttcttcctataaggcccagaatataaggctagcttaatgccttgttgtgttgatcagatactaatatcagtgtagatgatctcgtactcattgttgcattagatctattgtcatggtagccacaccatataggaagcaaaagaaaactagtgtttttgtctctttctttgaaggcaacttcctggtaagtaatgattaaattatatgactctcaaagtacaaaaataacacaattccttagatattactccacatttgtgtagcaccaacatgcaggtagttagccatgataatggatattatgttcatgaaaaatcggtgctcaaaagtagcttttagaagggaaacaaaaccttgtatattagtaagatttatctctatctcagcggtgaatgatacagggtctgtaatcaaaatgtttttcttagtataatttgactactagctctataggtaatacctttcacagagaagcatggatgcccatctcctctcctttgtgcacaatcctgagggttagtcttgtccttcctctgcccttggcatcaagggacctccaggaacctgagagtgtgtatctttgggctgtatctactgtcatctgcttccacctgtgtgagggatccctggttcgctgggagatactttcctgccagcatttttatccaccgttgatgaatcaccctctctcatctgccacatctggtagggctttgagtgtcacaacctcatgcttttaattatttatttttttagtagaagatacagttttcttactgttgaagaaagcatagttcaacctcttttttgaaagttgggtttcagtgttttcctgtttaaagtcaatatatcaaagaaggctaagaggtgagccactcacttttttttttttttgacttagttgtgtgtagtgtttgaattgcagggatttatacaggctactgaattgaaaagagctttgattgtgatacctcagtgaaaacgattacatgtatgtttgtgtatttgtttcctgtttccaagaacaacttgtagctttttaaaaatgagcttcctttttatcatgacatgttgaggttagataaatctttaaatgtcctgcaatctaactccctagctgattttcgaatctcttcttatccctattgagagctcttctggtgtattcctgaacacttccagacttaggtagctgattcttaaactatgctgattgctatcaagtacttttttttttcatgtcattctgtaacgttttatcccctggtttcaatttttgcacttaaagcaactcactcatggagactgagcattaggctacttcattcagttatcagcacctcctggaaattggttcctgacattgctattgtcccaaagataacagccaaagttctgttcgtatgtgtttacctagaatataaaataagaatacagatcattttccaagagtggaaaattataaaaagaacttttctaaggcatgaaaaatactatattttaagcacataagaagctatttatagtttcttcctgccagtgtccagtgctattaaacagcaggagatttttatagtctgaaaagggatattttgagtctataagaactttttgcaaggtgatagcaatctcaggttgaattctgccagattttgctgtctcaatatgatttacaaatgaattgaagttaatactgtctgttaagagagaagttaatacctacccattattaaatataaaaccaatgtgttaaatataatttagttttatttctaaaatttcattgaaatataatgttttagcattctggttagaattgaaatgcagtaacacaaatatgtttttagtatcttctttacagaaaatattagtttattctaaaaattaaatttgatgccaaaaattaatttgtatctggttgcattgggaagaataatgtcaaaaatgcactaacttcctttgccttgatttggggaatgatggtggtgtataaaaaatgatttagaaaccatcagtatgcaataccacaattttgtgattattgttatcttttgttattcttaacacatctatcttccaaatgcgattgaaaacagggcatgctgtttaaactggctctttggccatagtctttgttcaaaacaggtcaccttttgatgattttacctaaaaacattttataaataactgtagttattttctcctgtgttacctatgagccagcagaaacttttcttctgtgtttatggatttaaaagagttttttgtttgtttttttggtttgtaattatgacattcagcttattacttctttcatatgtaatacaaatgttggccaaaaattggtatttttccatcgactttgaagaactgtagaaaagaagtcaaacacttgtaaatcgtatgttttggtgattctaagtgatactccttgggtttccaatgaacttcaggtacagagggctgttgttaattgtctttcacatttatgccatgttagatcattgatctgagcaaagccccagtattgtttaatgttttcattatctttatctatctccagtccccatcttattttccctgaccatatcctaatgaggcaaccaacccgatgtgttttacacgatctttttattataggtgttcttaaaaattacagtttgtggacatgtaattttatttactaaaaatagtgttatgctatagatctctactcaatacaatgtttaaaggtctgtctgtaaacctgtgtacatttttatatctaaccgtggtagagtaccctatattgtgtctctaactgcttcatcccccagggggagctatgtagattccccgtggctctccacaaccacaagccatattataatgtatatgtataaatcaggatgaatagagcccatttatacatatacatatacattggctgtataggccaatgggctttatccatcctgatttatacatgtgcgttataatatggcttgtggttgtgttgctggtttattgggccagtgtgtacttaatttgatgaagtacttcaggatcgtcctccagaagggctgcactgatctcctcttgagcaaagcatgatgttcactagagtgttcaaatctcatatttgtttttgggatgaactaaatgactttttttccctaggcatagttactctctgtatgttgggtttgaatgggtgatttcttacagtagacaagaaggtacttgtctgaaagttaaaggagaggagataatgaagtgagaaaaggatgagggaaaaagaaatacattgcttatcagctcctaaaactaggcctgacacaaggtagagggtcagtcaatgtttgtataatgagtgaattaatagtgtggtatggtagatgttttagatttatagctaaatattttgacttacattctgcttctgccactggggggaaatcgtgagaccactctgaccctcagtttatgaaactgaaaactgagattgatggaagggctaattgaggtgcagtatgtgaagggactggcatgtataataggcatttaacgggtgtttcattcctttggcaaagtatactttctattacatgaccagtaataatcagtttcttctgcaaatattctgtcataagtcaattctgattttggcctttttaatggctgctgtaaggatttgtgaacagtctgttatttcctattttgctattcatggaagcattaagtaaggttttacttaaaaaccactcagagttatcatggcttcactaacacagttgtctgtgctgcaactacgtaaattttgacctaattttttcccgatcacctaaaacctataaaggactattttgaaaggtcttatattgtaaagcctcatttatacaggcttctgggaatggagttttacacattaagtaggttttccaggtaacttaaatttattccttgatataacttttatatatccttggtatatctttgatatattccttgatatattcatgacctatttcttgatataatctttatatatctttaatacaacttttaaaaaaggtgccatttaaaaatcctctataatatgttaaatacatttttttgatagaatgtattagatgtaattttactttttaatatgcaaaattattggtttgcctgtttaatcagcaatatgataggctttgtgactgttttcttgttatataggttatcatatttgccctgagtgaacctgttgtatcagcccagctcttaactaatttgttcctttttaatgtgttagagccagaataagaaataaccaaaattagtagcattttatgttagtcatgggttagtaaccttgaataaagacttgaggtcttctctggccaagtgtaagagacgccctgccttgaaaatagtgcttttgaagactcaactttgtatcctagatgctggccatgttccaggtacttaagagtatcatgaatctgaaatctggaaaacaaagggctttatttcaatttttagcaaaataacttcagaaatgtagctattaatttgacacatactttgtagagttacagagtttgcaccaaattccaccatctacagatgaagacccagaaatttagtagtggacacttttgtccagggtccccttggggtgtgttgagccctagaacccaggactctggactttcagcccatagctcttgtcattctcctttactaatagggacagtattgcctatagggctcttatatgtgtaagctgtagattatgtatgtggaattattaaatgtaccgtctgtacctaaatatttcagaatatttaaatagtaaagattaagtaaaaagaagaataagtatgtcaaaacattaatgaagattctgggactgagaatatgttttgaggtcttcagtaccagatttgattgctataagacttcctctcctgactttggtaagagccaagtggcctataggggaagaaggggctatcaaacctactagctatagaattttccaggaggtatgtatttgcaaactaaagcttctaaaatggtagtttagatttggttttcacctccagaattgtcagcaaaaggataaaaattttagctcaaagttaacagggcctggaatccaggcaaaataacactaataatcaacttaatcactaataatctacacatttccagtgtgtgttatagtgtccaaagtgccttatatgagctaactcattttgttctcacagcaaccggggagatagttactatttgtattagtttgttctcacatggctataaagaaattcctgaaactgggtaagggtttatggagaaaagaggtttaactggctcttggtgttgcaggctctacaggaagcatggctggggaggcctcaggaaacttacagtcatagcggaaggtgaggggaagcaggcaacgtcttacatgaccagagtaggaggaagagagagaagggggaggttccacacacttttaaacaaccagatcttggataacttgctcactgtcacgaaaacagcactaaagagtgaatcctccctcatgatccagtcactttccacaaggccctaccttcaacattggggattacatgagatttgggcagggacacagactcaaaccatattactattattatccccgtttgcagatgatgaaactgaggcatggaggagttagatcttgaatgttaagttgtacatatagttgatttcatctgcattctggctctggatctccaccggctgtctaaagaggcacccccatatagctgcaagtgcaaaggatatccagattttcaccaggctttctccttttccttagagagagaatgtgggatttttgtgggtgacacagatttacattggttcttgggaaggtccagcccttttttagttgtgtgttgacactttatagaatggatcatcacattaagaagggttagatttaaagtctagagttctcagacaagacaaaataatttatttcctgttaaattaacatatgcctcatagaggctaccagatttcatgaaatttcttaccaagtctcttctagacaagccttttgtttttgcctcaccacaacaatttctgcaaacaaaaggtggtatctttctacacggttattctttgtcatatttaagcaacttttgcagaggaaaaggcttatgggtggggattcattaccacatgctgaccctggaccctgtaggatggtaggaaaataaagtagaagcaaagcagaatagggatgcaaaaagtagtaacttcagctgaaaagtgaaatgtagtgggctaagcctttgctctcaaggttcaccaagtggagctgatgtttcgctaggcagaagaaaacttcagtttaggagtctttctccaggccttgtccacctactcacactacaggctgtcatggaccttaacgttcctaggttcccactgtttggtttttactctttcaagcatttcgtcagttatagcttgaaatctgtatttccatattgaggtaaacagagtaccttcatttggattttaccttttagattgcagatctagtctgtttatttttctggatgtttgctctctgaagggtaaagcccgtcatgcttaatcatcatttgcatttttttcttaacttctctgctgttcacaaaacaatctaattctttaagcaggtgtgtagtcatgtcccttggttttatctaagtaaaatgagaaaaatcttgttttccaatcaatcatacttgcattttgacatgaaacagcaggtatttgtcaaaattaattgttagataaacctgtataagtgaaaaagagtgggatggctgaaatcatttttaaaaatggaaaaaggtgctcagaggatctgaaaaatgttggattggattgtaccttaccttgcaataaaaggagattcacatctatttaaggactcttgcttttcaacattcacatagtgagatataaatgcagggctattttttttaactataagaaagtatatttaaaatttgaccattgataaaactatgacatcccatatgataagttgcagtcagatgcttgcatggtaggtgatatggtttggatctgtggccccaccgaatgtcatgtcgaattgtaatccccagtggtggaggtggggcctggtgggaggtgattggagcatgggggcagacttctcatgcatgggttagcactgtatccccctgggtactgtcctcacaatagtgagttgagttctaatgaaatctggttgtttataagtatgcagcaccaccccccttgcatcctcttcctcctgctctggccatgtgaaatgccggcctcccaccttcaccttccactgtgattgtaagttttttgaggccttcccagaagctgagcagatgccaccatgcttcctgtatagcctacagaactgtgaaccaattaaaccacttttctttataaattactcaggctcaggtatttctttatagcaatgcgagaaagtactaatacagtaggatttattgtatggctttttcctgcgtgcttcatttaaaaatgtacttttcttaatgagattttgtctgaatgtccactgttgtgtatttttaagccgtagtctaatacttttgtttggtctcactgatataaaaatgcaaacttgccttttaagtttataggtgtctttaagctttcctgggtcttttatttcctgatagactttattttagcccgtaaatttataggctggtattcaatggtgattatagagcacagatctgcagaccaatgatcctgtgcagcctgcttgggcttccctcatttctaggtctgtctctcagtggaggtaagggtttaatgaaatgaagaagagacaaagagtttttctcctttataaataaattgcctagttcacttttttttttgagacggagtctcgctctgtttcccaggctggagtgcagtggcgcaatctcggctcactgcaagccccacctcccaggttcacgccattctcctgcctcagcctcccgagtagctgggactacaggcatccaccaccacgcccagctaattttttgtatttttagtagagacggggtttcaccgtgttagccaggatggtcttgatctgacctcgtgatccgcccaccttggcctcctgaagtgctgggattacaggcgtgagccactgtgtccggccgcctagtttactttttatcactttactaacaggtcttagaaaaggctaggctgggcgtggtggctctcacctgtaatcccagaactttgggaggcagaggcgagcggatcacctgaggtcaggagtttgagaccagcctggccaacatggggaaaccccatctctactaacaatacaaaaattagccgggcgtggtggctcacacctgtagtcgcagctacccaggaggctgaggcaggagaatcgcttgaacctgggaagcagaggctgcagtgaaccaagatcatgccactgcactccagcctggactgagactgagactctgtctccaaaaaaaaaaaaaaaaagaaagaaaaagaagaaagaaaaggaaggggcttagtaaagccccctgcttttcaaatatcacctaatgaagctaaacatagcatgcattgaggtacctactaagttccaggtgctgaaataggcattttgtatttgagtagtaaagaccttgtcttatttctgagaagtcatcaacaacataagacttgtaacaaacgcaccttataactctatgaataattttctcaatttttctctctgagatcgctggcaaagttttgtccaaaaccaaggattcattaaaatggcagcttgtcatgatgaagcaatgaatatcccaagttacttgttcatcctcagtagtgaagttagagacctgttgtcaccaaaccatcatatgaaaagaagatagcaatagatgtttatattagtttctttttcattgtcagaaatctttgtacttttgagacatagaagaatagctgttaaatcaaaagcagtttttttgtaaagagataatgtttttggaaaagtgactgctcattataaaatgtcaagtcgatacaaaaagaatacaaagaaaaagtgaaaaacagattcgtattcagaagtaaccattattaatattgttaaacttaattcagagaactctgtatgtatactgatagaaggcttgatagtgtacacatatgagattattctataatgatattttaaatataaatgattaaatttaacaaaatttgaatacaatattaaatttatttttcagggggagattatttgtattttcttttttcttttttttcttttggagatggagtctcgctctgtcacccaggctggagtgcagtggcttgatcttggctcactgcaacctctgcctcctgagttctagcgattctcctgcctcagcctctcgagtagctgcgactacaggcatgcgccatcacgcccagctaatttttgtatttttagtggagatgggatttcaccatgttggttaggcacgtctcaaactcctgacctcaggtgatccgccggccttggcctcccaaagtgctgggattacaggtgtgagccactgcgcccagcctgtattttctttacctctgtatttttgacattgtaatgaacttgtattattttcatagttaaaattatataacaaaaaataaactatggtaataagttttatgtaatgaagacaagtatcagtagtggctgtgtgacacatgagtgattccttctctcctcctgagcccgtggctttgacattagctaatagttgtaggagtctttcctttggatcccagacttgagctcagaatctttatcaacatagttttgtagattgtcagacccaattgactgcagttagtcttgaattgagactcatttcctagacttggtctctttatttagttccttcctagtttttgctttctaattatgcatcatagttatgaagtgcatatactgtgcatgaaatcacattaggaggaattatacgtggaggaactcatggtctgtgattctaattatgagcaccttcttttggggcttaataaatattaaatttaaaagaaaaacaaatgaaatgaaaggaattggtgaagatcagacaaatactgtatttctttataacaaaacatattacttgctaaaaaaatcctactaaagttgtgaagaactttgtatggagtcgtttaaaaagaaatgcctcagattgtatatttaagaagagaagaaatttatatactaagacttctttcacttcattctcacctgttataatgttctttttacattgccaagatttattaaatttgtgttttgtttagtaaccacaataaataccaattctttacttaaaataactgggcccatcatgggtctttttagcatggtttctccatacttcctggattatttgtgtttggcttgactggaattaattaaaaagcagattgtctgagaaagacttttgagtgttgtatttcatgagttcttcaacagttgggaagtgtttgaagaataacttggctggacatgaaattttgaatcatactttccctgggactttatagaaatggctcagcttaagctggagatttgctcagtgagtgtgaggccacctagtttttccttttagagagctcgctttttcagccttagatggtcatatgatttttctttatcagtaacttccaggtgtactaacactatttatgttcattgttttaccagtttttccaggaacatggtatagttttttgagctgcaaattcaagtctttctttgattttaggaaagttctgttctgttatatttttacctatttttttctcttccatgtgttttatttaggagtacctaccaacaagatgtatcttttatcttttttgtctatcatctctataccattttatcattgattcctgactgtattttcgttgtttttcctttttctaatttgggttgcacccttgtactatttattttttatttcatttttttctctcctgagctttgccagctgccttttcatgttcttttatgatgtctctttgaagtccttttacaaaagaggttctttctataatttctttgagatcagagtatttgaacatttcctctgttttcttatgatgcatatccttcatctcccctgcggtttgctactttccttctttcttttcttcctggttatctgtgttcttttctttctcattatgattcttccatgcatggggacagctatttgctgaagcagagtgtggggaggagagccagtggggacagggagggaagagtgagccagggttccacagcttgtttggagtttgttgttttgatcactcttcaccagtctgttgttctctgccttggaggggtgcatccctccctaggggcataatcaggacagtggagctcatagcagaacctccttggagctctgtgtggcaagcaggcgtttgaactttcacatttcttcacttcacccctagaaggtcctctgacctgttgaaattctggggatgcatgtgttggcttagacttctcagtatttagctttgtagtttttagcagcttgaaattggactaatttctttctgtagggaatgtgtagtaattttttattcctctttttttattcctttgttgctatttatgaggaacttatctgtgcaaggaatccaaataaggaaaaattaatgatagtctaagacagaaaatgagagggaaggaaacattttcattccctggaagtattttgattgttacatatttccctaggtatgttacagtgtcagtggccttggatgacaaggtaacgaatgaggttctgttaactaggaacattcactgaggtattcaacactaggtgcagatgactgggatttggaatatttagaaggtaatttcaatgacatatgtggtgaaatgtaggtaactgtaggaaatggtgtaatgcttagaattcacataaaagagataaagagaactgatagccacatgcttatttcatgagattatgggtttaaaaattagaattactttcaattttctaaacaagctgcttaatagcctcttaaaggacgaacaaattcaaattcttctctagttaagaattgtaagaatgatcaggcatgagacacagaaaaaaggaaaaaagcctcattatgctattacttcactcatcatttctgattttaaattgcagtttagtgtgggtatttaaattgctagctatttcaaaaatgtcctctggttttagatactataatcagctgaaaaggctattgagtgccgttacatggcctcaagatctaaaaacttttgtataaaaatagaacaatttataatactgatctgaccctctgagcatgcatgtgaagacattcctagaataaccctttttagaattattggatgttctaaatagtctaacaatgtaacgtattgtctttgatgaaaaaatagaaactctgaaaaagactttttttttgagcaaaaagcatctggaagtgccttgaactatataaaatgagtgcacagatatacctagttttatgttcttcacttaattgtgctttgcagatattgtgcttctaacaagttgaaggtttttgggagccgtgcattgagcaagtctattggcaccatttttccaacagcgcatgctcacttctctgtctgtgtcatattttggtaattctcgcagtatttcagactttttcattattatttaaattattatgatctgtgatcagtgatgtttgatgttactattatggttgttttgggggtaccacagactgtacccatagaatccagtgaactttatggataaatgtgtatgtcctggcttctccactgactggccattccccttctctctccctctctggcctccttattccatgaaacacaacaattttgaaattaggtcaattaacaaccttataccggcctctatgtgtttaagtgaaaggaagagtcacatgtctctcacttgaaattaaaaggtaggaattactaagcatagtttcaaggcatgttgaaagctgagacaggttgaaactgaggcctcttgagtcagttagcaaagttgtgaatgcaaaggaaaagtttctgaaggaaattaaatgtgctattccagtgaacacaggaatgataagaaagtgaaacagccttgttgctgatatggagaaagttttaatgttctggatagaagatcaaaccagccaaaacattccattcagtgaaagctgaatccagagcatatctcccctcaattttatgaagacagagagagatgaaaaagctgcagaagaaaagtttgaagctagcagaatttggttcatgagatttaaggaaagaagctgtttccataacataaaagtgcaaggtaaagcagcaagtgctaatgtagaagctgaagcaagttatccagaacatctagctaagataattaataaaagtggctacactaaacaacagattttcaatgtagatgaaacagccttcctattggaagaagactccatctaggactttcctaactagagaggagaactcaaaacctggcttcgacgctgcaaagaacaggctgactcttgtttggtgataatgcagcttgtgactttaggttgaagccagtgctcatttagcattctgaaaatcctagagcccttaagaattatgcgaaatctgttctgcctgtgctccataaatggaacaacaaagcctgggtgacagcacatctgtttacaatatggtttactgaatattttaagcacactgttgagacctatggcacaggacaaaaaaagattcctttttaaaatattactgctcattgacaatgcacctggccaccaaagagtgctgatggagatgtacgaggttaatgttgtttttatgcctgataacacaacatccattctgaagcccatgaatcaaggagtaatttcaactttcaagtcttattatttcagaaatacattttgtattacattttgtaaagtgatagttgccatagatcgtgattactctattgggtctgggcaaagtaaatagaaaaccttctggaaaggattaaccattctggattccattaagaacattcctaattaatggaaggaggtgaaaatataaacatttacaggagtttggaataagttgatttcaaccgtcatggatgactttgaggggttcaagagttcagtggaggaagtcactgcagacgtggtagaaagacagtaagagaggaacaactagaagtggagcccgaagatgtgactgaactgctgcaatctcatgataagacttgaatggatgaagagttacttaagtggtttcatgagatggaatctactgctggtgaagttgctgtgaacattgttgaaatgacagcaaaggatttagaatattacataaacttggttgggcagagtttgagaggattgactccaattttgaaagaagttctgctgcgggtaaaatgctgtcacacagcatcacatgctacagagaaatctttcatgaagagtcaatcaatgagacaaacttcattgttgtcttatttcaataaattggcacagccactctagccttcagcaaccactgatcactcagttcagcagccatcaacatcaagacaagaccctctaccagcaaaatgattacaacttgctgaagggctcaggtgatcattagcgttttttagcaataaagtatttttagatataatgctattacatgcataatagactagagtacagtatagtgtaaacctaccttttatgtacactggggaaccaaaaaattgtgtaacttgctttattgtgatacttgctttattgtggtagtctggaacagatcctgcagtatccccaaggtatgcctgtatctcagtatagtcgtgatcataggtcttgcttttctttagattcactgttggtgttatcatccatgaatttcaccttcctgtgtacaaacatctcttattacagtaggagaatatgggagtcagaaaaggaagacatttattgtcattatgaactcagaaatatgttttctagtgatcattgaaacaactgagattgatattttccagccacggcagttttggtgattgaaagcaagatctgttttttaaaaattaaatataagtttgcacattcttccagggaagggcacgggataatttcccttgccattttattttgaaaccagctttgttgtggtggcacgctccatgagatttgctccatgagatttgctccatgttgcaccacacacagtctttgctcctgtgtccttccatagaaaaaaacagtgtggggaaggatttggtttgtcttaccctttaatcttctgctcctacagctctctggtctgatagttcactattttggtaataaagtcagatatagttcaaatcctgtctggtctattatttcgtgaaatttttgaacttttccatgctttggcatcctccaagaactttttcctttctaagttttactgttttaatataaatggactcctatgtgaacacttttagactggagtctaaaagtggcctaataggcttgctatttttagagaaggagaaagttgccttttgttctctctgtgcttttcacctcccacatgttctttagagttttttttcctgttctggtcttagtagtgacagctttctaattccagaggctttttcctgggtctgtttctggctcattttgtctcatactcaaaatttttaatgtcagaattgggctgggctcttctctttctattatctgtaaacattttgggtttcttttcctctaatttatgaaaattatgaaatgtacacataaaggagtggaaaatatattcacccagtttaaagaagagtaataaaatggacattcgtatatacccaccatccaggttgagaaatagaacattgcttgtgtctcagaagctctctgtgttcctctcagtcacgttcccccaccccaactcctacccaaggtaacctctcatcctgaagcttacatggaagatttgggcatttttattaaaaaaaaaaaaaagaaagaaaaagccaagtagtgataaaaaatagtaacaatagaattttcaggaaaaaaataaagataatgtaaatgcgttttttttctaacattccacaaaagaataatttgtttaggattgaggagagaattaatgcttgtcttagtctgctcaggctgctatagcaaaatttcatcaactgggaagcttaaacaacatttatttctcacagttttggaggctaggaagtctaagatcaaggcacctcaagatttagtggctggcagagaccctcttcctggcttatagacaagccaccttcttgctgtgtcttcatatggtagagagagagagggagagacaaagttctttggtctcttcttaaaaaagagaggacttcacccctttgccctcatctaaacctaattacctcctaaaagccccatctcctagtaccatcacattgggggttagggcctcaatatatgaattttgggagggcacagacgttcactcttgaaggatttcagctattcgtgctgtgtcactgaaattagaactagtgtaaaaagaaaagttcacgtacatataatgcaaatattcagtgagctggcacccaacctacccttgtttgataaggaataattggaaattttctattttggcctagcagtttgagggcagacaacttcttctgacctcatttcctcctgatcattgtggacatacaccagcagcatttccttgtcttacaatagtaagcttgctaaaataataataaataaataaataaaaataaaataatagtaagcttgctaaaataaaaaaacacgctcgtacacacaacacatacacctaaacacacgtatgcactttctttgtaaagctctgtttgaaatatactaaagaggactgttcctgaagtaatcttgcagtcatgtctgctctcatcctttgttctttcagcctcacattcccagtcttcatgggctgactgcctgggattgacttttgccttcacagatacttatctgcaaaagatagagacagaaagtagcccgagtctcaaagttttcttgctgccactgccgtgtgctacctcagacccctcattgcttacctgggggctaagccctgcctctaggaccctcaggttcctgtggattcctgtcttgagtatggtgtgccatcttgtttttttctgagctgcttgacttgttgactcttcatcaacaaatgttagaatgcctactctgtgtaggcagctataccaagaactgtggatgcaatgtggtgcctgtcctttttatgggatggttattttggagagtcttgtttgcttttctagtgtccacaggctggtatgatctctagcctttataggcatttctcttgacccagaattttgactctgctagaccacaagcttctggatttttcctggagtggccacttcatttttctacccctgtcatgagttaccaaccttggtgtggctttcctggatgtgaatcagttcatttaggacttttctcatatcttctctagtcctaaccattctggttcctggaactgatactgatagtaaattcgccataatggaccatatacagttaatgctagcatttctaccagggttctaaaaatgtctggttttaagattaaattaaaaatagtccctctgaaagacctaaatagaatagtttctctctttttctgtgtcagtctctttgggatttggctgcttctggaatcttacaaaggttttgcttttgatccaaacactgcaaggcactttgtgaatgtgagtaagatagtctacatgggctgaaaatttaagaccatttaatgaaagttgtctggctgcaggaaaaatgctcatttttacaaattgtcttaaagttctgatttatagatctgttctgcatttttctactaccactggattttattactggcacattatatttaattaggatagaaggaatgtgtgtgctcataattatttaaaatgatttcaggacatatatttagagaatcgagtgtaaatacttaataatagttaaaagataaaaattcagttttagtattatgcaaaatgtctagactctataattagcctggagtagattaaattatgcacctctaatcactattttatacatgtctttcaaagtgacatcaattgtcatcaaatttgcttattataagattttgctggatgagtacttatattttcagtatatttattttttagtgtctttgtgattaaaaacatgttagcatgactctcaggtttttaaaatttgttttaattacaattaagtgatggttttctaattgtgttgtctgattttcagcagaccacttaaatagtttggtgttaatgcaactgtggctttagcagatcttgatcattagctctcagatgaatttctatgtaaaggaattttgttatcaatctaatctgtagaaagagtgtatcactttacatcttggtaattggggtacagtctttttgttgaggtacatagaaatatgtagaattagaagaaaatttcagcagctctttacagcatataggcaatacgaatagaactgttctttcagcaccttctgaaaaagatgggcctgaagtcatcccagtatgcaatagctgattatttgacaaagcatgtatcaaatagatgaaaatatcaaatagacgtgtgtgttaatagtcctcaacttccagtttagcctaggtgtatatttaaggtaggagatgatgacaatcatactcatattcactcttttagacttagaagttttcttggagaccctataattcaacattcttggtttttgtaagggagaagactagttggacaatgttagttacttctctgagatctcagagatggtcagctcctgggtgcctgtttagttcaggcattcccctgtgacaggatatgacagcacagtgaaaaagggccggttagcacgctcataaacaacactgaatctgaaagtccacaccagttggaagaattatcctttccaaagaagctacaaatgactgatagtttttccaatatattctgtaattttcagaggtatcttagcttgttattattttaaaattgtacataatttagaagaatgaaaattctgtttgttagagaaattagttgtgatttaggtaagcaaagcacaatcatgacttttttttaaacaatcgaagtcccagtgaacaatttttgtgatgctatgaaatgtgctcagaaggtgggcttatttgaaggtcatttttctaaatgataacttaaaaaaatagttgccactttgtatgatagtagttttgtacccacatgaagaaagcattaaaaattctctgttctctttctcttcttggtaggttgtgttcttatctaccatactggtttgagattactgtagaagtatgtttctaattgctacattgtgacaattacttaaacatatctactatttaagaagaaccagcctggcaaggtggctatttcttctaataccagcactttgggaagccaagaagggaggattgcttgagcccaggagttggagaccagcctggggaagatagtgagactccatctctacaaaaaaataaaaaagataagccactcatggtggcacatgcctgtggttcccagctacttgggaggccaaggtgggagaattgcttgaacctgggaggttgaggctgctgtgggtcgtgatatttctaccaccttctagcctgggtaacagagcaagagcctgcctcaaaaaaataaaaaataaaaaggagcaagattatcatctctaaagattcctgtgttatatgtatgaagggtaccatgattgcacagaatattgttttctgtatagtacagagaaatcaagggtgacaacttcaaatgccttttactttacagggttgtgcagacatgccctcagtctgtctcttggggatttgctctacagaggcccctgtctcagttcagccagtagatatattccaggctcaggttgtggtggtgcaggagaaatcaagagttgggcttctcctaggtaggacaaaaagagaggaagagagcacacaaaagacaatagtagtagttctacaaaaatcttactcttcctttattaaaacagtgtaaaattacaaagtacacattagcatttgcataataaattttaggacaaacatctataacttacagtgaaagaatttaaagaaatggcaacatttagttaaaaacctttatctttgttaatcatttctttaattctcttcttcttatttttttctctcactcagtatcttcggccgttaattgaatgagtggaggacagttaaagccacaggttttcatatgtggagaggctgctccttaatgtctttgctggtctcttgccgttctctcctgctgctaacattaattactttgctgatggctctaattgacccagtaaaagaatcttatctgtgttcagcccttcccaggtcctgaagtctttgcagcttctgcttgctttcagcctttataaatagccttccaagttctgagttctggttctagagttccctttcctttgaaagtcctaccccttgcttaagcctgtggatcactgtttctaaacccaccttttcaacactattgccccatatcactgatgccccagctcaactggacttttagcttttccctgaataggcctctttgccttttcctgtttcatggatttgtacacagtggtccctgtctataggatcttctctttcctgcccatatttccctgtccaaattgtatcgtagagactgcctaagccctgcttcttcactaaagggttccctgatcatattaattgaaattaattttctccttgagggctgcttgatgctttgtttgttatttatggtagtaggctaactgctgccttggcttattttagcaatgagattataatcaccttgacggtgagaggcattttgtttctctttttgtctttacctactcccaccagctgatattcagggaacatctgtctcattgagtttaggggatgtagggaaagcctggtcagctgctgctccctgcatggtaggtggtggtattgtgaatgtctgtggttcctggtgtttcctggactcgaaattagtccttaattaaataattcctttattaaaggaactatgcttcttttcctttaaaaatatagcttgtattgtggtttcgtcttaaaatggcagtatacattcattgtaaaaattttgggtaatacagttaagcaaaagaaagaaaataaaaactcttgaaagttctgcaggaaacagtagctcactgctacatttggtatacaccttttcagacatttttctatatgtgaatgtatgtatataaacatacttctaaaaagttgccaagcatagtattcttttatttttcttttcactgaatgatgttgtgaacatctttctaagtgtgaaagccttgaaagctgctctcacctacatcatgcatgtattgttttttgtctagtcatttcctcaggaaacccttatgagtggaacttgtggattatagggtgaacatgctttcagggcttttgatacctattgccaaattgccctctgcatgccagttttcctacatccttgccagcagtggctactgtcattcatttttattttctaaagtgatgggggaaaacgatctctttcattattttaattcacaggtattttattgctagtgcagctgtaggttggtgtatgattgatcaccatgaatatttcttgttttctttttttcatgagttgcatgttgtatacataattcttcatgtttatttaaatccaagtttattcataggttatatatatgtatgtaaatatatatgtatgtatattcatatatatatatctctgtgtacattatacatatataaataaattcaactatatttgtacacatataaaatttgttgttgttagtagaaacttttccccctagattatttttagatgttttttgttggttgtacatctagaaatgtgttttgtttttgcatatttatcttgtaaccagtcaccttacttaactgttattatttctgatagtttttctgttggtttcttttttattcttttggctattttatatatacctaggaagaatagaacaccatataaacagatgtgcagtttttctgtatagaatgaaaaatgaaaaaagtaaagaaaaaagtaaaaaaatgaaaagagttcttttcctagaatgtggcaaaaactggacttggaagagagtagtttcttctgtacaaggttaccagaaggcaaagctgatcatggatcctcttctgttctctgcaatttctctatgtgtgatgcttgctttatagttatgttaataaatattggatgtatcagaaaagaagctggattagcaatagtcaccaactacattcattattagctttgaaatttgttcatcatagcatttcagtgatgtgtaactatgtgcagaagataggccttttttatttggatccagttttccttgtgtttaatttttttttttttggttttatgacatacgggggtaaaactagattgtgaaagtaaccatgattctgtcataaaggaatctcaaaattactggaaacttggagagacactggtagccacaactagaaatgtgttatccacttcatatggtcgagctttaagttaaggggaagaaacgaaacatctttcatcttttatttaaagatttttcttctgataccaccctcctcagaagggaactctcactggcttttaggctgatcaagccagctgagtgagggttctcagcttttatatcacctcaagtctcctaactctttgtttctccactctacaattagcttgcaggcctgcctatgtttcctgtcctcattatactagggttttctaaactttattatggctaatgggaccattacctgagatgcaggagtacctacacatttacatttccactgcaatctctcatatggtttaggagatcattaaatttctcttgttacccccaaagaaaaacctctataacctattcatgctaggaacattctctgcctgcagttctgttcctatgaaatgtgcccacacttaccagcccttgccgggcatgccatctttgtctgacttaacgcaaagcctctatgcaacctataattattttcacccacttaatatatcattgctacatgcttaaatcccagcctctccatgtcctcgatcttttaacgtagcttaaaattcttactgtattgtttacactcaaaggagtgtatattttttagctgaaacaacttttggtatgaaaactattttaggtggtatgagtctattttttttttaaaactttagaaaagtaatggttgaaaaattgttatacttttaaagtcttctgttacaaaaagaaaagaaatataagagcaagcataattgtaggatacaagcttatgtttatatgaatgtattgagtttaaattttgtgtctgcattaccacttacagtaattatctagtgaatttaaaatatcttatgtgtataaaaggacaaaacagagaagcttctaatggaaagagggagcgggcacgatgcttcactgtggcttcatggagccttgggcataacaatgtcactacgctcgaggctccatgaagttgagagtctccgcagtgacagcattggttgtcattaaatgaatgaaatgtgtacctggaaggaaggggtggtaggagacttcttggatgaatgtcagcgctcatttaggtgtgattagggctcccagtactgagaacttaagtactttcaagcagcagataatcagatgactgactttgcatgagaaatatgggcatttgtggtactccttttctagatatcatttaatttttctactgtttgtttaacttctgttccagtcccaatttgaacacatatggaagtaacttacatgttttactactgagaattgaattagggtatttgtgctactgtttacttaggaacaaagatgtatggcaaggtgcatggctagtcaccacctgacaagttcagtgtcttgcagtgaatgtgatctcatagcttcctgacttccacaacttacactgctgactcctcttgcccagatccacctactgatgttatgcactgagagagcctaaggcacctactcaaggctttcctaaaacagtggctgtattagtccattttcactctgctaataaagacattcccaagactgggtaatttataaagaaaaagaggtttaatggactcacagttccacctggctagggaggccccacaatcatggtggaaggtgaagggtatgtcttacatggtggcagacaagagagaatgcgagtcaagtgaaaggggtttccccttataaaacatcagatctcgtgagacttactcactaccatgagaacagtatcagggaaactgcctcccatgaatcagtgatctcccactgggtccctcccacaacacgtgggaattatgggagctacaattcaagatgagatttgggtgaggacacagccaaactgtatcagtggccatgtgaagtatgatgacagaacccaaaagcaactggaggagaggacatactcacagactgtttgcttactagaatctcagcttttgagtattttccaccttgtagaccaacctgaccttccatgtagaactcgatgtgtataccttaaatttggcctttaggtagggtgaccatatgccccagttttcccaggatagcccttcctggtttatgtatgtctgttgtcctggcacaattattaatatgcctcttttcatttccacaaatgccctagtttggatgataaattatatggccatccagttgttaggccttggtgcttgctactattcatctagacttttttttacctagttctgctggtgaagaaatgctgtgtgggcctctaggttccttcagacaagcttgttctcagcaactcactcaatttcctagttagaaataaactgagtgcttaatacaaaatttcagagaatacagattttaaaactagaaaggacttccagagactggtagttcaaccactttttacaatgaagtaaatgattttaagtcatgtagaaaaaatgatttcctttgtggtccaatgtatatcttttctagtagccttcctcatagcccaaggcccagttagccacgtcgtcttgttctgaacaattgttttctttgatcagcctgcccttaaacttttctgaccagaattactccaaagagaagcatatttttgtttgtttgtttgtttgttttgttttattctgagacagagtcttgctctgtcgctcaggctggaatgcagtggtgtgatctcggctcactgcaacctctgcctcacaggttcaagcaattctcctgcctcagcctcctgagtagctgggattacagacgctcaccaccacacctggctaatttttgtatttttagtacagatggggtttcagcatgttggccaggctggtctcaaactcctgaccctgtgatccgcctgcctcagtctcccaaaatgctgagattataggcatgagccaccgcgtctggctggttctttgtttaaagtaaggggttcaagttattttccaaaaaaactggatctactcttcttggttaatagctttcctagatactagggaatcttggtacctaacttttccaattattagaatccttggcttctccatatggaacttccttgtaatggaagatataaacttttgggagttttgaccacatggctgtttatgtgtctacttacattagaaacatgaatctcatattcaaggattccaacaaatacacacacacacacacacacacacacacacacacacacagacacacacagacacacgtctatacacatacatataaaactttcctgaggtaaatctctttttgtgaatttccaattcctaaatataatagcagctctgcttgtatagttgctgatgattgtgaaattctttgaacatagatttctaaaagatatttgtgataaatcctgaaattaggacagtttagacaatgtttcagtgacaaacatgaaatctgagacttcagcactgtaaaatgttatctcttccccacactgcgatatagtgcaagttgagtagctcttttagacagttcttctccaaatcatgatgaaagggtctaggctgcattcatatttctgttatgccatctggagcatgtggcttccagggttgccatggaagagagggcttagataatcctgcagggattttagtggtcacactagaggggcagacatcacttccttcatgtctcattagccatgatccattgtcttggccctaacctaactgcagcagaacctgcaaaatgtggtcttatcaggatgccaggaaggggaaaatgaaatagcatttggtggacacacagcattatttctgccacagttcccttcattgacctgattcttggctcatttgtcatgtttcaatagttttatattctcctgctcttacatgttcttcatattttgagtaaaatcatatttagtctcattctagagttcctagagttttcaccactttagtggtgcagattcaccatgaagggcagagtgagtgggttcaagagtttccttgttctagttcttccactttctttcactggcttgaacttccatcctacgtttattcatttacttataaaggtcactcctctttcaacagataacctgcatgagaagcatgggagtagccagagaatacagcttttctgtagcttcagtgattgaaaaaagatgtttattttagaatttaggatgttcagagtttgcccacaagttgttagcatcttcagaaccaaacatccaattggctgatcaacaaagtaaaatgccagtttatatttgggtccgcaattgctaaatagatgagtattagcatttcagaacattctgtttccaacaggaaattgtattaggactacagaaagcagaggtggaggaaaggacaactcatcttcaggcatgtggagacatagattaccggttccttcctggctgggtggggctggagacaccactgcacaatcaactattcccttctccctttttagtgtttcttgtccatcatcaaaaattacatttcactattatttcaagacttttataattaattaggttacatttcagttgatgtaattcactctcaaggagattacaaaataatatttttgagtgaggtgatcaatcttgcacatttgtgctgattttgcttagtttcaatttgaaagttgcatttttcaccctgtttccaagcccctatagcaggtgttggtagatgtttgctcactcagcagatattgattaagggcctactatgcattaggcattatgccaggtgctagggatactgtgatgagtggaataattagtttcaagggaggctggctgtggtcagacagaaggaaagaatggagtaaatggggatgtgtgctatttacaggaagtagaagagtggactggcatggtgaggaggggcatatggtggtgtatttctctcagtatttgccatagacctcctgaaaagtagctgtttttcttctttaagattctaaaatgccagagatactagaaacaggtatgttcatgagaagaagagacccttaaaaagagggaaataggataattaaagtgacctttatgagatttgggaattcatggttagaatgcccttgtaattacaggcaaaattaagataacgttgtttccaactcttagatgtgctccaatgattgtgtggttgaaaatgttgaaaatagtaaattacctgtagagagacacagttggaatgtagttagggagacctctctgcctcctggtgttgcagaagctttctgcagaagaatgataccatcaccagcttcatctatgtatatcatagtgctggtagccaacttaattaactagcagtgaaataagtttctgcaccctgtgagatattccccatgtatacagagttcagtaattgtcattacttttactatctgagatttttaaaaaggaatgagtagacataccacaatttagtttcaagtgtagaattatccttcagtacacatttggtttgtgattttaatgggaaacatgtctaaagtttaagcattggcttcctttctgtgttggaaaggttgtccttcatcacacacaggacatacgcaggacatacccaggaggcccccagttactctgttgactggtgctcaacacccctttccagccctcttcactggattatttttagaatgcatcagatgcagctctcaaaatgatgcaaaatcattgagtcctcccatttttcagctaaagaagtagtgtcacggtttcctaacaagaaaacctactatgaggcaaaattatagaaaatcagaatagcagaatagggcatgagctgaggaatcttctgctttagcccttcatttttgcataagaagaaataaagacccaagtttagagcatacagctggcttagagtgggacctactcttgtccttcagttcccattaggattaaatgagttaataccattatagtccttataacagtacctgtgccatagtaagtggtcagcaaatgcgagttatcacttgtcattattcctagtgatagagcccaaacaggaacctagatgccctaataatccagtgctcttcaggaggcacatattttgtatttccacattgtatagggagaaatatgttttaagaagttgagttaaaataaaaatagtgactgccacaatgccaattaatgtgtacctaatcagcatactcagtactctgtactgaataagtactaggctaagaaatgcagtacttagcctagtactgcatagtctgagttaaatactgcatattcatggtttcctttaatcctcacaatgttctatgagattcacatccttgaccatctccatttgacatacaagttggggaacttgcctatttaaaaaataggttttaaacactatttgacttcaatgactttcttaacctttgttatttatttatttattttaaatttctttttctttcttttgagacagggtctcactctgtcacccaggctagagtgcagtggtgcaatcgtagctcactgcagcctcgatcttctgggctcaagcaatccttccacctcaggctccctagtagttgggaccacaggtgcatgccaccacacctggctaatgttttaaatattttggaaatgggggtcttgctatgttgccaggctggttctcaaactcctggcctcaaacaattctttgccttggccttccaaagctgagattacaagtgtgagccactgtgcctgaccccttacccttccttttatcccaggaattggcaaactattgcacacaagcaatctctggccattcttaacttgtacagtctgcaagttaagaatgtttatatgtgtgtgtgtgtgtatatatacattttttttttgagatggagtctcactctgtctctcaggatggagtgcagtggcatgatctcggctcactgcaacctccgcctcctgagttcaagcgattcttctgcctcagcctcctgtgtagctgcgattacaggtgcgtgccaccacgcgcggctaatttttgtatttttgtagagatggggtttcaccatattagccaggatggtcttgatctcttgacctcgtgatccacccgcctcagcctcccagagtgctgggattacaggcatgagtcaccatgcccggctttgttttatgtattttttaatggttgaaaaaaatcaaaagaaggataatattccataacacataaaaattatgtgaaattccaatttcagtgtccatacagttttattggaatacagccatgctcatttgtttacatactgcccgtggctgcttttgcaatataatggctgagctgagtagttgtagtggagcccgcatggcccacaaaacctaaaatatctactccctggcctttatagaaaacccttgctgacctttgctttatactcttccttggtgattacattttatgacattccaactgtttagggcataattgtggaatttttataggatctgtctcctcaagttacttgccttttggtttgttctgtattaattaacatatcaatcagatcctgaataatgtgaataaaaagagttcaccgtccgggaggcggagcttgcagtgagccgagatcgcactactgcactccagcctgggcgacagggcgagactcagtctcaaaaagaaaaaaaaaaaaaaaaagagttcaccgttggattgtctgtgtcttgtcttttttttttttttttttttttctgcagattggggagtaatttattcctggatactgtgtgaaactcgatgataacctgtttttgtttctgtactaaccatggactgcagctatttctggtttgcatgcccctcacgttcatttattgagccgattgtttttaaacctccaagtgtcttagatgcagaaatcactctattttctttcctttgtagtggtttgttgtcttctgattatgtggagattcactacgaaaatgggaaaccacagtactctaaggtacggttaccggcgtcggcaagtactctagtataagtgtgcttatcatagagttgatcagtgcacactgcgttgttttgacgtctgtctcagtaaaatcacctgtgctcttttacaatgatactatttttagtgaggagaaatttattaaaatatacaaatgtttgaggtaacgttaggtattcaggacaaaaaatgtttattgttttgattatacatgcagtaccttttgtgatagtataaagagctatacagttccatatcagcacctgaaagtagttagtaaagaaggatgaggctcatggccatcgaatctggattagaagactggatgggctgttagaacggttctttagtgcaaatgattttgctgcccaagaagggcagaggacaggtgggggaagtgagatttaggtagtactttttctctaaccttcataacaattctatgaggtggatgttattattcctgctgtactatggaagaaattaaggcagagagagggcaaataagcctgcttaaggccacgggacattgaatatgagggtacttgggtatctgattccttcatttggagatgaactttcttgtcttcagggaggattaataaagagcaagtggatttggattaaagcaagagagagagagagatgatttgtatgtaagaaacagtgacctccgtcagtcagggtgaagatccccagaatggctacagaaagaaactctgacttctagggaatcaacaagtgccactgaacctgagcagtgtcccagttactggggacaccagaaaggaaacaaagtggggaaacctcactggatttttgtttgtctttttcctagattgctaacacatgtcagcataaaagtagcacctttcccgtatgtggacttgtgccatataggtaactgggattttcaatctgatggcttctcagcaaatgtttataggtgtccttcattataaatactgctcaggaggccctggcatgtctcaggatttataacatttcaatttgtaattggacgtgttttccagcctttgagttttgtgccacagattaagaactttcatgtatcattcttattagttgtcagttcttgccttaggttgcatttgggggttgttgagtctccctaaaagttagtgctgtggaaagtgagcagaaaagctaaatcaagcgcgggaacaagcttcctggcatttgtacaaactgaagcttctgtcagctgtgccagggccctgagcactgcagatgctgaatcatgagcctggagtagacaagattgcagggaactttatagactcagcaaacgagccacatttgcaggacacagaaacctgatccagacttctcactaaggcacttagttactttttttttttttttaaagaaacagaatagctaattggcctccagaggtcatttgaggtcccaaaaggagaccttatcattaataagacactccaaatctgatatcagttgtaactaaaacttaaaaggtatttcaactctagcaaaagaaattgtgttcactgcagtttgtttttgtgttcactgcttttctctctttcatgacccattttcttcaaacagctcatatacccaaacttacgtgcttcatagataatgaactaacagtctgttttttatgtgtctgtatttatgtacatcagaaaaacccaagatgatatggtgcacactattttatatcaagattttttaaatgtagcaaaattttaaatattttagcatatattaagtaatcttctaaacctttaatttttaaaaatttcataatattatttctaattcatttgttataatatgtttaaaaatgccatggtgatagacattttgactctttccaatctttcactatccgaataacttcaagggaaggccttccagatacgttttgaatacatcccttataattgcttcagaattaattctgagaaaggaattttctgggtcaaagagttggtacaattttttaacactcttcatatatattaacaatttttatttctgaaagtttgtataaattcatattcccaccaccattacatatatatatatatttttaaagcatttgtaaataaacttcatgaagattgtcttttatgctgcttcagaaaatctttgtacagagtaccagaaaaggaaattaatatgtaagaatggctaggttaaacttattttcacataatgcagccttttttcccctaaagatctcaaattgttttttttatttttatttttttgagatggagttttgcttttactgcccaggctagagtgcagtggtgcaatctcggctcactgcaacctccaccttctggtttcaagcgattctcctgcctcagtctcccaagtcgctgggattacaggcacctgccaccatgcccaaataattttttttgtatttttagtagagacggggtttcaccatgttggtcaggctggtctcgaactgctgacctcgtgatccacccgcctcagcctcccaaagtgctgggattataggcgtgagccaccgtgcccggctcaaagatctcaaattgtttagagaaaagtacatgcacacattgtacacacacatgtagacacacaatattttccacgtaactaaagaacagtctatttggctatgaagttaaatgtgaatgtggatattgacagcatcccaggaattagttgcaaccatactttgcaaagagggttgtctaggttttcccatttcaccactaacaagcccctctctcattcttacttctcactaagaaaagattaatgtcttggcttttacttttattgcatggacatgggttaaaagtgcttctttccatgtgaagcaaatataggagctcgagaggtccaaaagaagcgtgtaatatgaatgctaggtatcagtccaagaataaggaagaacttttgttctgcacttgatggagcaatagcttttgtttaagttcctaccagtgctttgcacataatatataataaaactattttgttgatttttttacaactttaaaaagtaatttatttacttttcttatttaaacaaatttattgggatataacttatgtatcataaagcatataattgtttttagtatatctacagaattgtgcatccatcaacataatctaattttagaatattttcatcactgcataaagaaaccacaccacctgttaacagttgctccccagtctctcttttaccaaccataggtaaccactaatctattaatactttctatctcaatagatttgcctattctggacataaatgaaataatataataggtgggcctttgtgactagtttcctttttcgtccctagttttaatgagatataattgaaaaatagaaattacatatatttaaggtatgtaacttaaattgtatatataggaattgtatgtattattcaaaacatcaggttgatatgttggtacattgtgaaatggtcaccacactcaagctaatgaacacacccatcacctcacatagttatcttttttttttttgtagtgagaacatttaagatccaccctcttagcatgtttcaagtactatatatttgttgaccaactttgctgatgagcctatttaaataagttaatttttagcatttcagttcttataaaataataagcatcaacaaaacactatgaaagtacttttcaaaattaacatatttctattaagtcttttttggtgagctgctaatacatatttgtaagtgcttactaatactttgatttctcttctgcttacgtcagcagtcatgatgaataaatagatgaagtgcctccatcccaacttccctctaccttattactatcattattaggtggggaaggcttcttttcctaggtctatttcctcaccctggcttcttcctattccgttgctcattcttgctcagggaaggaagagcggcttgactgctgggaaagtatgtctgtgcagccagttcctccctccctttttttttcttttttttttgtaggatctaccttcctacaagaagagtacattctctccacctttctcttctctgaattgtactgtggccacccacatgtgtgtatgtggctggggttaggttgtcccacattgtctctgcctgggtgggtaaggctagctactcctgggtgcagcattagcaggcctattagattctcaactaatcctctcctccagtatagctctataataaatgaaggtgacattttgatgtttcaattctatgtcactctctcatttagttttaaacttgggtgggcaccaattcatacctatgaggatggctataatgaaaatgatggacaataacaagtgctgtcgagattgtggagagattggaaccctcatacacagcttgtgggaatgtaaaatgttgtgtggctgcttggcagaacagtttggcagttcctcaaaaagttcaacaaagagttaccatatcacccagcagttctactcctaggcatatactcaagtgaattaaatacatatgtccacaaagaaacttgtacataaatgttcataacattattcatagtagccaaaaggtggaaacaccctaaatgtccttcaattgttgaaggaataagggaaatatggcatatccacatagtggaattactattcagtcataaaagaaatgaagcactgatacatactacaccaaaagataaatcttgtaaacattatgctaagtaaaataagccatacacgaaggggcacatatgatacgattctgtttatttgacatgtccagaataggcaaattcataggaactgaaagtaggttcatgattgccagggcctggtggagtggaggggaggagaaatggaaactgattgctaatggttacaggacttttttctgaggtgatgagactattctggaactacatagtggggatagttatacaactctgtgaatatgcgaagaaaaacactgaattttatacttaaaaaggtaaactttatgatttctgaattatatctaaataacaacaacaataaaaaacccaggtggggaataagagtttatttacccaccctcttcatcaaacaagaatcctttaggattggtcttgtcacatatgctcatgaataagccattcctgttcattcattaaacaaatatggttttactgtatagcataatgtcctttaggtctacccatatttggcaaatgccaggatctccttctttaaggccgaatgctattccattgcgtgtgtgtttgtgtgtgtgtgtgtgttgaaataagccagacacagaaagaaaaatattctgtgacctcacttatgtgtagaatctaaaaaagtcgaatatgtatttatgttggtgcaaaagcaattgcggtgttcgccattgaaagtaatgtcaaaaaccacaaatacttttgcaccaaccttatagaacagtggttaccaggggcaggaggtggaggggtgggagtggggtggtgggttggagagatgtaggtcagatggtacaaagttgcagttatataggctctaagtctaaagatggaatggatagcataagggctatggtcagtcatattgtatgatgggaatttgctaagagagtagattttaggtggtcacgccacacgcttaaaacgtaactgtgaggtagaaataagacatgttaatttgattgactatagtaataatttcactatgtatatcaaaatatcatgttgtatattttagatatacacaacttttttttttgagacagtgtctcactctgttgttcaggctggagtgcagtggtgcaatcttagctcactgcaacctctatttcctgggttcaagagattctcctgtctcagcctcccgagtagctgggattacaggcacgtgccaccacgcttggctaattttcgtatttttagtagagacggggtgtcaccgtgttggccaggctggtctcgaactcctgacctcaagtgatccacccacctcagcctcccaaagtgctgggattacaggcatgagccactgtgcctggcctgatatatacaacttttagaaaacaaaaaagcagaaaaaatattgatttaccttgtactgtgacctttttgaggtcatagttcctgttctaggtactagatatgtatcagtgaaccaaacagataaagatccctgcccttatgggtcctgtgttctcttctcacctttattcttttctttatcagtataaccacatcacccttttagaatgttctttgtgctttccttatcaaatcatcatcacagctcagttcaagctcgcttctaagagtgaagggtttttggcagcaggagagcatggattgtgatcaggtggagtaggtctctgtgcgcgtggctcctggctgggaggtagggttgatgcagagtggaagagattggaggagtgcgtgttctgaagaccctgtccagtgtatgagtaagggagggtgggccctgcagaagtcagtcagagtctggccgaggtgctgtattggagtcagggtattttcagacacacgggtctgcctgtcttcccttttctgagtgtttccccacctctttctgcttcctttcctttatttttctcattccctcttcttttagtaatattttaatgaagttttcagactattttttaaatctattttcccttcttttttactgcctctcagcttgccataattgggtttaaaaattcgtgtttgtattgtttctaaccagagataacttaaagtttgtatttccactcctatactaaaaatgactcttttacttgcgtgtacactagaattttttccctagtctttgaattaatagccagttttttaaaaagtttcttaccactgcataaataataatttaagcaataacaaggaaaacagaactatccacactaaatcacttaaattagatccaggattatcagttatttgaattttgagtataaagttgaaattattattaatcattcaaaatattgaccttcctggcaacattcggagtacattatagaatatgaaaggagcacggggttaaaaaatgccccaagaaatcaagatagcagatgacactagtcctcacaaagctattttaagtttgaatagtataatttatgtgaactattaaaaatttacatagcattggtacagccaaactgttctaatactttattaaactactgcaagaacattttccccattaaatttaatgaaggtaaataattaaattatttaataatttgtgtgttgggagtctcaagttccccaagtctccaaaattattgttttttatttccttattctgcagtactcaaaatcaggtatacatgtcccattatagatatctttttctatttctcatttgttatcagctcactgatttttaaaatagtttagcatatcctagtagttgataagcttgaagaatttaaagatatgtatatagaataatcatttgagtatagtgtcagtagtttttattattgtattcagaacctagatatcataatatacacattttctagttaaggactgtgtagtttcttttcaaatgtttatccagacctgcaggaatagattgaaaatatcagtgtatggtcactatcaatgtccaggtttttgggagtttcataagcagtaaagaactggctgatggaactttaccatgcagatggaataattagacacaaagttggggtgcttttaaaaaccaaattaaaactattggttctatttccactaaaatgagtagaatcaaacagttcctgttgttattactattattattattatcattattattttttatagaggcagggtctttctacattgcccaggctggtctcaaactcctcctgggcttaagcaatcctccctccttggcctcccaaagtgctaggattacaggcatgagccatgatgcctgtccagttcctgttattagattagtaataccagagaactggatctttttttccctacaagttgtaatcactagactcacaaagttattatccccagccatttctggttaggaagtattttaaaagatggacatggcttcaatgtgtcagtatatgaagaggaagcctggtaggttccaatgggattctgagcttggaaaccttgtggagcagagttattatttgagcatgatatggcttgtggagtgttcagctatgtgcaagtagcaggctgagaaaggtagggagcatactaggatttttaatttcctgtgactagccaataacttccacttatcagatgctccatttctgttgaatttaattaactgacagttttggatccgaaaatgctgatgtctgtatgggtgcacagagacttgtgtcatgggctgaatcgagccctttttggttgtccctgctgccatttgccacgtcacaggtctgtgacccactcctaggtggtcagggccagccctctttaattgtctgaggtcttcctaactggagaaagaaacatggacttgagaacctgaagatgtgggaatcagtttgtctttttgttatttttagaagagccttttgcactttgtttctgtccccatatgggtacatggagacagcagtcactgtgaggtaatggttgttgaagatggccagatccctgggtggaaggcacccctggagctgactgtccaaagtcatgattgccagtgcccttaagaagtgggctccctgtactggcccacttctgttatgcttggcacccaagatggattgctctttctctctcaggatttattttatatgagataactcaagatcttactttgcagtggtctgaagtgttaccaaataatatttttccatagtactctttaaaaacttggtattaatttagtaataaaaaaatcagaaaatcctctaatactgctagtactaatattaaattggaagctaccaaattgtttataatgtttaatataactacacaatttagctattaaaactttcttatgatgataaacatcagagattggatgttgcctgaagtctcatttaagtttaaaaaaatacagtgattcaaggccaggcacgatggtgcatgcctgtaatcccagctactcaggaggctgaagcacaagaattgcttgaacctgggaggtagaggttgcagtgagctgagatcatgccactgcactccagcctgggcgacagagtgagactgtctttaaaaaagaaaagaaaagaaaagcagcccttcactgtacacacacacacacacacacacacacacacacacacacacacacacacacacagttgtccttgaactgcacgggtccacttatatgtagacttttttcaaccaaacacagtatttgtgggatgcaaaacctgtgcatatagagggctgactttccatatatgtggtttccacagggccgactgtgagacttgagtatgtgcagatttgggaaatatgtaggagttctagaaccaatccctgactttataaatatatatttatctctgttttctcccgataacccacctaaataacagttaggggataaaaaaggatatgaacccaccaatacaaagacaggagaagagaaaacaagcaggtgagatgtagccataaaatttcaggagatggaaagtggatgaggagtgactcttagctttgagcttttcatgctctgctaagttcgtatggggggaaaccaagaagaaacaagtcaacttatgtcacttatcccagaaaggcagaaataaaagcatctgaaaaaagaaaaattggttgaaagtagatgtagagcggttaagtccccaattcactgcctgccctgtggagccagataagcagataggaagtcggggacttccctagtctggtaggagctcatgtatggaaaaaaatggataggagagaattctcagctatattttataaataataaaaattattatttttattattataaaattcttttataaatattatttataaatattatttttataataataaaaatttattattatttattttaaaaagctgcccagaactgaagtgcatagttttcttgattaaaaggtgtcacagcaggaggctgaggcaggagaatctcttgaacccaggaggcggaggttgtagtgagctgagatcacgccattgcactccagcctgggcagcagggtaagaccccgtctccaagaaaaaaataaaaataaaagtgtcacagagtacccagtacaacaaaggagcaaaaattctaaaaataaataaataaataaaaatggagcaagaatgaaaatacaataattatagtggcagagctgtgaacaatatttgtgtacacataaacaatgaatatagatttaactaaaactggtgatatgaattagaatgtactgggggtgagagaggttttcgagatcctatattaggtagataatttctaaaatggaattagtcagaacataaaaagtataaacattcaaaaatatatagccaaacaccagaagaaacagcttaaaacattaaaaatggttgccttggaggtggaggggaaagagggacaaaggaaactgctgtgtttttttaaaaataaaacttgtagttattatttgactttgaaaactacattcatatattgcttctaaaatgtttttaaagttaatttttaaaggtaagaaaacaaataagatattgtataattttccattaaaaatgattataaacaaacttttggagtctctcttcagtcaagtggaagtccttattctataacaacatctgaaaagtacctgtactcctacaatacatacttaagaaatgtatgttttattaattaccttggtgtcattgttttttaaagccttttctccttcattcaatttaacacacacatgcttgttataaaaaagttgaaaaattgcctagtcttatttgcaactttatataggaggagtttctagggttattaatacagtgcacatatatgcccatccttgcatttctttttgctttatggaagcacccaaagaattaatcataatgcataaaatacaaccaatcaatgaaacctgctttccagggtggagagcactgttactaccatggaagcatcagaggcgtcaaagactccaaggtggctctgtcaacctgcaatggacttcagtaagtgggaatctcattggcattttattcattgaccctttccagtttcccttttatggatatatatattttagtgactcttccgtgccagtgctgtgttagggactgcatgtggagtggtgcacaaggagggcaatgtccctgtcctcttgaacacttagtgtttgcaggagattcagagattaaccaaatgattacatagatgaatgtttaatcaccattgtgttaagagctgtaaaggggaaggacagatgcttgtggagtggcaaaacctagtccaggaaggtttcccagcggcatattccagaggacatatcagttagacctacagctagacttgagagtcagtaggccttagatctaagaaacttagacctaacagtaagttggagttagccaggcaagggtggggtgacaaagagaggggttcgcacattgacctaggggtgggctctaacaaaaccatgtgttggcaccttttagacctggacacagtagcacctcatataaagacttagtttcggccatgtgacgacaaagaatcttgaaacttttcgcccttttataaaaaaccttatgtccctgaaaattaaatgtaatttgtatgacatagagtcatactgcttgatggcagttcagaatttataagcgtaaagataccactgtttgcttcttcagaaccagatggttttagattattctcatatataaagaatctgttttcttacagatgatattgaatttgcataattagaaatttgtatagttgtacatggttctggaataattactttagagactgccactgagtgaatagtcctatctcagagtaattttctaatctgtctgttgaatttcaaacatcagttatatcaggtataatttgcatgcatttgatgtatacttttataatttttatagcctccatgctgcctaatagagtgctggggccacactgggactccatgcagatatgtgaattaaacttgtgacagtgtaaagggatttgttcagttatactctttattttgaagacacaataatgaagctcacttgctatttcttgccatttcctgtgtttgtttattccctcctttgtgtggtttcttttgtgctagtggcatgtttgaagatgataccttcgtgtatatgatagagccactagagctggttcatgatgaggtgagtctatgccatcagttgcctgatggcgttctactcctccagcaactttgtctttgagaagaaaagagaaaagagtgtagatttcaaagtgcctttgtacatgttaacttatttcaaacttagagtagtaccctgagttttgaagttttaagttgcacatgccaggcccatgtacccgtaaaggatagtaaaagacatcaaacataggttttctgaagcaaatcctagtccttcccagtctatgaaaagagcagagaggatattttgttttgtattagccagcctccttactttaaactagctttcatagaagtcattatatgaaaaagatacttgcacacacacatttatagcagcacaatttgcaattgcagaaatatggaaccagcctaaatgtccatcaatcagcaagtagataagtaaaatgtgatacacacacacacacacacacgcacacgcaccatggaatactactcagccataaaaaggaatgaaataatggcattcacagcaacctggatggaattggagactattactataagtgaagtaactcaggagtggaaaaccaaacattgtgtgttctcattcatatgtggaagctaagccatgaggacacaaaggcataagaatgatacattggactttggaggctcgggaaagtggaaggtggtgagtgataaaacacattgggtacagtgtacactacttgggtgatgggtgcacctaaatctcagaaatcaccactaaagaacttattcatgtaacccaacaccacctgttccccaaaaacctattgaaattagaaaaaaaaacagctttcattcttactgtcatctttagacaattgtgtgactataagaatgtacttaacttttatgaacctgaaaatctttagtggggaaatctgtgggctgaactatgattatattataaaatacttagttttctttacagatagggaagaaaataatgtttagagtcatgcacaaaccagtgatttagacaagaaatcacatgctctaatagtgttgcttgctaatagaatgcaatcaaatttaaaatttgacatatattcagtaaatattgtattgagggcttactacaagctgggtattattttaggttctggggatactttggtgacaaaatagacagagattgagccaaatggggcttacagtctacagaggcagatagagatacacagaatgaataagtaattacatgtggtatgttagatagtgatacatggtaaggagaaaaagtgaagccaggagagtggagagttaaatttttttttttttttttttgagatagtctcgctctttcgcctaggctggagtgcagtggcactatcttggctcactgcaagctccgcctgctgggttcacgccattctcctgcctcagcctcccaagtagctgggactacaggtgcccgccaccgcacccagctaattttttgtatttttagtagagacgggatttcaccgtgttagccaggatggagttaaattttttatacatacacagttccgggaagtccaccaagagaagacaagtggtgaatgaagcacttaaggaaattagagagctggaagaacattctagaagatgagcaaatacaaaggccttgaggcaggagtgtgcctagggtgttcgaggagctttgaggaacctgacagggttggagaggagtgaacaaggggaagaatgggaggagattaaggcactgagaggtaacagtacagaagtcagatcagtgaaaagaactgtagcgggaaaataatattttgtgagtgatagagttagattattgcagttatttgatggggaacagaaaacattttttatctttagggatttcaaatttagataaaattgggctgggcgtggtagctcacgcctataatcctagcactttgggaggctgaggtgcgcagatcacgaggtcaggagtttgagaccagcccagccaatatggtgaaaccctgtctccactaaaaatacaaaaattagctgggcgtggtgacgggagcctgtaatcccagctagtggggaggctgaggcagaagaatcgcttgaacctgggaggcagaggttacagcgagccaagattgcacctttgcactccagcctgggcgacagagcgagactccatctcaataaataaattaattaattaattaattttgaaacagctaacagttagataggctactgataataaaagctgaacagacaaacttttattgtcttggttatggcgatgtatgtatgaatatggggtaaatttcaaagttgatgcagaaaagttttaaagggttggtgtttgaataaacctctgtcattttcaactagtaactataaaaattatcaggtaatgaagacagcccacttagataaagacattttgattaagtaaaatgttatttatctcactccagtaaggaaagataatctgtgtacagcaaaattattcgactcattcagcaaaaactctgactttgatttctggctttgattaatggccctggtaccctaacaaaatccacaaagaacaaaacacagattcccaaataataactatttaagccttagagttttttaaatgtataaaatgagataatttttaatgcattcatagtagggcaattttgtagatttgatgaattaataaatgtaggtgacaatgtctattaaactgtcataaggatttataaatataaactattgttataatgtttaaagcattggttttgcattgtttacttgtgatcatattattcagggcctgattgttacatgcaaattgccttctctttgccttccttcctgttgcctaccttttggttatgtaatgatttgtcctcatccacactatgggtagaggaaaggaatagtgctttaaactttagtcgattttttaaattgtgttgctgatcccattgttaatttcattactatcttttcaccttttaccagaatttagagcttactgtaattaattttagatattttgatgtttgttgttagatattattgattttagtatgctttgcgataagtcaagtaatacgcatgggatatttctaatgagaattcatgttatctctcaagtaataaatgaatagcaaaactgttataagttttatgtaacctattaagaagtttcttttttataactttttctgattataaaactaatataggaaatttggaaaagcaaaacaaatacttaaatagtaattttccattatcctgtcccccaaagataacttcttgtcatgtttcagaatatgttcttccagttttcaatgatatagtcccatatatttttaaaaatagattggatcattattttataagataattttaagacaatgatgtatctccctgagcctcaatatctttatttgtaaaatagggataaaccatgcactatatggcgtctttgtcaggactaaattaaataatgtgtacattaacagtacctgatacatactatgcactcagtaatggaagctaataggaataagaataatggtaatagacattcctaaaagcataatttctagggcaaaaaatgtaaatgttttcacgtttgttgatataccttactaaatttctctctcaaactatgctaccaatttcctcttgccagcaaggtgtgagagtgcttttggccttacaatggtaattaactatggatatcgtaatttttaaaacttcatcagttttatggcaaaagttggtgcttcattaaaaaaaatgcatgttgaaggaatatgaaagcattcggcatgtttttacatgtttattgactttttgtgtttcttgtgaatttcccatttatagctttaaagaaagctaagatttaagagtaaccagtaacactatgtttttatctaaactggggcaattagatgatactcttttatttaaaattaagatttcaataagacatacttttcacttttgatagctaaaaaactgacatataaatattcccattttaggaaggacattagagaaagttccaacactgtttcatagaggcttgttcacatcttgctttctaaattgcctacaattgttttgtttcagaaaagcacaggtcgaccacatataatccagaaaaccttggcaggacagtattctaagcaaatgaagaatctcagtaagttttaactaaaaatagcgattatattttatgtagtatgagcttttatctggtggagctcagtagatatgcaggcttgttggaagtggaattggtctgatatcaggggtgaacatcgtggatcagcactggaatgagtggtggctcttgtgtaaagaggcatggagagtcatttccagtgcagactaaaacatgaagactttgagtaaagctgccttgggaaccagaaagtgtggtcaaatttagtacagtgatttacagtgaggttcatcctgaaatcttcctggcagtttgctgctcttgagccagcttggattgcctccctctcatgctctgctccagacacatcttaagtgtgctaatgttggaagaagcttctttttgattgttggggcatgtgattttatttctgtatattactgctaaaagtctttaataatttatgcaaaagctaatgccatacattattttgaatgctaaaatgaattagacatagtagaactctgtcaaattttcagatattgtcaagtggttttatatcaaatatgcatcttctaatgaatcttgaacattatgttttcttgatgtttgggacaaaattacatttgaactatctttgtggtcatgagagtgtgaaatatataatgatcagtgtgctttttttcaccttagtttgacatatattatcagtgccactgtttcttcatgtaatattttaaaacatactcccattgaaataagcataaaattttgatactaatttttcctttctgcagctatggaaagaggtgaccagtggccctttctctctgaattacagtggttgaaaagaaggaagagagcagtgaatgtgagtgtggcattgagccttgggtgggcctattttactcaatgaagtcatgtgcctatcaccccacattatctaagtgtacctaaaacagttcagattttggggactgttgtttaaaaatgaaaacaataaacaaaaaaccctatgatttgagccttaacacactgctttttattgatctctttctgttagtgattcaaactgattacggtagtctctgaaccctgacgtcatctaaagaacgtgttgttttagctctgttttctacgtgttttctgatgataattgcagtgcgttttattttctatttaaagtacagcagacttttctttctatatggcttatatagtgtcatataaaacatttctgttaataaaaaatctagagagaggagttaggttttgaaatgttggctaatcatacatatttatattactttcagattaaaaactctgttacaccaaactttaaagctgtatgtgtttttcagaacacaatgaatttatttgactattagcaatataacagtttctaaataaaaatcatgtaattgtataatcaactactgttatatacttcacatgtattgataaacgtataggggctttgtaattgaaattatgtttctggtcttttcataataggctagaaagctgtaatgatggggactgtttagtaattacatggtgaatgctatgtaactgagaattaattccacagcttatacattacatggtaatttactagataacttaatgagtaactatagtagaaattgcacattttagataatgttttgctgagtgtattttttttgtgaaaaaaatagaccaccagccatcaaaaacttagttccagtttaaattttcctcccttttatgaaactcttatgataattatggatacatttattatatattatataaattattattagatctcttttagctcattcataaagatgtggttggtaataatatgttttacaatggctgctgttctttccctacagtccacctcatcaaatataaagtgatcaatgactatgtacataaagaaaaaagagccactattataattttccaactatgaaaaagaaataaaagtccaaatgaaggctaaaatacttactcttaaagaattatctagttaatttagaagactttagactgtaataattgccaatattttttcctttgagaaattgagcagttaagaattagcatattatttttagaatttcactcgagtgagttaatgtttctatttaactacattgatatctgtatcagatatatctggaagtaattataacttatgctattcttattaaatgagttttacatagattttcattgacgttttaagtaaatatgaatattttatcacattttaatgtgaaattgagatttatttattttaacataattatgctataatttttctctagaatatttttacatataaaaaccatatacaacaacatggactgttttctatgttgataagtaagtaccttaatgataataaaatacagttattttctaaatacttgaatatgtacccatattttatgatcactttttaaaatttgcctgaccaactttcttctaaggtgtttataaagtaggcagcagagagttgttctgaaattcaaagtcttatctacaacttaacagtgagcactagagagattttatgtcaatcactattctgaccatatatttttattttccgtagccatcacgtggtatatttgaagaaatgaaatatttggaacttatgattgttaatgatcacaaaacggtaagaatatagagtcagtgggttttagaacagatagcttacttaagaaagaatacattttactttatagttaatcattattttttacttattaaccccaagatattcagacatattaagtgacttgatttatttgtcggtgtttggagactctgagttttatagaattttcacaactctaaactttccttacatttaataattataattaatagatttagctatctggcatcttttgtcttcatttaaaattcttattctctacttttcttcatctatgtatttggtcactgctttctaattttattccgtgcttttgtcctgctaatatgttattttttcttactagttaattatgcttatggtagatacaattgtaggaggcaaacatataaaataaaggtttatctaaagtgaatatctttgatgacttatcgtcttttttttttttttttttgtgagacggagtctcgctctgtcgcccagcctggagtacagtggcgcgatctcggctcactgcaagctccgcctcccgggttcacgctattctcctgcctcagcctcccgagtagctgggactacaggcgcccgccactacgcccggctaattttttgtatttttagtagagacggggtttcaccgccttagcgaggatggtctcgatctcctgacctcgtgatccgcctgcctcggcctcccaaagtgctgggattacaggcgtgagccaccgcgcccggcgacttatcgtctttaaatattggaaagatgaataatctcgtgttaacttctgtggcagtaaaatgtgattgaatatgtcatttcagtaacacttaaaagatatatgaaaaacattcattgttcctcattttcccctcttgaagatacaatagaaactccgttaactatacttaaccgtttcctttataaaattacttgcctgaagcccagaagagtcttggtcagtaggctatatactagtacacccaatactagtggtgtgctggtaaattttaatacctagctctcttgatttataatgtttgctgatatctgtggtgtaaatattgccaccatagctgatttcaagctatcaaagtgagatcactgatgaggagttaggagaggatgtatctagttggctctcgggatctgatgggagctggctccagcaaccactgccacactccccagactgtttaggccaattgtaatctctgttgtagttatgtgattgaactttaaaagttgtaaactctaaggcaaaaagtacttgttttatcaaaacaaagttgcacttctgaaaagactttatatagatgagaatcttttaaaaaatgcatagaaatcaggtattggtgacaaacttatgaaagattggaacaaaaattgaaattgctttggaattatctttaagtctttgttttactttaaggaaaccaaaattagattagtacatggtatgataaggttgtgcttcatgctaaaatgatgtgaaattctaattagctggccctactcagagaatgccttgaaactagaaatttaaaaaaatagtgacttaatttatatttaaacttttaagtttctactttaatggatgttttccattaactatcagtttaattgtgttgaatatcaatagaatacctcttacttttgtatacacatttattttctgttccagttgcctttaaatatattgcttgagatgttagtaagaagcaaaatttatcagaacacatataatttaagagaggtcctttttggtggaaaggaaagccagatgtgtaggcagtcattttagacagtaaaggctaaaatatgagtttctgaaggactttaatttgcttgaaaccccaagatagtttttttatctgaattatttttgttgattggaacattgagattttttttcccagctgattctcaatcttgagcattgtggcatgttgtgaaattatggcttttgaagcctaagcttttttcaacatccattatataaatacttttagagtagtagaaataataattaagatatattcaatgtctttgaatgcacaaagtgcattctcaaatagctgttaatctatagaatctgttctcaaacctttacttgcaattccaaatctcttgttctaccataatatatcaggaaagtacatgaagctatcaatcaaaagagcaaatctcagtaactgtgcaaaataggaaacagttactactaagtgttaattacaattaaacagttatagttttttggtaattgttaaaacagcatattttttgaatttattttttaacccttctcaatggtaaacatttaaataaccttattcttatgaataataaaatagcatacttcttaaaatattattttatatgtagaaaatttctacacaccatgtcacatgttctgtgatagagttccttatttaggctatcaaatcttttaagggtaaattttaataattcattttattattgttgttagtattattattattattgttattattttgagataggttctcactctgtcacccaggctggagtacagtgatccaatctcatctcggcgcaacctgcgcctccgcagctcaagtgatcctcccatttcagcctcccgagtagctgggactataggtgcatatgaccatgcctggctattttttgtattttttttttttgtagaaactgggtttcgccatattgcctaggctggtgttgagctcctggactcaagtgatctgtctgcttcaacctccgaaagtgctggaattgctggcgtgaaccaccatgcctggcctattattactattattaaaatgggtgagaagtaggtatgatatggtcatcagtttttgaaacaaggaaaaagaattgtaatttgtactgataaatttagagggaatcgatgtttaaaaaggaaaaaaaggccgcgtgtggtggctcacgcctataatcgcagcactttgggagtccaaggcgtgtggatcacttgaggtaaggagttcgagaccagcctggccaacatggtgaaaccccatttctactaaaatataaatatatatatacacacacacacatatacatacacatatacatatacaaaaaaaattaaaaaattagccggaggtggtgacatttacctgtaatctcagctacttgggaggctgagacaggagaattgattgaacccgggaggtggaggttgcactgagccaagattgcaccactgcactccagcctgggcgacagagtgagactccgtctcaaaaaagaggaaagcttttatttttgagtggtaataatgcctaaaatagaaattgcctaagatttctactatttaaagaaatagtacttcttggctaatagaactaaatatattccttttgctttaagacagagttacattctaatccataatagtcccaaatacgtatgacattttataagaattttttttttgagagctgaaaaaaattttttgaggtatgctttctatgagatgaaggttgtttttaaatttgattgccacttcagtagtatatcagaacttactggatcaaagtacttaaattcacatgttgaaagtcaaactgaactagaataattaatacatttatttctgaatatgtggggatttgctgctgggctttaggataatcatctcactgagagtactcatcttacaatctttatactatacgatccagaatagttattttgataattctcaccttcgggttgaaaaaccaaattctaatcttattttttttcaaaagacagttttcttaaggattgcatgtgttcaggaaggaaaagcaaccattttaaataaagattgttttaaactgatcagaaatgtgaaagtaagttttgttataaatggtgattgcatatttttctttatatgcaaaattagttctaattcatgcaggaaatagaaacattctgcctacatttgcattcaagcttatccctttaattcagagtgatttaacgttggctgcctgaaaaaaatgcagatatcttattttcaataggtatcacattatcagtggctttccattagaaaagaaaaatccctcaatttggtaaaaagtatcttagtacctggctggtggaacctcatttgcaagccaattatagccttgataagagtctgcaaacatgtctttgagctgcttaagttaaaaataaatattaaaaatcttattctaatagaaaattggttgagattttttaaagtgcataaagtgcatgaaaagcaaatgttttgcgtacgtgttttgctacatacttaactatgcgtcaataaatgtaaatatgtgaggataatttaaatatttttcaatttaaacctcacttggttttccttacttaaaaaccactacattttatatacacctaacaaattttgagttttcattaataatcatgatttgttaggaatatatataaactatttaataggaattgttaactgaaccagcttacctcctccctcaacctagagactagaaggatttaaattctagctgtgtgatcttgagtaagttatttggggataataaaacccacctcatagagttgtgaggagcaaatatttgttttaggcgaaacacttacagtttctactaaaccctaggtgtccaattaaatggcacttcaagttaacaaatctagtggtcattgttctgtccttgtcttactctctcagcaatattggacacagttgattaccctctttttttgaaaattttatttcatctcttggcttctatgacgtggtagctctctcacctcactggctatttcttcctagtctttaaaatctgacctctggaattatgtgagtgccgcagggcttggttcagggctcttttctctttgtatactctctacctaagtaacaacttgcagcctcaagtctttaagtgggatcatgactttaaactcgttattccctacttttagctctagccccttaagttctgtgctcatatacagaactgcctatttgatatctctattttagtgttgatttgaatagaacttctgaatcagaactcttagttccctagtcctaaacttctcttcttctagtctctcttattattttaagtggcaccacaatcccccatccattcaagttcaaaacctaggagttatcttttaattcttctctttcctcaccttccacatcctatacatcatccagtcgtgggagctctaccctcgtagtggtacttgaattcacttctctctacagttgtttagcctccattatctcttacctggactattgcagtagcttcccaacaggtatctctgtttccattcttggcactctctaatttacataacaatgacaggcaaaataatttttctaaaaagaaaatcagaggattgaaaattacaaatatgaaataaatttaaaacattacattttgatagacttttaaaatacctcattttattaatttttaaaacttgaaatgttttaaaacttgtcatgttttccgtgatcattatgctataaaaagaaatctcaataaaataacaaattaatactcagaagcaaactaaaattcatcttaataggtgtgtaacaccactgcattagaagaatagatatcagctaatgttttctctttcaatccacaattcagtggaactagaacattttcatcatcccagaggaacttaatgttaatatttttccttttactcttaagtgtatcttggaaagttttcagcttgtggaatttgctaggcaacttaaaatgctgagctatctatagaaacttctttatgccaagtttacaaaatgtgttataatgcctgaataatttcagattaataggatgttttatgacccagttatatgcacacattacagtttactttaaaagaacacaaatatagacagtttgggtcagattatgatgtacagtagtggcaataacatgaacagtaatagtaatattataccaacagttatgtattcatgaatactataataatagcagaatattaatttatttagcatttattatgggtaatcagtgtttttgttgttataaaaaataaacattagatatgtaaacattgagatatatattctttgtttaaaaaacatagtcacagatagaatgaaatgaagggaatctgacaaaagttatatatagggtgcgaatgggcaaaggacaaataaaagaattttctaatgtagaaatattttgaatctttatgaaagatgcattattttcataattataattgaaggtaaatttcaaagacttgtgcaaatctgagtctgtggttttaagtaggttttgttttccttagtgttgtagaaataataacctcatggaccagtagagggcatgattttcctatggtagaccagttttcaaatgtcctcttgaagacattaagcaaagcgtactactccttgctaaaaacgtagccctccagatgtcattgtagaattactctattaatttacttttctttatttcttaaataaacataaacaatcataaactctcagcacacttcatttttactttttgtcttctctttgttttgactttgagcagtcaaaagcaaatggcttcatttggaggaggcattcctctgaaaggatatactaaatgcctggcaaatgctgtccatatcatggacagtatctaaagcactgacaaagacattttcttgatctgtgcgtggccttgaatttaaagtgagacaagtgggttaagccgtttgtataagctacaaaatgtcatttcaatgaaaacaaaaggattgaatttgtagacattaagactaaatttaaaacttactttttaggtataaagcttctcatatcgatttctataggtccttactattattcagaacatcgtaggtttttttgtttttttttgaaaaaaattttgtaaagacaggatctcactgtgttgcttaggctggtctcaaatccctggcctcaagcagtcctccagcctccacctgccaaagtgttgggattacagttgtgagccatgctgcccagctaacatcatgttttagatagtcagagttttgccacctaacagagaagtaacaccaccaaatccagtataccacaaactaaattatatatttttaaatccatatttctactattactgagatatttctgcttttacagcattttgaaatttattattcacttatgatttggcagtgactggtatgtatttcccccctagtataagaagcatcgctcttctcatgcacataccaacaactttgcaaagtccgtggtcaaccttgtggattctgtaagtatcctggttttcttgaatttgtgtgccaagatggaatggtttatctctatttgcttacttgtactttaggtatttcttgaacaaatttaaaaacacaatcctgaagctcatctggctaaggaattataggatggtccgcttcacagagtagtgctctgagagtttcagatgactgagttattcccggaatcccaaagatacattagtgttgcttctaagttgcgtctatacattattgcccccagtctgtggaggacaaaaacagtggagaaatagctaccaaaatctatttgctattatactggcaaatgagactttttaaagaaacaactgggcttttcttaaatatatggtggtaacagagaagaaaaaatggattgaagcagagtatgtttggagaatataggtaataccaaaaaaaatttttttaaggacacaaatatattttcttagtgttcccattggtgtgatatttcatacttgatttctagatgatggaaataagtgcagtccccaaataaaactaatttggaagaataaaatatgtatctccttacaaagacttctaactgtacaaatcttcaatattgatatgttttcctcacttattttgtgaattacagaaaatgcttaagattttctgcctttttcctgccttaggttagaactctatagatatgaacattatatattatgttccaatgaatatttaagttgactagtcagaaattaaatatagaatattactccatatgttgtaatgtaaagtgctattttgcttagctaaatatatttttatcgggtattttattgtgtgttccttcttaaatgcgaaaaaaaccccaccattttttataagttgccaaatatctaaatgatacttatttactccaaagagctgccttcttttctgccttttaagcagtccacaaacctccaatcatgtaaatattcataacatatgtatgttatgtacctggtgggcacagctgcacaaaactataacatgagtggatgtgcgtcgagtatctcatatagagttaggatagcatctcagtgccaatttacacctggtttattaattttctttaatttcagctcttgtttatcttctcagaggaaaaccacaagtgaatgtggaaaagagaatcttaaccacatcttttcctctgcaaaagctgtttacttggtagcatctctgaattagtcatttcaacatgattgaatagagttacatcatgcaaagtgtaatttttattttgggttaccacataaggttctgaagctgaccactaatttttaaaagacattacatttaacttgtttttgttgtaaagtcattatataatagcttcaatttgatttaggcataatggtgttccccttcttcagtgtgttcaaagatcatccattggtttttgtttgtttgtttgtttgtttgtttgtttgtttttctttgagacagagtcttgctctgttgcccaggctggagtgcagtggcacgatctcagctcactgcaagctccgcctcccaggttcacgccattctcctgcctcagcctcccgagtagctgggactacaggcgcccaccatcacacttggctaattttttgtatttttagtagagacggggtttcaccgtgttagccaggatggtcttgatctcctgaccctgtgaagcacccgcctcggccttccaaagtgctgggattacaggcgtgagctaccgcgcctggcccattgttttcttaattagtttgaaaacagggcaaaatgacagcattcattgaagttgcttaattgtgtgaattgtttagctactgggccaaaaatagagagagagcagaaagggaacaatttaaatattgtgggtgatgccacccagtggtgaggatgagatgagtgatagggatctgctcttttttagcctcagatccttgagtctctctctctcccaatgttattttacttttcatataatatgacctccaagggtaagccagctatattgtttggtgcttatctggagatttagtgattcattccaatccagcaggaataaattgttgcactgcggttactcagaactggtatatcaggctccaacctgttacctgctatgagatttgaaagggtgattttactgaacgatgttttaaatttatgccctggctttggaatccttactgtctctccctaggacagtgaatgtattgctctgggatcgaaataaccctataggagagttgaaaccaaattgtgtgattgttctttctttatttttgctcttggaaaaaagaaaggaaaagaagattctctataatgggctaattatgaccccgtgttctctcacctcccccttcctgtccttccactgactctgactcactgatcgtgcatgtttgacccagtgttttcctcctgcacctgtcctgttgtataccctcagatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgtacgtactcatttcagcctttagtgtagtctttggtctgacatttatccttatcccttttttggttcagttaagttaaatatcagaaaatagtgacttgaacaagatttctgtgggttcctttgtctgttagataagaagcatggagttaggatatcccatgctgggatgctgatggttctgtagtcacaatatctacctttagagcccataacttccatcctcaagatcaactcacaatctaggatgcctgctggccctccagccttcattactggcagcgggcatgacatgtggggagaagggcaaaagggtactccttccagccgagctgactgctgtaaagcaggtttcctgaaagcttgcacatgtatgtttcatgaacaaatcatttgctaggtgttagtcacatgggccacacctagctacaagagaggctagcaaaatgtagtccttttagatgaactattcagttgagtttctactactaaggaaaaagggttctatactttctttttaatataataagctattctcttccccagtcatggcaaagctattttcagatagtcctctaaggttctgtcctggaatcaaaccaaccaaaccactccttcttttcctcccaccattaccgttgacttcctgttttttcagtctttaatcagcaatttttaataatcagcaatattaattctttttaatcactgctagatattctctactagaaaaaagtcaagagctgtgtctgtttatcttggtgttttcaattcctgtgctagtacatgatgcttagtaggtacttggtgcttgctcaattgaaattacgtaacataacaaatttaaaggtaattatgtcataaattttaaggtagttgaaataaagtttttgatttcttggaggaggatggtttgggggtgttccatgtaggagggtagacatattttgggagagtatgaaatgatggtccaccacgttggttttctgatagcactgctttttcttaaggcgggtgacatttcactataagagaagcagtctgagttactttggaggtgtctgttctcgcacaagaggagttggtgtgaatgaggtaaattttaccaattagagtttcatctttgcatctgttctcttttttccctatggcccagtttacatcctttctcgtgcttgtttagaatgatgacatggcaaatgtagcatgagtggcttatgttattaataaatagaacccaacgtggtccttttggttcatagtgacatattttggtgtcataatgacaatttttcgtatatatcaggcaaatgcagctgaagattggcctggagacttttaggcctctatagataagatgttaagcttttataagcttattaatccttctctgactttttttttgttataatgctcctctgtctatgttaaatttaactcattaaaatcaaaggatttctgatatcagtactgtatgtttttttctccctatgtatatattttcattttcatgccttctacctacctatctgtagaatgaactcaaacacctatttccttaatctcattgttcagattttaatactttcagttttataaaggaaattcttaattggtaacagcacccaaaaagcataaccaattatatctaaactcttgtcaatactgaaatatattataccaggttatctcaatagcctacaattagcctggaataatattggagtatattataccaggttatcccagttgcccatttagtaggtacctctcttgacatattttagtaagttaaatttattcttagtttggtataagttgaattggagcacagccttttgtgacttgtattttatgtttcaatgtgagagcttcaaattctgagagatatcacatagtaagaggggctttctgcttcttgggcccagttgtaaagaggaggtgagaagtagcatatgccatcttaagatactgacaggctctacttagggaactgagaagatttgtggtaacaattaagaaataataactagctttgtgcactctctcaaatgtctcccacacactttcaactctgaaaaacagtatggtcttccaatggcagtggcacaagtattatcgcagagcctggctcaaaaccttggaatccaatgggaaccttctagcagaaagccaagtatgtacactgaccttcttactcattttcatgtgccattctgtctgtataatgcatgtccagtcaataaataaatatttttcattccagtcattatagtttaattgtagtatatctccttcctctaaaatatttagaaaataagcaacttaaggtaatttttaatctgtttaggttgtaaaaatttccctttcaaaatccataaaatcatacccagtttctccgggaatgagtcagctctttctcacactgcagaatgtggggctgggggcagggaatactctcacactcagggttctagcagctgagcagacgtacaaggtgctagataaagcctccatcacaagcttagtgagatcacagttggattgggaaatagcttagatctagagtcaaagagagctcatctttaaactctaatgaaatttacccacctagtctcatcagaaaagttggagaaaaaggctttgcaagggaagaccctgccccagggccttttaagcatgggaacaggtggtagaggataggattctcctctagtggcccaggcaggtccaaaaaggagaaccaatagggccacacatcccatcagtaaaaaacatagccagtgactgttaggcgtcattttttcgttaatcagatgagaggtagataggaagacagggctgattttctagtgggcaaagggtctagggctcacagtaatctgaagggtccatgaaaaatgttaatttcttttaaaatcagaataaaagtcaacccagattgtgtttatctttatacaaacccagtggtaaaatataatttttaatacatttttatgacagtgggcaacgacctaatgcaatccggtggaaagagagaccaaagtgttcattcatattattcacttaactagaaattagatgaaagtgccttcctattttttgaaaatatgagacactgggagtaaaggtctcacttaccaccccaacctccctagagaagaaaaggaaaaatctaccttaatatcattctatattttatattctttttttcattaatgcataatattgtggaaaattgaaacaaattatatttacacaggcttctcaattccctttatgggtacattaagatagtcatcacaagtgtctggtggcatttcacaaacctccgcaaacttccattgattatcttgctcagagtgtttgctctcccaggaaacacctagtacacattaaaggaagtgtttagagtttcaccatctggcataaacaccttaaaaccagaaaggtgtatgaccaggtttatgcccttgtttagaaatcttgaatctgggaggaggccagtgctagagtcagctgagaggtgttactgagttgcatgatggaatagggtgagaagtagacttcattactaatgcctgccatcgttccctccttcctaaaattcttttttttttttttttttttgagaatgagtctcactctgtctcccaggctggagtgcagtggcacgatctcggctcactgcaacctccacctcctgggttcatgccattctcctgcctcagcctcccgagtagccaggactacaggtgcccaccaccacacccggctaatttttttgtatttttagtagagatggggtttcactgtgttagccagtatggtctcgatctcctgacctcatgatctgcccacctcggcctcccatagtgctgggattacaggtgtgagccactgcgcccggcctaaaattctttatttctttgtgacttgtttgtttaggtagctatttcattggttctaaactttgagtttaaaaaatccatttggaagtctatctttgcatatacctctctctctctatataggtatatatagatagatgtatacctctctctatatatatacgttgatatatattgctctctctatcgatatatcgatagagagagaggcatagaaaagagaaacaggaaaaaattaatgaagagaagagcccatcacaatatcaatatgtcagtttctggtatcgaagttaagttgtaattgtttttaagtgattatgtacacttctgttttagattgctctctttcactaaaccttttagcatagtgttcattcaagtctcttgctcatcctcacttcaactctaacaaattgaattctcttctctaacttcgagcattctctgttagaaaacttcagtgatgatatgttgtgtttgtgcaacagagctttaaaattcacagcacataggtacaccgtctagtgtgaaccccacaaccactctgggagatagacaaaaaggtgttattcccatttagaggtagaaacactgagacccaggaaatgctaagttacttgcctatgggactctctcatatgacagatcttggactagaactcaggctgtctgatttgtagaccagggtacttttcactaaacattagaactaggaaccaaattgagttgtcagagttacaaaaataatgaagagaggcacaatattacttcttgccagctgttttcttaggaattaacctataattctggaaaggataaggaactattgatttaaaagaaattttgttctgtaagacttcacattccgtgtctatttgactgacatggaattggtaataaagaattattgtaggagttgtaataccaaaaaaatatgtgactttctttgtttcctttttcttctgttgcttttattgttttattggaccagaatgtgactgcacagaatcctggggtggctgcatcatggaggaaacagggtaaattttcattatgcgtgcatttgatatatgccttttgctaaaattgctgtgtagagttagaaacaaggtctctcgggtattggtcttttaggctaagcacaatataaaatgaataattaattgtctgatatttttaaactgaaagatctaatttactttgtattttaattttttatttaaggttggtgataaaagtaaaatgtattaccttctacttcttattaacccttaaaggaagcacatgattaaaggcttctaagtttagtggaggcattaattttttagtacacttagattaaaagttggttatctacctgaagcagtcagtgaaaatcaatttagtcatcaatttacattttaaggaactcgtaaatatatatgtttacggtaataaaaattaaactttactgtttataaatcaataaagctttttaaaaattaagacagacttattgtatctaaatcaggtagtcttctagtgatagacatttgaacattccctcacttttcttttgtgaatactttgggaactagagcagcttccccagagctgctgttgcttcagtgaaccaaggcctggaaatattgccctctttcacagggacccctgcctcatgggagccactgcccccagaccccctaagccataacccactcctagtagaggggagaggtttcctcacccatgtgcctcttttgctttctttgccatgccagacacctgctcaacacaccaaccatttctggtcctacctccgtccctctggttgccagaggccctgacctacttggacagagctcctttgttttcttccaccagccctcctaggagtccaactcctggggaggagtgtgggcatgaaggtttgcacagtaggccattatccctgctactttagaacgcatttctagaaatagagtttaaaacgtgaaacccttagcttccacggttccctattactccatagcttagtaatttatggcttaaccaggctttttgaggactactataagaagataacacctataatattggttctatagggagatgtcttctgtcttctaaattaatctctgaagtttttacaatgactcttcataatatatataacatataatatctttaatatattttatataataaaatatataaaatgttttaaataagataaaatgttttaaagttaacatgtattttctcaagaatacatttctatatatttttctaagaggttcctatcaacagtggcaggtttcacctacttctgtaaactaccttcatacatcagaatgcataaaattattgaattacttcctagaataagtggcctgtcactcgcaagtcaagcactgttataatcacgcactgtattcctgaggaataggtgtgcgtgtgtgtgattcagtttaactaaccatgtgtataatattcccctgtgttctgacatagagatattatatttgattaagtaattcacagaaaggctcattttctattcctgattaataatgaatatcaccaaatagtatttgaaattgagaataaagagccattattcatggaagcgtaccccaattctattgtcactgtgcatatacatactaaaaacatacgtgcatatacatatatgatctaacacacctctttaaggtttccttgtttacctgaatgcattgttggcctgcatgatatagtctttaatatactggccctcacaactctctcctccaatgtaaaatctagtacgttcatgagctccttttattcagaaaacagaggcaaaaaaaaaaaatgcttgactttaatgagatatagcaaataaaaattaacaaactttaaaatacagcctatttgaagaggttttgtaatgagctttttaaaaaacatttcaagcctggtcacaaaagggcttgactgctgaggaggttgtaatgtagcccccaaatctttgattttctttgaaattccatctctgcaaactccaccacaggtacttaagtggcaatttgaacataagtcccttgtcaaaatttgtgtagattcatttggattcaaagtgaacattttgttctaatttaggggttttaattttcttctctgatgattgcttttggtaaattatttacatagttgattctttgtttcctcagggtgtcccattctcgaaaattttcaaagtgcagcattttggagtatagagactttttacagagaggaggtggagcctgccttttcaacaggccaacaaaggttagtaacttagaaagcatactaagaaagtatattatttctccagtgttttacagtgcaacagtgctggatatcagacgcctgtcttggaaagcaggtttcttgtcaatcagattaatatttagttataaaagtccttatcatgttaaagattgagtcctgtttaaatgaatgacaaaaccatagattcagcattctcagtctctggtgtttcagtgctagctagaactcccaaatcctcccttccaaagagcaaacaatccttcaattaaaatatctttgagattttcatgttaagatttttaccctgctgctaagagatggtgggttaaattaagataaaatattattttaactaatttctctgataaaaattccatttctccttgacattctttctagggacaagtattagtccattttcacactgctataaagatactacctcagactgggtaatttatagacaaaagagttttaattgactcacatttccacatggctagggaggcctcaggaaacttataatcatggtagaaggtaaaggggaagcaggcatcttcttcacaaggtggcaggagagagagaaagagtgcgaggaagtgccacagtttaaaactatcagctctagtgagactcactcactatcatgaggactgtatggggaaaccgcccccatgattcagtcaccttccaccaggtaggtccctccctcaacagtggagagtagaactcaagatgagatttgggtggggacacagagccaaaccatgcagggcctgactaatttcttgacttttgtttttttttgagtggtttgtcctcttgggacattagttccttatgaatatcagcgagccaaaaaatcacccaaggtatttatggataccataaatacacatacgtgtttataatgcattgtctctttacctggagagggccacattgtcaattggcatctcgtcaaactttgtgtatatagtgtcacaatcccttattcgtgtattcttaattcagaaaactgaaaattttcagaagtgttttttatgtttgtggaaaacacatttgacagtaaaacttgtcctaaactgaaaatatttatacctcataaggtaaatattcataagtcttgttgcagaaatattaactgattatagggtgtgtcccaggcccctcaggactattatatagaatatggtaaatgcatcgtacttctctaaacttcagcaaagctggaagtctcaaactcaccagcttcaaagcttttgcataaatcggggctgtagacctgcagtagcatgtttggaaatgaagttgctcagcaggcaaaagataggatcaatgctaattagcagatggtatggaaattctaacatggcaaatttcgtatttctttttaaaatactacttcatgagtcaaatatagctcattgctatgcaaaatgtttaatactttgcaaactgagagagcagcgaaataatgttaacctttttttttaaatcagtaactaatgtggtaactaacaggataatttattcctaaacccataattaagtgacactacgtagtcaggagatggtggcttgatgcctgacatctgtgtagaatcttagtatggctgtggaaaaaagaaacaggactttcaaagtgaccttgcgtcgtgaaagtcagttgcctgcctttcataacgttgatttcaatgcaacagaaatccaaaagcttcaaagtgttcaaaatgggtgaaataagtaataatgaactaatgtgagctgctggcatttttgaattgtaatgtacatggctaattttacccaccttgtagcttaggagctaattataagcatcatgcctgaggaaacaactctcacttgtttggaaaggttaaggtttctagcatatgcataaagatccatcaatggatttctgaaattgtctatgagttaggagaaaattattctaataacttggaaatgaaataaaaataactataaatcatctattttttaaaaagttagtaaatatggaattatgtctttttaaactacgtagtacaatggttaataaacaactatggatgccagtggaatagtttatatgtatgtatcaaagaagtgactttttcccccaagcgttttgaatgtatgtatatgcatgtgttgtgtgtgtattatttttacattatatgtgtgcatattttctgtgctttaggaatcttccccactgccatgttttccacactgttggagatagtgacccgtctcaggatggaggcagagtcctaagaaggaaagaagggggagcctggtataaagtgcaggccatgttctagtcagcccttcccttttccagtttctcctgcctcctgatcaaaataacacagagatgtgcaatgctgattttgctcataggacttttccacagggggagtcccacccaagtagcctggaaacctttgcttttcgtaatagttttgccttcctggaagtggaaggaggatcagttctttctcaggtgaatttagtggaaggcagcgcttccttgaggtgtgttcagctgctggagatggagtcagtttctccctctcatatttagggctcagagcatttgggttggagtgtgctgctccagccttcatttaaggtgtagtgattatgcccagagaaatcctgcccccctccccactgcccctggaatgggaagcaggcatgtttctcataaacagtcaactacctttacagttgctctataatatagtttatctggcaagcaagttcatggcaccagtagactagattattctagaaattatactcttctattgccctaggaatgactgagagatttctgtatatccatacatgtgtcttatgcttgcagacacttgagatttcttttcagtgagaatgatggtcttggatttctagcaacattttttcccctaagtttacttgcatttacttgattgtacatatcacatttggctatgactgaagcatatttatctttttgacagtttttatggcttctcagctgtcttgagacaagttagcaaattagatatctgtgagtcttattagcaatgcattttagctccattagcaaatatgaaaagtgatctattcctcttgacagcttgtctccatgaaaagtaactctaatgctagagttcatctgtggagcccacagccagagaatcccccaagagatattgccccatttcagatatatttttaagtactattaataagtgaacagtatttcccatacagtcatcatttataagatgccacaacaacagatcaaagaagaatatcacatgatagctgattatacggccattgtatgtggcccagttgatgtgctgattttctgtgataaattgaaacatttttcccttctgtccctaatctctttagctatttgagcccacggaatgtggaaatggatacgtggaagctggggaggagtgtgattgtggttttcatgtggtaggtataagaaaccttctatacttacagcacagatcttacttggtgcaaacaggtatagcatttgtgagaggccagcacattgattgtggtcttactgcctttctttctcatctctctgattagtgcttaattcaactcagacctgttggaatcagtcatgtccttatggccttgtctgagcaaacctaatagattcttctaattaaattccctacctcttaaaaatttgtagctcatattcatctcagataagttttaccaaatcgtaaaacattctttccgtgttgtatattatttttatctttataaaatagattgggtattagaatgtagtggagctaattggaggagaattgcctgctaaaaattaagctttctcggccgggcgcggtggctgacgcctgtaatcccagcactttgggaggccgaggcgggcagatcacgaggtcaggagatagagaccatcctggctaacacggtgaaaccccgtctttactaaaaatacaaaaaattagccgggcgcggtggcgggcgcctgtagtcccagctactcgggaggctgaggcaggagaatggcatgaacccgggaggcggaggttgcagtgagccaagatagtgccactgcagtccggcctgtgtgaaagagcaagactccgtctcaaaaaaacaaaaaggaaaaaaaaaataaagctttctatttgctattgaagtcctttcatagaagatcttactttggtgacaagtatggcaggaaggaatctatccttgtttaaagtaattaattctttcccagaatatttgcttactgttgtataaatgttctcatttggaatatgcatgccacgtgtggagagaatatgaatgaccagcaggtaaggctcttcgcttactcacgtgaagtgttttctctaggaatgctatggattatgctgtaagaaatgttccctctccaacggggctcactgcagcgacgggccctgctgtaacaatacctcatgtcttgtgagttttctgacagtttcatctttcttttaattgacagattagccagatatctcagtgtgtacactgagcatttgtgtagcttgtcacaaatttcttgggtacagtgtacatattagcctggcagttttctaggatcgataaatctcaaattctgtgggccgcaacatttatctctactattattcactaccaaccatcttatcctccaatgcctcattaggaaaatatacctaaactgcttccaaaagagttgccctactaacatagatgaaatccaaattaaattgttgaatagaggggagacaatttctgtggtctttttaataatatgacctacttataacatttttcttcaaaacttaccctaatttattttagacctgaacataaaagctagtgctcatattttcccattgggcttttaaaatcccctgtaaaggcaagaaagtgagataggaaagtaacatatgaatgcacactcatatgtgtatatacatggtttgtgtgtgtgtgtggacagacacagtcttccatctacagagaccaccagttatttttgaaaactcattttaatcttcccttttctcatatatataacctctaatatttcttataaccatagaattacataattttatgattttgtttcaatattagggggtactatgcattatggtatttagaagtttctagcttatttctccttgcttcatgtccccaaccagattataaattgcttgagggcaatgggctctttccttcaccttttacccacaccctcctcaaataaaatgctttgtatacaaaaggcattccctggcattactaaaggtaattcgtatgaatttattaaaatttgattgtctgtgtttagcaaaagaaagtttaatatctatgctaataggtaattcagtgaaggttgggtatatatgtgaattcttcagagagatcttaaatgtttatattatagtgttttgctattttgtcttaagccaaaccagaatttcttctttaggtgatttccgtcacattgttttctgaaaatagtactctgaaacagtgggttttgaaatctgaacatttaaagctttggttgatgattcatctttagtgtagagggtagcatctgggtcttgtttctattctgcaataggatattctgtcttgctaattcttaaaaagagtttggtgttagttatgcgagagtataggcattgtcggtgagtctaagaatgttataataactctgaaatattatgtaatgctaactcttaatattgaattttgatttgcagtttcagccacgagggtatgaatgccgggatgctgtgaacgagtgtgatattactgaatattgtactggagactctggtcaggtatggcgcactgagtttttggtaatacattttacttgtacaggttgagtattccttaccacagtgcttggggccagaagtgtttcagatttaagattttttggattttggaatatttgcatattcataatgagatatcttggggatgggactcaagtctgaccatgaaagtcatggatgtttcatatacactttatacacatcgcctgaaggtaattttatgtaatattttaagtaattttgtgcattaaacaaagtttctgtacattgaaccattgaaccctcagaaagcaaagatatcactatctcagccacccatgtggacaatcagtggttgtttggcatcaccatcattcctgactctgaatctgtatgctaccaataggcaattactttcttgtacttattcacacctaattacttaacagtaaaaaaaaaaaaattggacatgcattaagacattgaaaaaataatatgttcaccaagcagcacagtaacatcacccagataactgtatcagctgttgaaaaatagcaacaatgaaaatggcaggctttcagtcaccacttatgatgccgtgttttaaacctttgaaaaggttactgtaggatgtattttactttttttttttttaagaaacatcagaagcagtagagggaccaggaagtgggtcctctacggataagggggcattctgctggatggctttttaaaatgtttcctccagagtcatctgcctcattaacagagtttttgcttagaagtctctctttgattttattaggttggtgcaaaagtaattgcggtttttgccattgcttttgatggcaaaatcaataattacttttgcaccaaccaaatataaactggcatgatttcttgttatgaatgcacactggctctcgttcttcacaaagcccgtcacacactttcaccatatgtccagaggcacttctgcagtgttaacaacgtcatcttcatcatcatgtcaacgttcaaaaagtttcagattttggagcatttctgatcttagatttttggattagggaagctccctcaacctggctcaacctgtacatattttaaagctttcagtatagattgcacatgtgaatatgctttgttttatgttttattttgcttggttttctggttatttctagctctttaccatacctttattttaggaaagtttggtgtggttttcttttttttttttttggcaggaggggcctaaatctttttttcttcctaatttctccttcataattagttatctttatatgatttatacccaactaattgagttttcttttctggtccttatatcttaaacagtacactcacattgatgaagcactaatgtgctgttttcaaacattttaaagccacgaaactatttattagacaaaatttggatggatgcccaatgtagaaaataaggaataagcagcactactctggttaaagtgggattgggagcagaagtccacctttcttaattctccattgccgtgtctgtcccacagatgtagccctggcttcatggcctatgtggtttggcatgatcttcttcccattaagcttattgccacataattaatattgccctctaaaattccttctttacataatgtttatgtttttaatttacctattttatgtgtttaatttatacatattatgtctttatttgtcattcaaatgagtatttgttgagggcctactgtgttaagcactgctgtaaatgctgggacatggccttgctcttgtggaacctacattctgctgggtatagaaaggcaagtaaataaaaaatcagatggtggtaagtacaaagcataaaataaggcaaagtggaaagagtatagggtaggatgtgatagatagggtgatcaaatatttctttctggaggacatggcatggaagcagagacacaaataagaaggagcttgtcagtaaatagtgagtacagaagcttaacttctccatgaaatggaatgaaagcaaggatagctggagaatagtagaaacaaaaaggaagtcaagaatcagggcaggtagggacatgtaggccatggaaagaattttagatttcattctaccttcattttaattctgacattattttaaaagcatttccccatactgttacacagtttttatagttaattcttttcacgattgtatgagagtctgtcatgtggatttatcagttgatttatacccagtatgggtatttagattttggcagtttattattagtagtatagaagtgaacatctttgtgcatttttaaaagagtgtttcttgttcagggttagctcctcaggacaagctcctaaaaatggggttacctgttgctaggcattgtgctttccaagaggctcccaatagagtacacttggcagtcaaaatatcacttttattattgaaaatggccaagttgaaggctgtagcttaatgtgagggctaaaagttatctttaagatcccagttcaggctatagcaacaggttactgacaaaattgggtccagaaggacaatgtatggcacggggagcaatggaaaatgcatggtttatgtgggtaggcttgcttataaaagaatggcagaactgtggcggaatgcctagttcttcttcccaagcttatcattggtcagtcactccacctcccaatgatggaagtgagtaaggagtaggggagctggggttacactgagttccttaaccagaagaaaaaatgaggagagagaaagaagggttcctaagtaacatttttgtaaaggtgttgatatatattatttgaaattcaattcagatggaccctcttaaagaaatggtacagtgaaatatgttcaggccgtgttttcatgatttttatgcatatctgtttcttacatttcaatatataaataggtttttttgcaattttctgtaatataatgacaaagtatgagaattgtaggttctgtgtttaatgacgtgtattgacaatactgatacactgtttcagagttatatttttagctttgtagaatactactgtttttatgtttaccatatatggttttaaaaacttctgtgtattcagcccttttagaggtatagttttttcatttcaatctttaactctttaagtgccatagaatttactagaaataagatttttatgatgagaactctttgtttaacctaatattctattgtctaagtaaaacattttttctttttatagcatgtgtctaagctgaaaattatactgttaaattaatttctcagtacatattagaatagaatatttttgctaatatttttctagcatgatcaggatgaacctaaaatagaagtagagggagttaaaaccccccaaaattcttctttttctccttaagaaataatgagctttgaatttaattaatactactaataattaagaaaatggaatctctacaactctgagaatcagtatttacaggcaacattatgactttatctcttttacctcataatgtgtttttcttaatttttatattagcatttactgatgcctcagagctacttattaaacttacggtttataatagaataaacaatacttacgtaattaagagaaatccttgacaaacaatactggtggatgtaatacagatatttgaaagatagcagaaataggagaaatgttttttgttagtgctatgaaatatgtcatctaagtgggtagtataacataatttaaaataaacacttctaaatgctattgcactattgaagcctgcctgcctcaagtgaaccatcctgtatagcataatgtacaaggaaggttctggaatgacatttagagactgaatccaatgctccactcataagcagaataaagtgcacagatttatggttttcctgttttaaatgtccccagagaacatagtacattccctaatttccctcgttaaacattcccatgataagcaactgtcttttattagcctaaactaaaaccaaatagattagaaatctcacatgtggctatgccaatttagaataagggcattttttcttttttttttttcttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtctgatgttccccttcctgtgtccatgtgatctcattgttcagttcccacctatgagtgagaatatgcagtgtttggttttttgttcttgcgatagtttactgagaatgatgatttccagtttcatccatgtccctacaaaggacatgaactcatcatttttcatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggcttggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaggtttttttctaactgaaacatcacaaaagtaaaatctgataaattaattttagatcctgatgtgctttttctaatagcaatattgcttttgcattactgttgactgtggttgtgttagttttatttattttttaacattacaaatctatttatttatttttccataagtgtttggggtacaggtggtatttggttacatgagtaggttctttagtggtgatttgtgagattttggtgcatccatcacccgagcagtatacactgcaccatatttgtagtcttttatccctcacccccctccccaattccccccaagtccccaaagtccattgtatcattatcatgtctttgcgtcactacttagctaccacatatcagcgagaacatatgatgcttggttttccattcctgagtgacatcacttagaataatagtctccactctcatccaggtcactgcaaatgctgtaaatccattcctttttatgactatgtagcattccatcatatatatatatatgtatgtatgtacatacacacacactacagtttctttatccactcattgattgatgggcatttgggttggttgatggtcatttggggtggttccatgattttgcagttgtgaattgtgctactataaacatctgtgcgcaagtatcttttttgaataatgacgtcttttcctcggggtagatacccagtagtgggattcctggatcaaatagatctatttttagctgtttaaggaatctccacactgttttccatagtggcggtactagtttacattcccaccagcagtgtagaagtgttccctgttcactgcatccacgccagtgtctactgtttttttatttttttattatggccattcttgcaggagtaaggtggtattgcattgtgattttgatttgcatttccctgatcattagtgatgttgagcatcttttcatatgtttgttggccatttgtatatcttcttttgagaattgtctatccttagcccactttttgatgggattgttttttttcttactgatttgtttgagttcattgtagattctggatattatttctttgttagatgcatagattatgaagattttctcccattctttgggttgtctctttactctgctgacttttccttttgccatgcaaaagttctttagtttaattaggtcccaactatttatctttgtttttattgcatttccttttgggttcttggtcatgaaatctttgcctataagccaatgtctagaagggtttttcaatgttttcttctagaatttttatagtttcaggtcttaggtttaagtccttaatccatcttgagttgatttttctttaaggtgagagatgaagatccagtttcattctcctacatgtggctagccatttatcccagcaccatttattgaaaagggtgtccttttccccactttatgttttgtttgctttatcaaagatcagttggctgtaagtatttgggtttatttctgggttctatatgccattggtctatatgcctatttttataccagtgccatgctgttttggtgactatggccttacagtatagtttgaaatcaggtaatgcaatgcctccagatttgttcttttgcttagtcttgctttggctatgtgggctcttttttggttccatattagttttagaattgtttttgctaattctgtgaagaatgatggtggtattctgatggggattgtgttgaatttgtagattgcttttggcagtatgctcgtcttcaaatattgattctacccatctgtgagcatgggatgtatttccatttgtttgtgtcatccatgatttctttcagcagtgttttagtatagaggttttttgaccctttgttaggtatattcctaagtattttttttttttgcagctattgtaaaaggggttgagttcttgatttgattctctgattgatcgctgttggtgtatagaagagctactgatttgtttacattaatcttgtatctggaaactttgctgaattcttttatcagttctaggagctttctagaggagtccttagggttttcaaggtaaacaatcatatcatcagcaaacagtgacagtctgacttcctctttactgacttggatgccctttctttctttctcttgtctgattgctctggctaggactttcagtactatgttgaagaagagtggtgagagtgggcatccttgtcttgttccaattctcagagggaatgctttcaacttttccccattcagtattatgctggctgtgggtttgtcacagatggcttttattacattgaggtatgtcccttgtatgccgattttgctgagagttttaatgataaagggatgctggattttgtcaaatgctttttctgcacctattgagatgatcatgtgatttttgtttttaattctgtttatgtggtgtattgcatttattagcttgtgtatgttaaaccattcctgcatccctggtacgaaacccacttgatcatggtggattatctttttgatatgttgttggattcagttagctagtattttgctaaggattttagcatctgtgttcatcaaggatatcggtgtgtagttttcttttttggtaatgtcctttcctggttttggtattaggttgatgctggcttcatagaatgaattagggaggattccttctttctctatcttgtggaatagtgtcataaggattggtaccaattctttgaatgtctggtagaattctgctgtaaatccatctggtcctagaccttttttggctggtaatttttaaattatcatttcaatctcactgcttgttattggtctattcagggtatctaattcttcctgatttaagctaggagggtttcatttttccaggaatttatccatcccttctagattttctagtgtatgtgtgtaaaggtgttcatagtagcttgaatgatcttttgatttcagtggtgtcagttgtaatatctcctgtttcatttcttagtgaggtttttttggattttctctcttcttttcttggttaatcttgctaatggtctatcaattttatttatcttttcaaagaaccagctttttgtttcatttatcttatgtattttgttgttgttgttgttatttcaatttcatttagttctgtgctgatctcggctgttttctttcttccgctgggtttaggtttggtttgttcttgtttgtctagttccttgaggtatgacctcagattgtctgtctgtgctctttcagaccttttgatgtaggcatttagggctatgaactttcctgttagcaccacctttgctgtatcccagaggttttgataggttgtggcatcattgtcattcagttcgaagaatgttttaatttccatcttggttttgtttttgacccaatgctcattcagcaggttatttaatttccacgtatttgcatggttttgaaggttccttttggagtcaatttccagttttattccactgtgatctgagagagtgcttgatgtaatttcagttttcttaaatttattgaggcttgttttatggcctatcatatggtctatcttggagaaagttccatgcactgttgaatagaatgtgtattctgcagttgttggatgaaatgttctgtatatatctgttaagtccatttgttccaaggtatggtgtaaatccattgtttctttgttgactttctgtcttgatgacctgtctagtgctgtcagtggagtattgaagtcccccactattattgtgttgctgtctatgtcctttctcttccttccttccttcctttctttttttttgagatggagtttcgctcttgttgcccaggctggagtgcagtggtgcgatctcggctcactgcaacctctgcctcccaggttcaagtgattctcctgcctcagcctcccaagtagctgggattacaggcaggtgccaccatgcctggctaatttttgtatttttagtagagacagagtttcactatgttggtcaggctggtctcgaattcttgaccccaggtgatccgcccgccttggcctcccaaagtgctgggattacaggcgtgagccaccacgcccggccaacatttcttaggtcattagtaattgtttggtaagtgtggtagctccagtgttaggtgcatatatgtttaggattgtgatattttcctgttggacaaggccttttaccattatatactgtccctctttgtctcttagccactgttgctttaaagtttgttttgtctgatataagaatagctactcctgcttgcttttggtgtccatttgcttggaatgccttttccacccctttactttaagtttatgtgagtgtttatgtgtcaggtgagtctcctgaaggcagcagatggttggtgagttcttatccattctgtgcttctgtatcttttaagtggaacatttaggccattacattcaatgttagtgttgaaatgtgaggtaccattgctttcatcatgctctttgttgcctgtgtgctttggttttgtttttttgtttttgctttctaacttgtatttttgttttatagatcctgtgtgatttatgctttaaagaggttctgttttgatgtgtttccaggatttgtttcaagatttagagctccttttagcagttcttgtagtggtggtttggtagtggaaaattctctcagcatttgtttgtctgaaaacgattgtatctttctttcatatatgatgcttactttggctgaatacaaaattcttggctaataactgtttgaggaggctgaagataggtccccaatcccttttagcttgtagagtttctgctgagaaatctgctgttaatatgataggttttcctttatagtttacctggtgcttctgtctcacagctctaaagattctttcctttgtcttaactctggataacctgatgacaatgtgcctaggtgatctttttgcaatgaatttctcaggtgttctttgtgcttcctgtattttcatgtctaggtctctcacaaggccaaggaagtttgcctcgattattccctcgaatatgttttccaagcttttagaattctcttcctccggccgggcacagtggctcatgcttgtaatcccagcactttgggaggccaaggcgggcggatcacgaggtcaggagatcgagaccatcctggctgacgcagtgaaaccccgtctctactaaaaatacaaaaaattagccgggcgtggtaacgagcgcctatagtcccagctactcaggaggctgaggcaggagaatggcgtgaacccgggaggcggaggttgcagtgagccgagatagtgccactgcactctggcctgggcgaaagagcgagactccgtctcaaaaaaaaaaaaaaaagaattctcttcttcctcaggtacaccaattattctttggtttgattgtttaacatatcaaaccttcttggaggttttgttcatattttcttattcttttttctttttctttgttggatggggttaattcgaagactttgtctttgaactcttaatttctttcttctacttgttcatttctattgctgagactttccagagcatttcacattctaaaaatgtgtccaaagtttcctgaatttttgatcgttttttctttaagttactatttccatgaatatttctcccttcttccatcattttttggatttccttgcttttggctttgcctttctctggtctctccctgattagctttataactaacctcctgaaattctttttcaggtaaatcaggaatttcttcttggtttggatcccttgctggtgaactagtgtgattttttggggggtgttgaagagccttgttttgtcatattaccagagttggtttttttggttccttctcatttgggtaggctctgtcagagggaaggtctaggggtgaaggctgttgttcagattcttttgtcccacgggtgttcccttgatgtagtactctcccccttttcctatgggtatggcttcctgtgagctgaaccacagtgattgttgtctcccttctgtgtctagccatccagtgagtctacccggctccaggctggtactgggggttgtctgcacagagttctgttatgtgaactgtctgcgagtctctcagctgtggataccagtgcctgttctgttggaggtggcagagggtgtaatggactccatgagggtccttagctttggtggtctaatgatctatttttgtgctggttggcctcctgccacaaggtcgtgctttccagaaagcatcagctgtagtagtgtggagagggaccggtagtgggcagggccctagaactcccaagattatatgccctttgtcttccactataatcagctcttcagtttgtgtgggagctgggtgaggcctgtgactcctggcttcccccactttcctgacaacctgcatgactcagcagaggcagccataatcctcctaggtagagacctgggagtctcacccccatcccccacagcaaccacagcaagacccacccaaggagagtctgagctcagacacgcctagtcctgtccttacccgatggtcccagcttcaagaaaaaagggctttagttcttccccggcctgtgaagtctgcacacccgattggtgccctcccccaagttatggccaggaggcttctcgcccagttcaaattgttaaaaagttcagctagagaattccttctccctgtggagttttaccccctgctcctctggccaccttcccgttggatccctatggtgctaggcaggaatgggctgctcggggacccagtgaactctcagggcctttttgttgcttcctctacccctgtatttggcttggctctctagcttgactcagttccaggtaaagtcggaaacttttcctgcaaacagaccttcagcttctccagcgggggtgtgtgttcccacttccacaattggggcactcacagtatttgggtgtctcctgggtcctgcaggagcagtctgcttccttcagagggtctgtaggtcctcttgggattgctagtttgttcttgcagtccatctggagctaaaattcacagtgcaggcctccgcatgctgccctgtccggagctgcaatctagtcctgcctcctgtccgccatgatcccgatcactggttgcataaggttaagagtgagtgaatgattaatgatagttgattaatgagataatgattgcattttgagtggctctggatggattaaagaaaccacagggatttctgctcttgtgtagttgtgtatttctgctttttactgctgatcccttgaatactcaccagattgaaaagctgtggcgaatgaaacatttatgagagtcagttattctttagaaaggtgtagaaccaaagcatttgccttggaatgtttgttaggaaattactgcttcttaggaatgctaaattagttctgttatctttctgtggtgaacttgataaatggctcaatatgtgcagcatagaataacatagtcgtatctggttattgagtcattcatttattttctctgtgagctcacagtacttgcacacctgccacatgcctggtgttgttgtaggtactagggcagcagtaaggaacaaaacatagaatcctgcttgcatggagctcacattatgatggggcaacaatgaacaaacaagtaagtaaaacttatgaattgtcagttggtgataagtgctttggaaaagaaaaaaaaacaaagaaaaaaacttgtagacttctctaaaaataaataaataaataaaaagcccttaaagcccttatcctaaattggcacagccccagagagtgccagcattggaggggctgcagctttgaagagcataggttctataaaggcctctttgggatgatgatatttgagcaaagctctaacaaaggtgagggaatgagccatgccgaaatccagagcgacaacgggaaagcaaaggcaaaggctgtgggtggcagcatgactggtgtgtccacgtggactcacatcagccatgggtgaacagaaaatgatgtcacagagatgacggggtgagaaagtataggagcagatcatgttgagcttggaaggtcattgagtaagctgggaaacagaagatcgatgtgatttggtatttacctttttaaagagatcactctgatagcaatgtaaactctaaggtgactaggatagaagcaagggactcaggtgggaggctattacagtaatccaggtgagaggtggtggtggcttggacagggtgtgagcagtggaggtggagaaaaggggtcagattggaattatattttgaagatagaactagcaggatttatggacagactagatggaggaagagtgagagaggaggggaatagaagatgactatggcctttggcttgaacaattggaaggatggaacatcatttactgagaaggtgaagactgagggaggacctcagtgcacactgctgtttcttatttatttgccatgcctgcatatttttttctttttgtatttgttttaaactctgtagcagggcctttgacttgatctttttccattctcttaaatgtagtcaataaaatgtacagagagtaactttggggggaaatgaagtatttctttaaaaaatgatttgataaatagacctataaaaagaaataaccatcacatcacagactgttctagtaacatgtctgcagtttgaagaggtcagaactattaatataatggagatatagcacttactttgtgttgaaaggcagagtatttcttctgtttcactaaagtagcctataggtaaaatgtcatgatgtcaaatgcagatttgacattttcagagagctgagcaacttcttgtaaattagtttcttgaatgtgaccgttctatgtaccaagctgattcatttccttcattgtccattttaatctcttctacttttaactctgtaggcaagtgaatgtgacttgttattctggtccatctcaccataaacagaggaaacatataaaatgcatgcactgtgtggcccttacttacttattttaccaataataggataaataatttgaattaataacgtatttaaggagttgcatgtgtttttctcaatgtttctagttatatatatccaccatgcttgcattatatatagtatgtacattatctgaaggtacctagcatgctgaatattaactaaaaagataatattttgcagtgcccaccaaatcttcataagcaagacggatatgcatgcaatcaaaatcaggtatgctgggctataaattttaagtgtaatttaaaaaggattcattggaaagtttttttttccttttttgataaatattaatataactttgaagggaattttactcaagtaaattattatagtgggattctaatttagagttgcttcatgttatgccaaatattaaatatatttacctctggtgacaaattgtccagattaagagaaaaaaaaaaagaatgtaatggctgaagaactgggagtctcatttattgagttgtgaccatctttcagtaatttcagcctgcctggtgtgtgaaagaaaatatgacaatctgtcatgagttttttttcccctgaagccatattataacctacaggtgagtatcatgatgtcaaatgcagatttgatgtttcctaaccatccatacacaaaagaagctaaaaatcattttggtgtctctcacagaaatgtaccaatttttgtttgctgtaaaatttcaaattgtagatgtttagtttacatttagagagctgtacaatgagttctgtttagagttttaaagttttaactcttattcttgagatatttgtgatccttactggtcactataaaaatattagggtatgaaatgaaaaaactttatccaagtgaaccagaaggagacattgtagtaaaaacattggggaagacaaactgactctgtgtgcctcacatgtgtgctcctgtccccagggccgctgctacaatggcgagtgcaagaccagagacaaccagtgtcagtacatctggggaacaagtaggtcgcacctccttgcttggcggttacacataccattttctcttaatagtgttcttctctgccagtcttgctgagagagatgcacagcttggagtgatgttttaaaaaaatctagaaaggatgagaataaagagaactgtgaatcttagtcacaaaaactatagaaaacaactgcttaagttgggtacttgtcagaactgagcagtgccatttaatggctgtggctctcagagaaggggtgttgcattcatttgcaaagattgggttgagtacagtgtgattatccagccacttgtgtgatttattttgtaccttggttttaacatttgaccccctttttttccattaacacacacacaagttagctttctggtttttaccgcaggaaaataccagacttattttttaaattttgtcatttactgtctcacttcaaagtgaagagatgcatgtacttcctgagatgcagataggtacatggctgtgattcttagtacattccgtaaaagttcacgtgcatatcctcttcctgacatttacagtgcctctccaataatatcagttcatgagggccagacggggggaagaatgagaaatgcgtctgcctttctagccaaggctgggttcaccccaaaggaaaagaaagcacacagaatgagaacagggctctggcatgagtgattttagagtttggcaaatatcatttatttgactgatttacattcagtgctttagttttgacagagaaaagataatagacatatttgtattttgaaaggtttaattatcaaaactcaggtgccaacataaaatctcaataggctacgactttataattatctcctaatattgatataaaacaagattaagaatgttagtttcctgtgtgtcagtcacttcaccaattcctgctgataatcattcgcaccttccatcctcaaactcaccaacaaggattggagagaaatttatttctcaggctaaaaacagtgttgttttggagcttttttgtattagcttgcaagagccaattgttaaattttcaggaattttggaagcccatggatatcacattgagtgtgaaatcagccatggagaatttataccatggaaacttgcaaatgctacaaatcaggatgttctttttccttgctctggagaatcgggtgttaaacacttactggcacactactggttatggataacaaagaaaatgaaaattaattttcttctcttgcctatctccaaaagaggctgcagggtctgacaagttctgctatgaaaagctgaatacagaaggcactgagaagggaaactgcgggaaggatggagaccggtggattcagtgcagcaaacagtgagtggtcagctctaagggcatagtcactggacttggaagcccttcttatgcaagtgcaaaatgagcacaaaataaatgctaatgatttttttctaagtgttcaccattccaaaatttaaagtatttatttttaataggtattattatatctagaggcaaatggctatagattaaactgttactatgctacagattcatgccattttcacaaaattcagaaaatttctcaggtgccacattttacttcatttttgttctgacgagatactttgccagagcattacaaattaatactagcttttaattttctacttttactagaatatatggcctatgagtgtagtagtatacatgtagtttaaatgcaaactatatagaccgtatatatttttgcgaccaacgtgaaatcttactgtgttttttatcatttcacaagtgtagtaacatttgatttaatcagatatctaatatctacaccagagattttttttcccttccaaaaagcatctagttagtacatattaaagccatctttactcaggaaatgagatgctttcagagcacattgatatttctttctccctttcttttttttttcgagactgagtctcgctttatcacccaggctggagtacagtggcatgatctcagctcactgcgacctccacctcctgggttcaaatgattctcgtgcctcaacctcctgagtagctgggattacaggcatctgccaccatgcccggctactttttgtatttttagtagagatagggtttcaccatgttggccaggctggtattgaactcctggcctcaagtgatccgccctcctcagcctctcaaagtgctgggattatgggcgtgagtcaccacgtccagcctgatatttatttgattagttgaggaaagttagaattctcattaattaggttattaaggttaattgaattactgtggaacaatggaatcattaaggaatagcccaaacctctttccttttccttctaaagcaatgaaaattctcctaattttgaagcagagcaagaatttaagggaagctttattctcagttaatgatctctgctatattttacaaaactttgcatttccatttagtctttgatgatggatgaggccacagtaggcaacaaatctttgactataatttttaaaaaattaaaccaaaataatagagaacagagcttcttatctgatgtctcataagtgaagcacagatgttccaaggtgttgatcctcagtcctcgaggtgtcaggggataggagcaaggggagcctgaagtagtcaaaatccatgggattggacatcttgaatttgattagctttattcattcactccatgtcctagagaatctgattatctctctgtgtctcatgacctcaaaaagtttgagaggcattggattagattattgtaaaggatagcttttgagtatctggtaatagaatacccaatccccaataagttaagggaaattaatgtgtttgaaacttgaaaaaatcatgaaatatatgaccagacacgatggcttatgcctgtaatcccagcacttagggaggctgaggcgagtggatcgcttgagtccaggagttcaagaccagtctggacaacatagtgagtcctcatctctattttttttttaagttgtgaaatgtataaacataaaaataaataacaaataaatatacattttaccaaataattatgaagtgaactcccatgtcactcctacatgggtcaagaaataaaacattgcagcatcccagaaatagtgcagataccttcatcctgacttttgtggcagtcactttcttgcttttctttagagttttactgcctgttttcatccctaatgcttcatgtattattttgtattttgcttctcaagtccagcattttaagagttttctgtggtgtgtatagctgtctgttgttcatttttattatttatttgtttcacttttataaatgcacaaatgaatgaatatactatactttagttctccattctgtgttgatgaacatttagtttgttttcattttttggctgttaggaaccatgctgctatgaatattcttgtatatgtaacctagtgcacatttgtacctctttctgtaaggcctgtacataagtagaaaatttgctaagtcataggggatcttatcattgttaccaaataatgtcagactgttttctaaaatggctgaactagtaaattctaccatcagtattatgtatataagaattttattgtaccatatttcaccaacacttggtattatcagactttttgcttttatctgttctggtgggtgtgacctgctatattagcatggttttaatttgcatttccccagattacaagtggaatctagcacatttttgtacatttgttggacatggatttcctttttttgtgatgtgccacttcaattctttgcccattttttaggagtcattgtttacttaacagatagactggaggtagaggtcctcatggtgcatgaatttaacaaggtcaccaaagacccagataatttctgcccctccatcctgtaacccttagcatgttgattttttgtccttatgctttgtgaactcatgattgtaaagtggatacaaaagctacacattcaaaggtaggaagtaaggataggagcaaaaggtcttctccctgtcagtctctaaccttttatccagaaaacaaaatcctcccagccactccctagccagcttctcctcacatcttcacagcccaggggccacttttaactctaggaagacgagaagggggaatggataggaaagtgggcgtcgagaatgggagtaccaagaatagatgagacagcagtcatgatccacctttcagggctgggcactttgctgttccaaacaaaactgtgatcctcttagcaaagaaggaggaggttatcacctaccaatgatatatgatcaaatgtttttgtttagaaagaaagataatattttaaaaatttgaatcaatgtggaccgaatcgttttgattttttgagcttgattcctcctgtctggtctgtttgttttctttacacatgttcagtgatgtgttctgtggattcttactctgtaccaatcttactcgagctccacgtattggtcaacttcagggtgagatcattccaacttccttctaccatcaaggccgggtgattgactgcaggtaacatattaaatattagaagacctaataagccatgagaattacaaatttcacaaaatgaaatttcaaaaaaatcagaaatcaaagatttttctagtttttacaagaggaaagttaatttagattttattatcacctttcatattgacagtcacttaaaaagaaacaaagttgtatattgacttgcagcttacatttgctcaaaattatactagttagtagtaatatggccttctttgtcatcataattttaggagtagaattatggtgttcattctaacccattattaaagttttaagcattagagtatgccactattttgaacactgtgtgtgtatttattttgtgactgaaaagaaaaagaatttaagctatagtttatgaagtgtatgtctggtttggaagatggcttaacaaatacctaatcatatatagaaaatatttattaaaatagtatgtataccgataagcaaacatttgatatccagttgtctgtgagtacaaggcatgtagatatgaggcttatttttgtttagtcggggagtcatattatattccaaataggtattgttcccttcaaagtagttataattcgaagatactattctcttactcaatggtattgttgttgctcaaaacacttttgggcttccccctgcagaattgccttcagcgtctgcaaacttttacttttagtatccttagagtaccatatcttcaccttaagtgaggtaatataagatttgggattatccaaaagtaattttagtaaattcattgggtactaaattggctaatgctgtctcagtcaaatggttacttttttttttcttgcttttaaatggctctgaagacaattctaacagggtcttagtaagatccctcctggaataaatttgtagtctctaaagctagttactttgacgtatacaagctttatttgaatgtgtgttttcatgcctttagataaaatagccttgttaaattatattgttgtatatactaaactagcatatttgttaaatattcagcaagatattctattagtgactatagcattatcattcaaattcaaattatacctaactttgaaattttagaagtaagcactaaaacacatgaaataatcttatgaaaccactgtcatatatgtggtctgtcattgactgaaattttttacacaatggtaagtacttgcctatctgaacgtatctaaacatagaaaagtcatactgccccttttctatgtttagatacgtttagataggcaagtacttaccattgtgttataattgcccacagtttgcagtacagtataatatgctatacagaagtgtagcccaggagcaatagactagaccatctagcagtgtaggtgtatagtaggctataccatccaagtttgtgtaagctcattctatgacatttgcacaaagacaaaattgactaatgacacaattcttagaatattatccccatcattaagctaggcatgtctgtaaatatcaatagaaaataactgatttgtttatgtttttcaattatggataatcagatcttctgaagtaagaataataattttcaaaatatttttcatttgctgtttttgttcatcgtctgcttttttctaccatgctacatctgaaagccttggagagctaatgatatatttgcttcttttgttctcatatagatacttctctcctttagtcttaatgttgggtcttgaaaacacgtgaagatttagaatatactttgtgcaaatgacatttttcttgttgatgtgtactgtaataatgataatgaaagagtgtttctttttcatgctcttttattaaggaaaggtagggaaaggggaagaagaagaggagtaagaaaatgctaggagaaatccacatccactgacagcctcttcggttttgtgaagagcaagcctcattcatggaatgatgttctaagtgtggtgcaaatagttatatgggtatctttcttgttttagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtaagtaggtatcaatgtgacagctggaaccttcatggtctggcatggtcacagtgactggactttaatttcagccattctcctagccaacatggtgaaacaccatctctactaaaaatgcaaaaaatagctgggcgtggtggtgggcacctgtagtcccagctactcaggaggcttttgcagaagaatcgcttgaacccaggaggcagaggttgcagtgagccgagattgagccactgcactccagcctggcgacagagcgagactccatctcaacaacaacaacaacaaaaaaggccaaattcagccttgttaatcacaatcatggtattagaatatttcagattaaaaagcttccttgtttgattttatcatctctgaatgtgtttctcagggagataagggtttaaacactcctgtctctagtttgctcattgttatttatttcctctagattacagttccattccagcatgctggtgggtccctggagaaacagggaggagacagagatcactctggggtcctcagcttggctgactgagaaaagagggttaccaaggactaggggtgtgggggtgtggtgggggggaatccttgttgggcagggaaagtgccaccaagtgagtttggtgttggacgtggtaacggtgaggtcatacaaggcactggtgatttatgtctcctggccttttatctccagcagtgcttttgagcccactgtctattaatttattgaagtaagtgtatatgtttttaaagtgggttcctagaaacagttacttctgaacaaagtagaaaaaagtatcttatcagacatttgtatacttatgtaatatcatgattcaatttaatttaagaataacatgaataattcaatttaagaataataataaataataagataaataattgaagaatttcttccttttactctttttctttaattaatgggaaaaaatgttacacaatttgatctatgcattattaccttgtgtctagtgatcaagaccatgggaaactttaaaaagaaattccaaatagcttttaaagcttcctccctgcccccgtgtctcttttacatttatcactattattctacaaaatacagtgaaaatgccatatctgttcctttttcttcacaggtgtgtagtaatgaagccacctgcatttgtgatttcacctgggcagggacagattgcagtatccgggatccagttaggaaccttcacccccccaaggatgaaggacccaagggtttgtgtgattttggtttcaattcatggaatactgaattcgttgacactgttccaatgcaccagtataacattctaattgacttaagaggagacacataagaatatctgtttttgcctttaaagtatataatttatgttactgccaaattaaggattctgatatatcatatttttaaaatgtgtttgaattacttcttagtctagaactgagattgggaagaagtaaatatacacattttctttaatacagtattctttttctctttaaaccttattctctttctgtagtcacaaattattttgcagttcgtctaagctatgccatttttctaatagatcaaatctttttggctgacatgaggctctggttacttttcaatgttggaatctctccggaaggaagttgtcaccttacaagctctttttgaacattcttttgactaggaaggagttggaattcttcatagaactttcattcttcaaagaaaatgtgagagatctggacctttgttttaatcagtcattaagaggagagaaattagaattttgggattagaaagagactcaggggccacctaggaccactctctattttcgcagatgagaaggcccagaccctgaggtcaggtcacttactatagtcacccaggtagtgagagacaaggccaggatcaggacctaagtcctaagtgcctgatctcagactcttgttctcttcccatccattatatcatcttttttttttttttttttttttttttgagacaggatcttgctctgtcacccaggtaagagtgtagtggcacaatcatggctcactgaagcctcaaactgcaaggcccaagaatcctgccaccatgcctggctaattttttattttttgtagagacaaggtgtcactatgttgtccaggctggtcttgaactcctggcctcaagtgatcctcccgccttggcctctcaaagttctgggattataggtgtgaaccactgcacccgcccctcttacatcatctttttttttttttttttttgagacagagtccgactctgtcgaccaggctggagtgcagcggtgtgatcttggctcatcgtaacctctgctgcctgggttcaagagattctcctgcctcagcctcctgagtagctgggattacaggcacctgccactgcgcctggctaatttttgtatttttagtggagatggggtttcatcatcttggccaggctggtcttgaactcatgacctcataatccacccaccttggctgggattacaggtgtgagctaccgcgcctggcctcttacatcatcttataatgtagtctgtgttatcaggagtatggtaatcatttttcattattctcccgattctcaacccctcatacaattttcaaagatctagaaaacccatcagtcacaaacaggcctactacagcatctgttacattgtacctaagaaaccaaggaaatactagaaccagtttttatatacagggatgacgttgtacatcagcttctttatcatggtactgctaacagtttttttgtaactgccgtgcttttctctgacaggtaggaaaatgcatataggattagtaccatttagatcagcttagttttggatgaaagtttattgaaactctctgaacttcagtatagtttatatgggaaaagatgatttcagatgcagatgaagctctgtagtcctcaattcctgaagagatttaggctgattcaggcgcatgtgaattgttcagtaatagtgggtgtgttaaaacacattttatgcatttgcttaatatgcccatgatattaaaattctgtaagaatcataatcacaccctcacagtctatttctgttctccttcttctatttctaaaagggaacgtattccacttttacacttagtcttttgttactttaaaactagaacaaaaaattcttggatccaccttctgaagttagatttagagaagatttaagctctaacaagagaagccaaggttcattctttccaaattttctctccacagtgtttctgtgattttttttttaagatctagatgctatttcctcaagtgatgtataaagatgcctcaacggatgagcagagctaaatttacttagactctgcctttttttctttaagtagagtagggggttattaattgtctggttctgtaatatctattccctgttccttcacccacccatgcctaaaaatctttggaggcattaagtaaagaaagtcacattctagagaaagagtactcacagctgccttttgttttgttttgctttactctctccatttaatgtggtagtatcccacactacctttaaaaaaaaataacttttttgatccttcaagtaatacatacttattgtagaaaaatttgaaaatacggaaaatattaaaactcagaggtgctcaagataagccttattgggcctggctcagtggttcgcgcctgtaatcccaagactttgggaggccgagggcaggtggatcatctgaggtcaggagttcgagaccagcctggccaacatggtgaaaccccatccctactaaaaatacaaaaattagccagacacgatggcacatgcctataatcccagctacttgggaggctgaggcacgagaattgcttgaacccaggagacagaggttgcagtgagccaagatcgtgccactgtactccagcctgggtgatagagtgagacactgagccccctactcatcccccaaaaaagaggccaggcacggtggcttacacctgttatcccagcactttgggaggcccaggcaggcggatcacctggggtcaggagtttgagaccagcctggccaacatggtgaaaacccatctctactaaaaatacaaaaattagccgggcatggtggtgcgtgcctgtagtaccagatactggggaggctgaggtaggagaatcgcttgaacccaggaggtggaggttacagtgagccgagatcgtgccattgtactccagcctgggtaacagagcgagattccatctcaaaaaaaaaaaaaaaaagagataagcattctggtatgcttctttcctgttgcatttttctttttccatttttaatgaagacaatggagtcattgcaaagttatctattggttctaaaattattaaaaaccttatgaatctctaataattttgattaaattgaaaatgtcattaaatgaaataaatgacctagttatttttataaatatttacatttccagaaaattcaagcaattttagtacaagtaaataatagcttttatctgtaatagctatctatatctttttaacctctatttaaaaaatctattaatatactggtaaaacagaaactaaaaaattttaaaactctgttgtagattttattattttgtttttgattgtcaggttaaaagaagattccaagtgagaaattatgtgcttttcgttttattcagttagcaaatatttattgactgtctactatttaaaagatagcgtatgcttggcacacagacactccataaatattacactcttctcttttgaaatatgcaaaggaaatgagatggtgcatgctagtgccacttttcagtttatccatattcatttgttttgttgccttgccgacgagtaataggtaatggactcaagttattaaaacaatcagtgttttacttactgtaggctcagcagtgtgtgagacactaagatttttctcaaaaaatgcatgttgtggccgggcacggtggctcacgcctgtaatcccagcactttgggaggccaaggcgggcggatcacaaggtcaggagatcgagaccatcctggctaacacagtgaagcctcgtctctactaaaaatacaaaaaaattagttgggcgtggtggcaggcacctgtagtcccagctactcgggaggctgaggcaggagaatggcgtgaacctgggaggcagagcttgcagtgagctgagatcgcgacactgcactccaacctgggcaacagagtgagacactgtctcaggaaaaaaaaccaaaaactgcatgttgtatcttttttctcatgatccaactggtttggttggcacctgcctgattgagcacagtgtttgggccctccccaaatgcttgccatttataatgggcaccacccacagtggccaatcatatccatagatgaaggttttctgtataggtgcagtaagagtattaaaaatacttagttttatttaatttcaatgtgcttccattatatagagaaaaaaattcaagaaacataatgaaaatatggcctttttaaaaatcatgaacatgggcataaaagataaattgtacccaactgccctttggatcaagaccaaattagtaaaaatgaaggcgaattctatgactccgtcttcactgatttgagaatgtcagaaatgaactgatgtgttttgtgtatttcttttattttaactataagttcctggaagaataggaaattcaacctctcctgtgtgaggactgaaagcatacctgaaagcattgccactgtagtcaccctgtacttactacagttgtccactatggacccataatttaaggcatgctagattattcacgccaacttctcaaaccaaactattgaaagacaagaaataagatctcaaagcacaaaccatgtgagcaaggattttttaaaaaagatttttgtcacattatttattttttctacgttgttcatttcacatgcaaaaaccctttcttaagtttatttttaattttttatattttttaagcctagtccttctctcaacttgtttccactgaaatcattatagaaaattattttgctttgttctacaaggacagaatgtattttaactctgtttaaaagacctagaattctctcctgttacagggagacccacatcaagtaccccaattattgtctgtatgtagacacattctcaaggtgcttactatagaatacagtggaacttttctcatttgatagtttacatcaccattgtaagaaggaagagaaactgggacataggtaatgttttcagtgatatgtatgggcagatattcctgggaagctttggtcagaccttttcatcacaaccacactcatcaaatcagaaatgaaaagggccttagaaagaattcagtctagaccccttgttttacaaatgaagaaactaagttagttttcagggttaacaaagagtgagaggcagagccaataatataacataatcaccttatcttgagccaaatgcttttttctgttattccatactcctgttttgaagttgaatagtgaggctaggcacagtggctcacgcctgtgatcccaacactttaggaagctgaggtgggcaaattgcctgagcccaggagttccagaccagcctgagcaacatggaaaaaccccgtctatataaaaaaataaaaaaattagccagttgtggtggcatgtgcccatagtcccagctacttgggaggctgaagtgggaggatcacctaatcccatgaggcagaggttgcagtgagccaagatcacaccactgcactccagcctgagcaagagagtaagacccttctcaaaaaaaaaaaaaaaaagctgaatattaagttattctgctagttctcatagcacaatagtaaacagaaagtgaaacaataaccaggtagtaatcaagcttattaactgatccattattgtcagtgatgctttttatggaattagataagaaaggaagtattatattattatcatttagtatttttaaaataatagttttgaagtcttattttctgaggtattaaccttgaggagtatttagtgtttacatttaccttttgcaatatatccttttggtgactgtcttcgtcagtgcacaaatctttgattttatagtttagatgattagatatgagaagttatccttatcatatatgattatgctcatgtataattatgtgctacctggatatttttctcaaataacaatggccttatcaataacccaaggatatatcaagtttaaaaattttttaataactgaatttattttgtttcagttcagaaaaaccctattttcattgacagcataaactgaaatatattcttacatgaaatcatttattttgcatccttttagacatttgtccatgtatctaaaaatgaacttgtttttttcttttatggaaaacagtaaggagatctgattgtatgtataatgtattgaaatatggagctacataccaatattatacactagtatataaagagtttatttagtatttacttttcttgtcttgaatggtagtggaataataaatccctgaagaaagcactttggtccatggaatacaaatgatgactttgatgcctcctgcctgtgaagtatcaaaagatacaggattttaaccccctttggaatcacttgggggaaataatgcatcttcttatttgagaaactctctaaaaataaggaaaaaaacccactcaatttcaaaacagcacattttcaaaatgtctgaagcatgacatgtctataaaggaattctacatataaaatagaaaatcttaagaaaaggagaaaatttatagtttttgatattttatacttaccaaaaattctgtcttttagcacaagtaaacctaggtagcagggaccaagactgaaaataataataaaccaacaagtaatggaaataagcaagtaaacaaaaatgaaaacattctgctaggtaataaacagattccacaaacacattatactgaaaagtaagtgtatcaaagagttagggagcaaagttaagttcctaataaaaggattgtgttgtcagctagaagctttaagcgttccatctccaggtttggtaggatgagaaggaaaataagatatatcatcgtgtgtccagcatagttccttgaacaaaaaaaaaggtatttagtaggtaatgaatgaattaatgaataaattacagaatagataaattagtgtagaagtagaatttttttcaatgagatgataaattctttgtagctatgaaaagcagctgcaacctttgttttcaaatatgtcccctataaaaatccacccacccgtgagctactcagttaatttatgtcaaggtgatgcacaagttcctacttgccaaaacaaagttcagcactctctaaaggaagagaacaaaagcaaagcagaatcgacaaaaagaaaatcttcacatctttaagagacaaccatgttcagtacaatgacaaagaatcaaatggcactttacatgtatttgcaggatactgtgtcactcaaagtaatgggagggagagagaacagggagggtagggatgcttttgaaaaagctttttttcccacttttaacttgctttagcgttaagagtacttaccagctaataatgtggaggaaattattctttctcattggagattacagaatatatctattcatcttgaatacccacttgaagcctctgtagaaatgtctcgtcctccggttgtatttctaaaacctacatgattttgtcttgtttctgcagtgagaaattacatccatagcaaagacaaaagtctttttaaattatttttatttatctttcatatagttcttacaatttctaaaaaattaacactcatttagtatcacaatttatgggagagggttttttgtatttttaagcatatgtggcttatataaaaattgcagaagtcataggactgtcatgtattgcagctctgagaaccaatgcctgaaacttaagccaaaaaaaaaaaaaaaaagttatgaccaggcacggtggcctcatgcctgtaatcccagcactttgggaggccgaggcaggcagaccacgaggtcaggagttcgagaccagcctggccaatatggtgaaaccctgtctctaactaaaaatacaaaaattagccgggtgtggtggtgcgcacctgtagtcccagctacttgggagggtgaggcagaagaattgcttgaacccgggaggcagaggttgcagtgagctgagatcatgccactgcactccagcctgggcgacagagcgagactccatctcaaaaaaaagaaaaaagaaaaaaaagttataaaataatgtatatcagttaatttagtattctgaaagcaagggttttctaaggtctttttaaaaatgaggcttcatattttgaatacctttcagtcccagtgtttgcctccataacttgaaaatcggagtagttcaggtggttttgagttctaatgtattgtcatagtggggaaacattgctgccaccttctgtgttggtcttcttcccttagccttcaacactctcgggggacttttctgttctctgttgtgtccccatctttttgtttgtttgttttttaagaaaccaggttgtgcttagtcaatgataaaactagaatttctccctcacattattatcttgtgataagataaagcagtatacagttaattaacagggttagaaatccaagattctttctcttcctctgggaaaatatttagctaaaaatgtcagtgagcccaattgtaagccttaaaaaatggtggctttgagtcgtggatctttgtttcgtttcactgtctcagagcacacaatacatgtgaagggcagccttgttgaagctaatctctgttttcatgggaaaggtaatttgaagccagtccttttgattcctatagaaatatgaaataaagtgtatgtatgtccacacacttgtgtgcacacaggcacagacacacaactgcaaacaatgtgtcttccaactttaacaccaaacttcattttgcctttgtagcgggaaccttggggacctccactcattccaggcccattttccaggattggaaagctgtacacagagaagcagtgacataaagttattcagattctcactctgatagtcatctaccacttggtggtctgaagcaattaatacggtttcccagagaccctaactttctataagtttatccacttgagactactaataaacaaaaaacaaaatgtctaaatactatgacagaaatccaaatattgcagacttatctgaaatacgcttttcaataacttcccaggtaaacatgtatttacttttaaagctattctgtcttgaatttgtaaggatctttgcaaaactgaatgatatattctgaattttgaaaagatgtagcttcttaggcatattttacagtttgagaattttataaacaattactaatggttcattacttttgtaattaaaatacagatttgctgttatgcaatttaaattactttttaattttacctcacatctggtaggaactataacaaattgaattatttatgtatttataagtacgtataagataattatgttttttaaaagtagggtgtgcagaatttgaaggtaaattcacagttatcctcaaatatcttcaatgtgtatgtagatcttaatttcaaatcttatagcaaaaaaattcaatatttagccaactttcaaagcatgtcctgaatagattattttgtatgttagtgaaattagtatgtaatttcctttgttaaaaaatctccattttccctccacacagtgaatatggccacaagcaggctaataggggccgtggccggcaccattctggccctgggggtgatttttggaggcacagggtggggaatagagtaagcatccttgccagtttcagagtgtttctgtgtggtgcctgatgtgtgaggcgatgcctgtacctgactccatgtctcgtcctgttgaccgtgtttcctgtggtagtgcaccttgtggtgtgacttggatgttgcttgtgtcctgtggttttcttgtgtcatgtagaaccttctcctgtctggaacaatgtggggcataacataacactgggtgtgcttccgatatcttcataattaaggcaatagtcccaacacttccattgctcctccactttgtagaagtaattttaaaatacagacttttttttaaaccatttattggcaaaaatgcttttatatgtgtgttttcttaggattcttgtaataaagttaatctgtgccagtcaaataaatttacatatataactagcaattatcaacagttataggaccttttaaaggtaataaaaatgatagctactaatgttttcttcatttatttagaatgatataggaggctgcagcttaattttttaaaaagaagatatttagcatactgccttcctatttttcctataaaataggttaataattcaaaattgaagtctacataaatatttggaagcaaggagcattaagaatgaaaaaatatttaatccaaacctgtataaccataagtgaacagctgcaaatcacctggtgggttcgtcttaaaagtagccagggtgtaaataaatatattgtgtgccacttgcccattaagctgtcacagaaatacagttctcctgatgctttgatttagggtgctctgtacttgatccacatcctcagaatagctgtcagttctccagggcacattgcttcctgagattgctaatctgtagattaaaatattatcatgatttttttcttctctctctaattagaaaaagaatatttaagaatggcagacataaccctttacacagtcttttctgtctactgtggtggtggtggtaacacttcaaagtggcccaggaatgaattactagtatcttcaggaatcactagatatctttgactcacccatcccaaatcatgggcttattgtgaatatcagatatgtttttctatagtcccattagttagaacaaatgggtgctcctcttacacactggaattgggagacccggggaccaaaatagcattaagagggaagcaggttcatagttcacaccttgtgttgaagatgacatgagccttctttctcctggattcaaggactttgaccagacttagatcttccaactcacatctcatctctatggactgtgaagctggttagcacaggggaagctagaaatactagaaaagagattttgtttctccttgtgtattagaaaacaaagaccataacagggataaaaatatttagagacaaaaactttgtcctgtaaaatttccccttggatctgttgactggattgtatacagaagaaacattcctttttcagggccagctccatgcatgcatttatgtgaaattcctccttgacaaatggtagttttctgaaaatcatcccaaatgcattttttaacattatacattggctgtaactttggtgtccttaaatgtactaattgaaaggatgaattttaataatccttccttgaagtcttagagataggtaaaaatcaaagaggcctttcttgtaaaacatagtccttgttatcagcatttgttttcatcaatcatttccagttttgttcgtttgtgactatttctaattgtgacaggtaagtctgtgtaagtgtatgtatattttttctaaagatagatttgttattattcctggtttatgagcactagttttctcttagcttactgatttttttccccatcaaattccaagttttagcataattgctcaagaaatatagttttttaaaaaataatgtagtacaatatagattgtctcaacatttcttagtttaattgatagagtaatgttcattcagtcactaagaattccatggacagttttttttttaatttctccttagtttataagtcaggaatcatttttcatgaattatgtgttgattctaatcctagcctgttttctgaagcggacgaagtgcaaatcatatccaaagcatagagtatgtacatggttatatatttttttaatatttgttttgaaatttgattctctgttgaattgtggggaggaaatacatgtaagtagaataaagtttctctaaaacagaagttagcaaacttctgtaaaaggccagatggtaaatagttttagctttcagcctacagggttgtctgtaacaacttctcaacaatgctgtcttagcatgaaagcagccataaacaatatgtaaatgaatgtgcatggctatgttccgataaaacttttttgcaaaagcagacagtggggctagatttggtctgtgggctccagtttcctgacccttgacttataggatatgttttagggtcagacaaatctgtgttcacatcttgccgctatcactcacaaacttctagaagcctgtttcctcatccattaaacaaggatagtcatagttcccacctcatacgatttttgtaaagatcaaaagagatactatatgtcaagtgttcagtactgtgtccagcacatagtaagtgcacaatacggtagctgtttaaactatttttatggctctcattattattattattattattggtgtatctctaaaggcaactgagattcgttctctagacggtcagtggttagtcttaagagcatgtcacaagcccaggagcctaaagagacctgcaccccgagactgtattgcagctgtcctctacctgcccaccaagcactggatggtctccgaataaaaacacattatgcatgcaatttgtgtgctgccaaaagtggcatccatttatgtacacagttgagggcactgatgtgagcagaaaagagaattttttacacagaaatgaatgtttacacaaaactcaaggattttcgggaaactagcaacattggctttgtgattcctggagcagggatagataggactgaaagtattttgttgttaggggacactgtacctgcatgttagcatcctgaaggatgggatatgtaaagtaattattatactaggtttaacgttgcttagattttaaaatgctaagcttaaggagaggagtgagcgagtggacaggagttactaggatatggattagctcttacccttagcaattgatagaaatgccaccttgtcttttctttcttactgtcctttggctctctgcttttttatatctctaagcctgaaagttctgttagtaacaatgggaactttaaagctattctcagttgaatctaaggaatctttttaccatttccccaaaattacccaaatgagatttatgcttccttatatcttgcctttggaaccccattttggtctttaccactgtaaggatagtgaagaagtgtatctttgagagcaaggcttcaaaagtcagatctgtattgacttccttctgactgctaagttttaactgtttccaagtggggaattaaaaagttagcattcagaccacttttaggtgctttttggaagggcattgtagcagaatgtgtttcctttcctccatgcccccatttgtgagtcagatggagcttgtctgaatgcgatggtgttctctctgtgcttttacttatttgatacatgatactgggagaggggaagagaagaaggatgtgtaaagacagcaagtggggcctatttgcttcaaattctgtgaaaggtgaatttaatggaacttaattgtcaatggtgcagaaactttagatttaaaggcatataaatccaagcaacgctcaccgtagcatctaaaatgcaattaagctaagtaaataaaggcaatttaaatgtttagccgtcttttacacaggatatttacttcctgaaactgcttaactgcctttcccttgtggtaacgaaagtggttggttcatatgactctcttcccatgatcctttgtcacaggtcctagtgccaccaatctcataataggctccatcgctggtgccatcctggtagcagctattgtccttgggggcacaggctggggatttaagtaagcaacgccgcatgtcttcttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcaggcaagtggaaatgtagaaggaattcatatacactgatttttaaggagaacaacgaagttctttggtagaagacagtccagcttgtaagagcaggcactctgagatacattcatttctacacaggaaatcgaggaaaccatgtagttggaaataagtggatgtaaattgcttgtatctgtttaaaacttgtttgtagtccactgatattttgaaattttcacaacctaagtaattatgcaatcattacttgtatttttcatatgtaacatagtatatgtagctttgtgatttgaaaagctttatagtttaatgaaaacagattttaaaagtatttgtataatcctcgaccaactgaattggttttaaatcagaatttgaaaaatgtggctttgtgacacttagtattttctaatcaaggactaaatattgacctgacaggtaggcctggtgtgttttcatagtgaccttttagtttggattgcacactgcttactgaactaagattgtttaaatagacacactgggtattcacaaataaacttcaattgtgatcaaaatttttaaagctgatttatccaggctggctatttctacactccagaatcattggataattgctttttataccttttcatgctatagtgagttgatgattatgatttgtaggtaagccctcctgtgcctcctgtgataaattttcagccagattcacagaaacaaatttaagtgggaaataagaccattacccaaattcaaaacccactttgcctgcatctggttactcaaaagaggaagcttttgccctgaactatctgaataattgccttaattataaactttatatgttttatatttgggattttgaattcaatatgtttcagccagttaaagtgttatttttagaagctgattaaagaaaccaaagatgatttaaatacattcaacattttctgctaatttgttatcatattaagatttattgagtaagtctacagttttggagtgcctttaacttgaaatagtattataaaattatacgtcttttctctcggtatatttgtagagttgaacttgtttagtaatgtagtcttggcatcagtgtgttttcaaaaacacactcataaaatggacaactcatatttaaatttattgttttggtattaataaaatattgcccacatagtgagtcacgcatgtggcatctagtaagaaatatgttttcgtttgggcggacctaattcaagcaaaacttttcttagtgttccactgctacaaaaaagtcattgaacattatagtactgccatactcttattattttataatgcttccttgaactttttcattagtatgcctcaagaaaaataaatctggatcatgcccaggcttatgcctcatttggcgttaagaaatcccggtttcaaaggcctggaaaacagtctattacacgtctttgccgtctagccatatgcaatgccaaatttatcattgcagtgtttcgagagaagagcacactattctgtagcaggacctcaaaacagtggcctggcctagctcacagcttgaattgcatgtttctttggggaaaaatggaaaagcctttatcactgtgtatataagtggattaggccctgtaaagattctttatatctgagagagagagagatctcgttatcacaagaacagaaaacaaaaggtgggggatcagcacttagtgagatgagaaacagcctttgctgactgctgcctggttgttgctgtgtagggacctgtactgctgagctgagtcaaagccccttcctgtgccctgtaactctgataatcactttcagggagaactgtgtagaaagacacacaatagggtgaagtatttcatgccccgaagcaaagaaaacgatgaagactaagaataattccagaacatgtaacttcaggagtttaaatttggagaatgtgctactcctgggtgactgttggttgctacatgaggaccttaatttgctttagattttagtagtaactgtgtggtttgtgttcagctttaaataacacttctaccttgtaataaaaggcttttggtgctgaatgataatgtttagattttcccaccacttggacagttctggagattactagtctggagataattcgtaagtataattatttgctatttgaactgaaagcctttgggtttgagttcaatgtaaatgtttaaaaagaaattcctttagaatcagaagttgaaaatagtttgtacaaaagattgttctaaatgctgctattgggaatccctcctgataccaggtttttatttctagaagaaaagttggtaaggtaacctgaacaatttgagggcatgtcaactttttgattaaaggaaaatacagtaactactcagggaaaatactatattttcctaatgtcacatttctttaggtgtactagtgagtagtttagatgtagaagtatcatactatacgtgacctgcccaagtataaatgagaaatacagctatgctctaagccctgaccttgtctgccattctttaaagttctttccttaaactattatttcctctgaaataggtggtaaaaagcatgaaaatgtgtgcatgtatgtgaatgtgtgcacatttgtgtgtgtgaagtgataataaagatgtatcaagattattataatctgaaaataatactgatttaaattacatacttccttttagtagattagttgagtcagaccgctttggttaatgcaagcaagacttccacaagcaaggttgtggatttcctgaagaatttttaaatgttttatttggtagatttttaaaaaatattgtcacatattgtgtaatgttatgggtagtaactttgcttaatttctttttctttttttttgagacagagttttgcttttattgcccaggctggagtgcagtggcatgatctcagttcaccgcaacctccgcctcccaggttcaggcgattctcctgcctcagcctcctgagcagctgggattacaggcatgcgccaccacgcccagctaattttgtatttttagcagagatggggtttctccacgttggccaggcaggtctggaacttccaacctcaggtgatccgccagactcggcctcccaaagtgttgggattacaggcatgagccactgtgcccagccaactttgcttaatttcatactccagaagtatgaggttactaagggtatgattagtcgtagagtcccaggtattgagggtcttaggaatttctctatgaaatcctgtgaaaaacgaacataggcatgtggcacaccaatttgctctacttctatatctgcatttattttcattcaccccatgctcctgttcttccccatcacccacacacaagaataaagttatgagctgtggtgcagaggattgcaaacctctgtcctagttgactcatggagactcatgacacctacccaacattaaatgatgatactgcttgattcgactgttagagctgttgcttttactggacattagaaaaagcaggaccattttagtagcatcttccctaaagcttaggaaaggtgaaaagtatatgaaaagagaatttcatatctccatttaaaagtgaacaggattgtcttcagcaccttaggcgttgctatttatctgatattccctaaatttgaatgtagggttttacatgcacattagtaggtgatggtggtaggaaaagagaaattctaggtgatggtaggaaaagaaatgaaggtaatagtgacatggtttgttgaaaattgaaatcaaaaggactacaggatgaacactgagcttttccagtgataccgtaacacctcagtctgtagaacctcatcaccacgtcttactctcccgctacttgccctgtccatgggattcagtggcaaagtggatttcatcagtggccatactggcctggcatagctactccttacattaaaagtgttaatttaatattaataagtctgtgtaattatcatacgtgattccttctctctgagaagttatttgtgttaaaagctcttctgagcctgactctggatttaagagattctgtctggcctacgttccattttattggacatgttaaagaaaaggctgtttatgtactcacacaaaatgaaaaagagctatatctagactattaccagcaaagttaagagttatctgaagctgggcatggtggctcatgcctgtaatcccaggctgaggtggacagatcgcctgaggacaggagttcgagaccagactggccaacatggtgaaaccctgtctctactaaaaatacaaaaattaaccgggcatggtggtgcacgcctgtaatcccagctactcgggaggcagagacagaatcccttgaacccgggagacggaggttgcagtgagccgagactgcgccattgcactccagcctgggcaacaagaacaaaactctgtctcaaaaaaaaaaagagttatctgaatgtcaagtcagataaaatttgaaaggaacttaatattgttaattatattttctcaaaagagtaaacaccattttttgtgggggccttttgatttttattgaattaggaaattgaattaaatttggctagtctttccacgaggaggataaccagactgctgtttttttgaattccatgactgtatcccagttcaaaatgagaagcctgattcccttaatgcctgggactcctgggttaggcactttctctttcatggtaccaggctggccaggaagatcggtgcatttccctgccccagcgccccagggaagtgagctcagtgtatggtggcctaggaggggttgggctagggacacttcgtcagggggtgactcagcatagaatgataagaatgtgctaaccatggataaatatatgcccttgaaagaagaactaaaggctttacggctctgagacggttattgttactgaaagagtcttgctttaattttgtgtagatgttatgtgtataatgtatattgtagacaaaagtccagattatttcagaagtagtaaaaatggatgaaagctgtgaaaatgtaagctttatggattatgctagtgttttataatgatccagaaataccttacaggttatgagaaagttaattaccttcagaatcctagtgagcggagggtattcagaggaaaccgttatgaagaaagtcagcaaggacctgcccgcagtagttgtactttcacattaaaattgaactgaaagaatatttttttcatagagaaaattcagaccgttctcaacatacagtgactgtgatggttttacaatttatgtgtgaggcaccttcacagtccgcttgccacaggagtgttcatctctgtcctcatcgcagtgtggcctcccttgtagaggagctcactttccccctgctgggacatcagtggaagagctaaggtcctggaatgccccattggtgttcagagtccattttcatccagaaagatacagttctgcaggatggctcagcctctctgtctggcctgggaacccagtgatcctgtagagcaatatttctgcaaaaaggtgcaacctaagcttcaaaaaccagcttttaaaaagagcacaagcttttggacaccagcggttgtctgtgtgccaggctgaaatggaatttcctatctccatttaaaagtggactgcattgctgttacgaccttggacatggctacttatcggtcattcccgaatttgaataaaggaatttagatgtgggcaacatgcacagtgctagcttggtttgccctttcctctacatttggatttactgaggaaatttagtttaacatttatcttgagttctagcaatacatagctcacaagattggggcctcttgtccttcagggtcatttcacaaggtcaggcagtctctgtttttcctccctgactcacagagtatggctccttaaacctctaccttccagggatatgaacataggtggcagatggagaccctgtgctctgcagcaaactaacttggtggaggatgcattatgggatacttgccttttggtttcacattggtttcttgggcagcatcagcagtgcccgctttcaagaatgttgacttaaaagagggctgggtgggaatgatgaagaaaagtaaacagcattgttgcagatagtgttggctgcaatggttacctgctaggccaatgagtcacacacttaggtcactcatgaagacgttttaatgtaaactttaaaaagaaaagacaagttttctttaaagacttttatgttgatatttcaaaagagaagcatcaaagtgaccatcttgggaaaaataagaactttgcaggatgcctttatacctattttgagctttggtattgtttttattttgaattacttgtgggggaggaggaatatatcgcaatggctttgatacttagggcctgtaagggtatccagctggccctcagtcggtgggcaggggagtgagggctttggggactcctcagtctccagttttgcatgatgcctcggtggcagtagcgttgcacccgcccagtatgcagactaaatgcatgagccccttgcttgatgccccacataaagccagaccatggggaggttgcaaccaacttttactgttgccttgtagtgtcttgctggttctttcttttctctttaaacataggagccactttttaggagactggacactgtgagcaaagcattttaacttgccgattttcaactaagctaaattctgcatttgcttaactaacctgaacctgtgtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgcccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaatgttgtagctttatgctttaatcatttcttttaaacccccttttctgtttcctcttgtagtgctgattaaatggccatgtgcctgatatcatcagagttttagcatggatccaaaggcttactgaaaatttaagcagtcagtggcacaaaataaaatctctgattaatgataaatatatgcctgattacgattcagttttattggattcattggaattttttgcttcttataaatcagaaaaaaccctaccttaggatcgcttagagattttttttttttagtatctcccttctgagttttaagagtggatggctagtaataacatccacactttggacctggtaccaaatttgtaatcaagcaacaaagaaagtagaaggaaatctggttatataaattgtattataaaaaacattctaaggaaggcatttcttcacagctcccatggaattggtcaccaaattatatcccttcttcatgaatgtcttcaatatgtctcctctccatcccattgccatgccttggtttggccttaacagacacatgtatctcacatatatcgactgcactgacacacagttactaatctcaccacattgatgaaagcattgcagggcttttcatttcctgtaagttaaggctcaaacttaataacacaacgtaaactcctgcccacctctcatgatctcaaacctgtttctttttgtagcctcattgactcatcctcttgtagtcaccttaaaggtcccctagaggaacctcttgtactcaaggcccaacaatcttatttaaatgttacgtccattacccataattcattcgtttccatgtcatttcatgtaataaatatagaaacactttaaaatagcatgaatattatacttaaaattagaaagcttattagagtatttgagtgttgtttatatttgactttaaatgaatgatttgtttttgtgtgtgttttcctttaagtcattctgttcttgaggatgacattgaaatgagttctactccatgcttccttagtaactggctgagaaaggtgacccagaaactccctagataatagagcagcaaacctagagttaaaatttgatgtgaataagtagataatccatatgcttatgctggaattcccaagtaacttttaaaatgtaaaataggtgccctttagtttaatgtgcaaaggttagggagttccattcactcatttattcattcagcatatttattatgtctctatgctatgccaggaactcctaggtactgaaggaacaaaagtaaattcttggcttaaagttgctcacaatttagcaggaagagacatgtttaaaaaaaaaatttctagacccaaggtgatgagtaaacaaagctactcttgtgctgggagtaaaaagaagagcactgatgggcaggtgggcgagggatgcagaagcctttccaaaagaagtgagttttgaactatattgaaacatgacaagaattcaccagtctaacaaaatgggaaacgtattcaaggcacaggaagcaacaagtgcaagacccaggaggaggcacccagacccttgggtaagtagagctaaatgtcccatccattcagcctcagtttcctccctcctccgttctcttctttgtttccttcctacctttctacaacctcttgatctgtaagaatcctacagtagtcaggctccaaggacacatgatgagttcaatcttgtgagcaagatgcaacatgcaatgctatgtggcaagtgccataataaacataaatataagttgcttcagaagaagagaagagcaaggctttgtctctgatcctggagtcaaggagagtttcacagaagaggtggcagttgagcaagaggctgtgcctgtgcaattgggcctaatactgtgatcccttattgtgagatttaaccagggcttgctcgttttggtggtgggactaggggaatccattcataaatgctttgcaagcacaacaacccgtaatgctcagaattgtcctcaccagatctctgagtgtcttttgtttgtgtgaagattatgatctctgttaaaaccttatatttttagacagttttccaccgatgtgctcatgatggatcagtcttaagtgtatgagactgtcagtaatgacaaagagggcttcttgacctgggctgtgaacctctaatattttcttagcataaaaattcctagctaatctcagtctggagtgagggggtgggtaagaagaacaataaaagcttttaaagcatcatttaatatatccttccactaattaggggtcaacatcattttctaagtatagttgagcttctggtgaaccaaaattagcatttgtctatctgctaagctttggagagaaggttatcattcctcaatcttttcagaagcccatccacagctctgactccttgactagaacaagtttttggccatgtatatgacttctggagagaaatgaaatgccttgaatcttcacatgaaaacagatttcctgctgatgctcctttagcagttgattgcatgtgcacacacacgtgtcctggtgtgattgttaaagactgtacttgtggccccatggagtccacccttaggagaacatttatctgactgtgatgattattgaaagccaaactcgccaagtaaagcaattggtcttacaaaaacaaggcaaaacaaaacaaaatctctctgaatgatcaagagtatatgaagagttcttcagatctctttggagctttaaatagcttccagtcttcaggaggtaaatgaggttgcagcagaggttcttgcttctttaggcctataactcagggtaaggacagaaaaaggtaacttggattataaatgacatcagggaggcctctgttttccagcaacagacacagccttgtagagccattgtaactcctatagagatagcaaatggattgtatgcaatagctttaaactgcttttcctatataggtgaaatggctacaaatcaaaggtcacaaatgctaaagtctacaggagccagtcagttaccaaaatgagctgaacagggcaatggaggagacaagggctgagggaggctgaactgagttggagaccgtacaccttgtcctgaagggagcagcctctactcagctccagacaattgtcactatgaggaaaagtggcccagtcattgcccattccatttatttttctagagaagccagaaatccaggcttttatatgaaatttccttttaaaaaattgtaaaactcattcatattttttaaacactgtggatcaagatggtgaaaacagaacctgacgtcacataggattgggtctactggcacctagcggggtagcttctacataagataataggacatttttatgtctgccctctgaaatcagctgatagctccagtgagtatgcagacatggacttgcttccagtcagggttacagggtgccatgtgaaggctcaggcagacgttcttatgaattgccacttacagtgttgacttaactattgttttgtgtggataggaagcagtcactgaaagccacagagtatcaaagagagcctgcctaaagatacttcgtgacggtggtgctttgtgtaataactaagcttactcagatatgctcatttatgggagatgaactaaacctatattggcaaattgaggctcattcctcaaattgaggagcattcctgcattgctcattgaggctttgtctcgatgttcactaaggcagtgtagtggctgcctggatcctgagccagtgattagagaaaatgctgtggttgattttggttgcctgctacctggcaaccagaagtacctgactaggtccgcataaatcttaaaacagtgttcctttctgtcttcgattctcaaggataattggagatggggatgaattagttgatctagctaatccagaggccccacgtaatatactggatccagggaaataaaggattcctgatccaagaaatacagaagctgaaaaatccagcaggaaggaacaactgtttatttttttaattgttgttttctgataattatgaaatcctacatgtttattggagaaaacgtgagaaaaagaaaaatttaaagaagaaaattgaaatcaatatcatcaccactttataatctccattaataatttgtaaatttcttgaactcatcattttcttggtttttcccatgaacacaaaagcagcctacaaagtaggcagccagtagttcttgcagaggatttgtgttgtctcccctgctcgtgtgtgtgtgtgtgtgtgtgtgcacgcgcacgccatgtgccatgttctgctggcttcaaaagagggtgggacagtatgtttagggcaaagaagtactttctagcctcttggtttttggcttaacctgtttatactactaggaagactgcttttgcccaccaaagcccagtcaaattcctatgcatccccaagtgtcacttcaaatatgtactacctccttcgtgaagcctttcctgatctttttaaagctttctagagagctttaaaaagctctctacagagaacatgggagctccagttagtggtagagctgggatgaaatcccaggtattttaggatccagagcccatcctctaattacatcactttattgcccttttttattcccattttatttatttatttatttatttatttatttatttatttattgagacagggtctcaatctggcacccaggcttcagcgcagtggcatgatcatagctcactgcagcctcaaactcctgggctcaagggatcccgccacctcagcttcccgagtagctgggactacagagcacaccaccgtgttatagccaattgtagttgaaaaaattcacaattggagaggtttagcaccttttttgaaatcaccattctagtaagtgccagggtcataatcatgccaccggcagtccgagtttgaatccttttctggacccaagagaacatggaaaatagcacttatggcaccaaaacatgagcagtaggggaggagcagtagatcctcagagagaatctcttgctgcctacttttatgagctgattctgctgggagtgctgctggaaccattatttattgtcaccaccaggagatctgttttggaaagccttaactctctaaatgtaaattctagccttttgttagaacaagagagagtgggtgtgtgtgcacaagacccaagggaaggctgaaaatttgttcgtaggccactccacctgagagggaatatgttaagcagtttgaaatgtctctaggagtcattgtgagaagaaacgggatttttctgttacctctgatgagtgaaacagttttctgttacaaaactgatgagtgaaaagtcacaggaatgccacttcgaatctcatattaaaaagaacttcattcagtcgacaagtagtaaagatatccaccaagtaaaagactctttgctgcacatggtgggtcagaaaatgttatgcccagatatcctaccagatattacagcttggtaaaagggctaaggaatagggaaagaatttcatttatgatgaaagtgtcacccttggtaaggaaaatacaaataaataattatgaaaaatcaacagaggaaccacctcgacatccccactctaggggtgtagggaggagagcaaagaaattctatggaggaggtagcatttgaacaactggtaaaacacaggtatacggaaatggagagaaaaatgttgagagaaatggagagaaaaagcttgagctaggtaggatacgcaaattcagctgatgtaacaatgaccaaaataccagaggcttaaagaagagtgaagatttcctccccatgatgagcagtccagagctggtagggaggccctacacacctgctggcttcttgctgtgcaatcctttgcaccagccttcacctcatggaacgaatgagctgttccagctcccatcaccctgtctgccttccaggaatcaggagggaaaggaggagacacaggaggcctaccagttcctctggataccaatctggcagttgagaatatcgctttttatcacatggagtgcctaaaacttagtaacataagcacatctagtgcagagaggctagaaaatgtaatggggaggaaggagtattcctaaagaaaaatgtttagaaaggggcattgagagacagatagcagcctgccactgagcttaaagaaaagtgccaatgtgagattgtgggagtggatgggggtaaatggataggtgccatgatgggcttattcctcaggcccactttcgaggaataaaggggttatatggtgtttctttctctgtccactgggagtatcagggaaagacgggcatctgcagttggcccttttggggaatgcctctgtttaagaaaactgccttcctcaaagtagactgcgcccaatgactatcaacgtgggagtttcaaggccaagccctcttactccaactcaggacatctgtgaaaagacatcccagctccaaaagctcttcctttgccaacaaatttcctgtatggaaattcatctccctccacccaatcctgcctccttccttcttttccacagctgtagaaaagcactccaaatcaacactgtgcctgctaatctctgccccagagactgcttcctgggaaactccatctggcacaatcaccagtttgtttttatcaccacatagtgtataaagggggagggaaggaagtgaggagtgagctactgtacctttgagtaagattgtagagatcctgaacagtagtgtggacttggttctgcaggcagttgtgagcagg

SEQ ID NO: 223 - DNA, 571598 bp, Homo sapiens
agatggggcctgtggctactaagtctgctcagaaatcgtagacttcggggaattgatcactattttgaaatgtcagaacatgctgacagggaagaacgtagtcgaagttttgctgtgacgagggtgcgtcttcaggaagaggcttctgcagcatcatcctcagcttctcataaggcgacattggtcacgctattcttggttattccataaaatcttggcatcttgtgatgtgttggttgtttttttatatgtatgactaagcctagcatgccaggcccccgggacgctgatttacaggctgtgtcctctcagtgacagtgcgcagctcccgttttctccattctgcagtaagagctgttaaccacacagaactcactgcacacagcggcagagggagcagctcccctccagcctcttgggctctcctcgcctgttttctgcaccagagagtgagctacggggcagcctggccttgtcctttcgttccctcagccactagcacagtgcctcgtaggtagtaggtgcttaatagatgttcaactaaactcctttcaagctacataaagtacctgtatttggcttcatgaaattgcatgagagatttggcttgtgttggttgagtgagaaaaagcagctcccggggcctctggtgatcagcttcagccttgtgcatatctgctcctccctctccggcctccccccacacctgtgagaccctaggtcatgcttggccaggcctggcaaggaatttctgaatctactttacattcttttgaaaaatgatctggtgtggagttagctgccaagggaggccaggaggtttgtgtgaggtgctggagggatcgggagggctgggcagccctagggtgacgtggggccctgagtcccaggccctgagcctgtgggcacgagtggcaggtcgactgggagcagttgcattgcaccgggtgctgtgactcttagatgcccatgtgccctcgagccctgtttaattcctcctccatcagagggcacggggcaggacgcagaagcttcgacatggactggctgtgtgcaggggcctggagaacagaacgtgtcgctggagcagtgtgtgcaggacccgccggggcgcagcacccctgtagaaccgcacgggagccgctcgcaggtggaacacgtgcttgctgcggtgctaactttgtgtccaggcacagaatcgagcccgttcccaacccgtgagtgggtccctgctgtgttcatctgaataagatgaaatgaagcactggtggaggtagcatcccgggtctcagcagtcataggtgcgcgtgaacacagggcatgcgctccacccgccgtcctcagcggcgcacacgcacaggtggtgttcagagtgtgacgacagctggggtttgtttgttcgtttgttttatggagacgcaaggtctcaaggtctcactccattgcccaggctggagtgcagtagcatgatcacagctcactgcagcttcagcctcccaggcccaagcaatcctcccaggcccaagtgatcctcccacctcaacctcctgagtagctgagaccacaggctgctaccaccacacctggctaatttttgtagttttcttttgtagagatgcagtcttgctgtgttgctcaggctggcctcaaactcctggcctcaagtgatcctcccaccttggccacccaaagtgttgggattgcaggtgtgagccaccaccccaggccctgatatttttgatattgactaaatactgaaaggataaaaagctcctaccgagctgaccatgaggttgtctctttcactgtccagagaggagtgctgggggcccgcaatgcttaggggctgtggatgagaatgtggacaatcacttttccctgtgcttggcttctcaagcaaccatctcgtacctcagggatagagctgtgggctcatggtctatggagaagccatgtcttcaggacagagatgggtgtatgtggtctatggagagaccacatcctcaggacagagctgtgtgctcctggtctacaaaggggccacgccctcaagacagagctgtgtgctcatggtctatggaggggccacgtcctcaggacagagatgggtgaatgtggtctatggaggggccacgtcctcaggacagagatgggtgaatgtggtctagggaggggccatgtcctcaggacagagctgtgtgctcgtggtcctctccctaccactctactccagccccctgactccacacagcttccccttcccatcactccataccaagcccactccttgaccgagccaaatgttccatccatgaagattcatgaggttatttccttcggtgtgtgaggcacattctcctgtggtcctgagctctgagcagtgggaacatgcagaggttctcagccacctcagttttgggttttgtcaagcaatgtgtaatcctcacaggccagcagatggaggccaactgctctggggtcctctgtatttgtgctcatgattttcctcggtctcctcccggcttcatctctgttgatgaaaggctttcttttgggaaagctggccctttaagggcagtggctttctgaaaccctccagggagagtgcatttccgtcatcaagtttaacccaactaacggaactggatttaatagattcaaagcaggctgggtgtggtggcccacacctctaatcccagcactttgggaggctgaggcaggtggatcacgaggtcagcagattgagaccatcctggctaacacggtgaaaccctgtctctactaaaaatacaaaagattagctgggtgtggtggtggtgcctgtaatctcagctactcgggaggctgaggcaggagaatggcgtgaacctgggaggcggagcttgcagtgagccaagatctcaccactgcactccagcctgggccacagagcgagactctgtctcaaaaaaaaaaaaaaaaaaagattcaaagcagacgaaggcgtgtcaatcacagagcggtgtgtcaatcacagagcataaggaccactgctgtggccactttgtccttcaaccccacacacacctatcagattttgagaatcagagtggatggtggttacttcctttgggaacatgcacttagctgaaacctctcactaagatgatttatcatcaacttcaggtttcatgctttaaaaaaattctcaacaagaaagaaaaatgacataggagacgaggctgtctggggtgagggcaggcgtgaagaaagactgggcagatgtgtgaagccgttatgtttggaggggttaccaagaggcagacccccccactggcaagaacgagggcctttttgggtaggaggggctcctctgtgagtgacagcaaagaccaaccccaggagccacttctgggccactaagagatgaggctggagacctttctgtccctgagccattaaaccatccctcccaacactctgattctccatgctcagtgactctggccagggaccactgagccaccttgcaactctgacgcctttgaggttcatcttgaaccctctttacacctgcaggtcttcttcattctctgcccataaccctgaccccttgttttgctgtctatggggtaatttatcataaggcccaagaaatgagatgctctttagggcgctgacagcccacccggaggaatggcccccacctgtggatgagggggaggcatcagaatcttctggggtgttttcagagcccccccacctccacctctgcccccatctgagaccccctgcaccctcccttgagtggagaatcactgtggttaatgtgaaacacacagacaaaaaaaaaaaaatgcaggcacccacggcctggcctgaagggaggtagggtgggactggagacgcggggtggacgagagcaacacctccaaacgcaggcacccgcagcctggcctgaagggaggtagggtgggactggagacgcggggtgggtgagagcaacacctccaaatgcaggcacccgcagcctggcctgaagggaggtagggtgggactggagacgcgaggtggacaagagcaacaactccaaacaagacgtcttatcccggcccctccggctgcagcattggagccccgtactcagcatggctgtaattttagtctatttcctgggtgacagtgagaaatcaaagtcccttcagccagcacagggatgtccctttctgggcctgccatgcccacagttaggtccctggaaagcagcaagatgtgtcacggggaaaacactctactggattctggggtgctcagtccacgcagactgacatggagctgtggcgcaagcccccgagacgtttaggaatcccttacaccccagttcccacctggcttagtattctacataaaattaccagccacacccgtgctccgtgtgttatggcaaagctacggcaaatctgggagaggactcagaacatcgaacatctcagatttcataacccttcaacccctcaagcctccctcagcagccctgggaagtaggaggctaaggctgtgttcacacactggtgagaaaactgaggcgcaaagtcacgcacgcagtgattaattcattttatgcagttaatgggaagcgggctcaaggctcggagggagctctttacacgtccggccctgtgctattataatgagttcatttacagtaaatctgtaaggctaatgtcgggctagtaactgctgctcaggcagaggccactagtcgatgtgaccattagaaaaaggaaaagggtttgtttgtttgttttgagacagagtctcactctgtcaccaggctggagtgcagtggcctgatctcagctcactgaaacctccgcctcccagtttcaagcgattcccctgcctcagcttcccgagtagctgggattacaggcatgcgccaccatgcctggctaattttttgtattttagtatagatggggtttcaccgtgttggccaggctggtctcgatctcctgacctcgtgatccgccggcctctgcctcccaaagtgctgggattccaggcgtgagccaccgcgcctggccaggaaaaggttttagagctgattgtgtcccttctttggggtgggtggacacattgtacagtcttgagacccccagaactttgcttgatgaaaaaggcccaacaacccaggaaagaacaattttactgaatatttttatttacttaacagaaacattcacttattagatatcactgaagtgcaatttatagaacttagaggcaaattaacatgtaaattcatattttaaggttttggatttttttttacaaatattacaaatgtacatccattgatacaatattgccattctatcatgctttttatgtacataccttcaattagaattactatgtgttaagttcattttgcttacaaaatgctgaaaactaacggggcacactgggagagatttttttttttttaccgatgcataaactgcagagagatagaaatctagggcctgtgtgaaaagaggcactgggaccaggtgatctcgccttggtgtttagggaatgctcatccctccaaccttggcttaggatgatgagttgggaaataaagtgttcctctcaccagggtttgatctgtctgcggttcccgcaggagtgatattgtttggtgtgaatctctagaggccagcgcggtggctcatgcctgtaatcccagcactctgggaggccgaggtgggcagatcacttgaggccaggagttcgagactagcctgggcaacatggtgagaccccatctctaccaaaaatacaaaaattagccaatctcataagccggtctcaaaaaagtaaatagatctctagagatgtggccaccagcgttccttctggtgggaggtcagaacatgtggacacattcaggagagtccaaaaatgactgcagcaactccctgtgcacaaggcatcaggaacccagcggggctcccccagccccagcatgaacctgttgtgtggatccctcgtggggggatggtgcctgagacctcctcctgggtgggggccacggcagcagaacaaaggagccaggagttttgggacagggactaacaagacagcaagaaagggaagaggcgaggaggagagaaagggttgagaagggaagcgaagaggctgaggggagagtgagcggagggtggtgctggccgcctctcaggcttcccagaaacagcctgagaaggaagctcctctgtctccaccgcatctctggttggtccctgtggcctctgctcctgcctcctcacttccccaccatccttccttcactttctcggattcagaatttgtgggagaagtttgacgggtcaccagcagcccagtgtttccagaaacagccctgctcctgcagtggcgaggaacccagacagcggcaaggcctacaccgtgtcctccagccacccgcctagccccacacagtggcaaaataccaaaagaccctaaaataccagcgaggcggggggtggtctgtccctgctaagagctgcctgggggtgctactgcctctcctgcaacacagggcttctaaatttccacctccaaccgcgagctctgcaaaaactgcaggcgaggacaggctttggaggtatgtgggatggcggctccctgacatggactaggggactctgcagcctccctgagggccgcgggaagcccacagagcctcaccgggttctgttgggtgttatgagaggcggctgcagcgatccaacggtagtacataaaaggaaagcctctcagcttccctttggtctctgttagaaagtgatacttattgtattttgggccaattagtcagattattttattagaatggcttcttaaaaaagggcatataagtttccctaaattaaaaatgtctactttatgtacgtctcaaatgtcttcagttgttttaaacaatacactatagacacatcttgaaatttattatctaaaaataggatttcatcaaaataactattctgggcattgatatcctctgtatttactgtttatggctctccagacgtgataaacattatatccaaaaaaaaaagcatgcgactttgttgataagaaaagctccctgtgaaaacaaaatgagatggagaaatatgatctgtgtgtttctttgaaaaggaacccagcttgatgtttctgaggaacaggactcatcacaaagtcagcatggtgtgatagatatatacagatgtaaagagaatcacaggaatggaaaggaaacaatagctatcgacctgcacatcctttcctcagcaaaaacaaaacccacagaaaccctaactctatcccttgatatcacacacggctgcaaaaccggggctggaggtggacagcggaggctgcctggccgcgcagccgttccctgcgccccgtcctgcaaaaaggccagaaaccaccagacactaactttttgactaagaaccaggccggaaaccacattgctgatcttcctgatgggaaagcagtgtgtgttttggaggcagataaaggtggtgctggttttatgaggacttttgtaggggcctaagcaggcatgaatatagactacagaaaatctgaagcaagggtatgaatacagaccacagaaaatctgaagcaaggggcttggcggtgtcaggtggtgggaagtgcgaggaagccagacggtgatttcgaggtggacttggaggggcgggcctgacttcatcagccccccttgtgtcgtgcccagcgtattttcagggtgacagaaagtgacccatcccctacttgtgtcgtgcccagcgtattttcagggtgacagaaagtgacccgtcccctacttgtgtcttgccccctcacttggaggggaatgggtggccactcttaagaccaattcagtggtcaaaactgcagggcagacatggcctgaaagtggtgctgggatgttctgacctggacctgagggcgaaatcctcaggcttcaacacgagcccttccatctctgcagaggtggcacagcccctccaggcacatccagggctgtgggaatcctgggacctgggtcttccaggcacacctggggctgtgggaatcctgggacccggcccccccaagcatagctggggctgtgggaatcctgggacccagctcttccgggaactcttggggctgtgggaatcctgggacccgggtcttccaggcacacctggggctgtgggaatcctgggactcggcccccccaagcatagctggggctgtgggaatcctgggacccgggtcttccaggcacacctggggctgtgggaatcctgggacctggccccttcgggcactcctggcactgtggaatcctaggacctggcccttcctggctgggtcaggccctgccagttgggagcagcctgcgtgtggcgtgatctggtgtggcgtgcctcctgcgtgtagggtcacccttgactgcctcgactaccttctcctttcactacccagggcctgggaccctcctttccttacgtggggtcccctctgcagcccacatcccctctgacagatccctccacggaaaggctccggcacctcaacctcactctggctgcattggaaactcttctgtcgctatcggccttctctgaagagctttaatctctccttccatggagtctcctgtggacttaatacacgaatccatacacttgtactaatgggtagcatggaattaatgtgtggctttctccagatgtggatgttgatatttcagtaaagtctgagttgtttctggaaggtcaatgcctgagacaaaacgaatcccaaccccccagctgtggcttcatgatgctggccactgggtggccgagcgctttccgagtcccgtgaatcagaccctgcgtcttccctgtgacagtgaaatctgcttacaacacaggccccctcgctgcagaaacagcgtgatttggagcccactgggacaaagcattatatgcttctctagccaacatctcagatgaaggtgatttgaggcctgggtgggagacttcagccaggagctggccgtgctcccacgcattcaggggagcgctcacttctgactgctgcgaatgtctgagccacccatcacctctcgactctaagttctctaagcttcatcctagtgatgtcaagttaccagaacttaatagaaactggtcgtttgagcttagcttttgcactgaattaagatttcatttatttttgtgatttttataaaagattaatgtgagtcctttatttgaaaaaatgttctcgtatcttttgaaactttatctggaagaagttgtctactccagtacctgttttcttttctaaaagaactcgagtgataaatttggcctgattttaaatcccaggaaaagtttctttttccatactaatatctctacttcttattatcttgtaacaaatagctacaactcagtttcatttctgccttctcattatgataactgtaatttatagcacttgactatgtacagcacaatgttattcttgcactttctggggtggtcagctgggattctttccgggaagcccacaccccagaggtggacaccaccatgctttgccgtctgccatcactgtcatgaatttcagagatggattttttaagttggagaaatgagagactggctatctagcatgatgaatgttagaaatgagttctcggaggtgagatgacagcagctcgaggtacatggattacgtaaagatacttggaaaagagcctgaccccgtatgaatacagcgccttggctctcagggatgatgctgtgggctaaagcccccatgtcccatctccactgtgagctgaaggtctctggtgttggaagcctgctctgagggtcacagaatcctgcctcttacattttttgacagctgaacttttttggggtcttgtcctgcaaggtgttgattggagaatctgaaagaatagagagctggtagcctctcaagctgaaggtaaaggttgttttgattttattttgtgcttgctttctaatgaaaatttagttaaaaaatcagaatttgatcaaagacttggtctccttattacctggtagggaggttatagggtggtagctaacccttacacaacccagacctcagtggctcttagtatcggccaccataaaccaaacgccatgacggactgaacaggcatgggccaggtgtttccgggctccccacatctgcagcacgcgtgggccgggtgtttccagactccccacatctgcagcacgcgtgggccgggtgtttccaggctccccacatctgcagcacgcgtgggccgggtgtttccaggctccccacatctgcagcacgcgtgggccgggtgtttccaggctccccacgtcacaggtcttaactctgcctcgcaggggttttggaaactgttccttcactttgtgggaatggctttcgtttctctggttctattttaggtgttcggtaatgtcgtacatcttaaatcttttttgaaaggaggtggagtataaaaacctaaatgaatagtgaaaataatagaggattcttattggtttctctggggctggggtgggcatggcttttctcttcatttgtggcttatcttcatgtgccccctcaagctagtgagaccccagcatcaccaagaggcgcacgcaggggtggggtgcagggacggggcctgaggctcactcctgcctggtgtcgtgtcggtgcctccttccaaggctgcagctaaaacccctttgcctgaatggagcccctccctcagactccacaggaagagtcggcgctaactcaacagtgcatgtgcccctgggtgtgggggacagggttctggggccagcgatctggaaagaggcacgttctgaatttgtgttgttgctcgtccaaacattgcacactcgcgtgtttctgggacaccaaagtaaaacgaatgcagggaaccggccgacccgccacgtcgccccccagacacggtcccatccctccagcgtcccgctcagctccagcagccaggagcccgcagcctagagagtcagtagaaactgctgctgctccggtggtttcctcacccaggtgcccaggccagccttctgaaaggccttgaacagctgctgtttcacagactggtaggtgtgcgcccccagcttggcctcacagtacatggagggcgtgtctccagggctgggtgtccgtgtgctcagctgcggacaagaaggagaaagagccaatcagacaccagcagaaaaggagcttctgctaggtgagttttacatgccaggcatcagctcctggccttggccttctgcctttctttctcccactattacagagagcaactgtgaccaggtcctctggcaattccacaggaaacctagtcatcaaggaaacccgcttcatctgaggtgtgaatgatgaatgagcggataaacttgactgctactaaaagtatgaacactgtgcaggggctccaggcagggttggggacagagggggacagtgggagctaaaacagcatcacagtgggcagggagcaggctggtgagagtcatgttgtcggctgagcaggaggatgatggagctggggcgtttcctctgttagctttctgaggtctgccaggcaaagctttgcagcaacacaagacagggatcaaatgcagctctgatacccccaccacggggcagggaggccaggagggaagaggatggggccatgggggagctccaaatcccacagcgggtcttccagggaggcactcaccggggggtcacctcgagcatgtgcaagaggagagggcccttttgctcagcaggacagcatcgacgcttccctgaccttccaagtctccaggagaagggagaccccggcagtgcccttgagcggacaggacagaggctgagagctgcaggatgctgggcgtctcggccaagctcagagctaatatgtgcaattctgagtgtcctctaagttggctaaaacgtttattttaggcattagtatgcctgccctcctctaccagttgacaaatcaacactattattcctgcttggattaaaaagtgtggaaaaatgagagaggcattttttatgtgttggctggtttttctgttatttgttgtttttggttacagtctatgctttggaaatgcatacagatacagattttgatttaaaatccagaaatattgctgttatccctacttgtgaaggagaaatttgctcctaattgtggatgtcgtggaaatgcttgggctttggggttggggagaaattcgaattctgaaattcattacctgtgaaattttggggaaattacacaatttttctgagtgtcggtttcctgatatctaaaccgggaatagtatcgacttcaaaagtccccaggagctgcttctgggacaccccgaacaaagcaggtggtgccgtgccggctccgtcaggggttcagcaatgagctcctttcctgcttctgcagctccagcctggtctgggggcggtgcctggggtagcagggtctcaagcctacaggggaaacgctgctggcctgggcagctgggaaaaggacatgtgatgggcgctgtgtcgtgcatctccctccctgcagaccaagtgttggcctctcccaagagcttgctcagggctggagccagggtctggctgggtccagtttccctgcaaggatgggtgcgacctaccctgccatacagccgcgcccaccgtgcagacagcacgtgcttgcagagccgggatgggcccccacagctcctccgcccagtggtggcgttgataatctccaggtccgcgctgcccacgacccagttcatgctgaaggggggcgacttccccggctggcgcgcctcggcgtcactcacgcctgtcggggagatggggaaaggcgggcgttaatattcctggcctcacacggggctcccccaagggcagctgcggggaaatggagcctgtatgtgagtgggaatggtcctcccttttcatcctcaggactggccagttcacgtgtcacccgcagggcggaggctgcaaattgggcaggatcgtggtggccgcctcgggtccacggcgtcgctgcacctgcgtcaaccttctaatcgaagattttaatagtctggtgataatatagctccgtccagattccccccccttctgtaaatattagttgagtgaatgaatgaacagagccacgtggaagtgatctgagagtgtgtttatcaggcacctttgcaggccccgctctgctggaggcaaaacaccggggctagtaagcaacatgcagctccctggctccctcgggtttacagtttagctgatgagaaaaacaaaacaaaacaaaacaataaaaaccaggcagaaatgagtgtaggatcaattgatccgcaatgtgatcctgaaaccgcactggctacagagtgtttgagactcagtgcacagcggaaatatggggccttttgttcgaaagttacgaagaatttcatgatgacagtggggcgttaaaccaagcatgggttcgtctaagctcaggtgcctgtgtgagctgcagggctgcatgcccacgatgctggtcctgtccagagagagccggcatcttcagggaagccctcgtttcaaaagtgttgcctcttgtgtgcttggacttttaacccggaccatacagtccttgcagcccagctcacagtgcagaagggtggatgaggaggtctccactctggggtggcagctgctttgcagctgggggtggtgcactttctggcttctaactgtggccccagccctgactccttgaggtgctcctgtgctgattggggcttctggacatgctgccacaagatgtctggaaactccagggggcacctgccgagaccctgccctgtgacggcctgaggattccaaaacatgagattccggtgcagctgagccccgccaattcattgtctctttcagtcccttctgaaggctgcatttggcaatgtgaccctcggggtggggaaggcatcagaggaatacaggctatgggacgccagaggcagcgtcctggggacaaagcccacttcttcccatgcccagggcttcctcatggacccagcatggtggacgtggccctcagacgtccatgggtggtgggggaggcacgtgctgtttggccctgtctctgctcagagtctcataggaagatgcatggtccacacaacagtgagtcggcagggagtccaggctcccactcacagcagtggtgttgagacgcttggtttataacccaagatcccttgtcccattggtgcctcctgaatctcccacctcccgcggcacctgcatggcctctacctgacgcgttccccaagcccagctggccgggtgtctccctctcattcatgcctcctcgcagatcagctctgcctctccagcccttcctgccttcctggcctgctgtcctgtggtgcttggaggcgagcggggcccctgagttctcgggggcccgtcatgcatcacgtgagatggcggtgcctgcagagaagaacttggcgtcttggccagggcattgcatataggccagccaagtgcctgctcaggtccctgggaagccactggctattggtggagaggcccaggtgtcagcattggtctgagagcaaagacctggtgggctgagctggtgcgagtgggttcccgccatagcagactcccgggaggaagctgtccccacgtcacgtggtagcacagctcataacaccttcctggaagcaggcttcatttaaattcggggaagacccactgactacagagttgcacagccacagaccccagatcctctgctgctcccagcttcatccacgagcctgagctctgtggacagactgagcacatggcccatttgccaaccacttcgaaagtcacctggtgagcttctgctggccacagacaggtgatgtgggacacccaagcgaatcccgttcatgtcagctcttcctttttccttcaagtgattcacggtggcagctgccaccccgagagccgggagggacaatctggcccgttggccgctgtggctgtcctactaggcaggggccgcctgggcaggaggagccagccaccaaggccagggatgaccgggcactgggagaggcagtcactaccctgatctgcgtgcactgggcagcctcccctcctcctcccactcccgtcaccaggcggcctcccctcctcctcccgctcccatcgccaggcggcctcccctcctcctcctgctcccatccttctggtctccatgaccatcagggccaaccactgaggtgccaagctgcaaagtctgaactcagaggaaagccttgggagcctgaggtctacacaggacctcctggttccttgtcaggatgccctggctccggcctgtgcccctctcctttctctttgcggaggacgttgtgggcaagttgctgctagcccttggccagctgccgtctgacggggtttcctcccaacgctcctggctgccaggcatgacgaggcccaaacaccaccgggaaggcagctgtgaggacgtgggtgtgaacccagcacgtgcactgctccacactccggggacagaaggaaggagctggtggggcagcgagggaggcgctggcgggtgggctgcggggtcgtccagccttgcatgggggcttcttctcaccagggtgtggtcccatgtgtccatatgtgcacagggaggacagtgtctgctgtaaataacatctcagctcacctgtgatgacgtaaatcacactgtaaatcattcagttctaactacaacagccccgcaggctactgtttaacatagaaagtggtgtaaacccaggagcaatcttcaatatccaagcctgtccatgaccccggaggtggaaaatgcaccccaggggcctctcccactgaccaggaaccaggtggctggagttccaggcagtttgagttctgtggcccgaggtcatcctccacttaccgctctgtgacaggtgacttctctacttcacgaggtgatgtgaagatcaaaccaggcaaataagagcacttttggagcacccaggctatgaatgctgctgttttcatctgaaggaggatttgaaggccaactgcagtttgtttcgtgttctccaagtcacacagatcaaaaatgtttctagttagatcacagggaacatttccaacttagttacaatcacctaattgtgtccagggaacggaggaaccgaccaacaagcaaaggtcagttccttgttcctttcacggaaaacacattctgttccctttatttgtcctctgcaggggacaggaccatgtgcttacgctttgagcttctagggaagggtctgctcccctctgtgttctgctggcaaaagaaaaacttcccaaggcagcctggaagaatagcagtcctttttttttttttcttctaccttcttgtcttttttttttttaataaaccttccatagagagatagtgttgggatgtttcctgaatactcacacaggcagtagtttctgacatcgctgtgactaatatctgcagctgatcatgcccgtggagcgggaaccacggcccagatccctggagtctaatgtgcagagaaacggatgctcatggatgctcatgtcagtctcactattaggtttgccgttaatgactctttccatggaacagatcccttatggtgagaggaagtgcagtcaggagcgggctgcttgctctgaggaaccagaagtttccttctccagtgcggccagcagccaggccctcttcccacgctggggcccagccctcccgcaccaggtgcccaggctccaggagggccatctcttcctcaccgacatggaagggccatggcctcgtgcgctttcactctctttccatttccccgcagcctgagtcaccctcaaggaggtaactccctgtcctgggatgtctcctgaggacactccagcattgggacatcaggtcactccaggctcttcctttctttgttttatttattttggcctgggggagccacttggtttctcaggagccttctgctcatgtgtgaatgatctctcatggtgcactgattttataattttccaccagtttcccaggtgccgtacaaagacatgcagagccttctgggagctggtccagttgcttgctcatggtgttcctgtcgagcaccttcctggccgtggagaagtgggtttcgaaagggttgaaggtgttagggctaaactttaactcagctggattgcattgctagcggtagttgtggatagagccagacaaggtgaagacacatgtgctcaggcctagaaatgaaagcctggcttgtgtttaattttaactcctgtggctggaaatgtgaaaatgcattaactcctggctcattcctcctgaagtgggcatcggctgattgaagacggaactcgagtcccaaggacagagggtgtctgcagctgcaggggcacctactcaggcctgtcccaccctgttcctcaagataacacagcagcacatacctggtgacccagtccacccagaacacatggccctacctccttccccagaacacgtggcgctacctccttccccagaacacgtggcgctacctccttccccagaacacgtggcgctacctccttccccagaacacgtggcgctacctccttccccagaacacgtggcgctacctccttccccagaacacgtggcgctacctccttccccagaacacgtggcgctacctccttcccccgaacacgtggcgctacctccttccccagttcacagcacaaaatgtctcctggaggggattcagggaatctccagcagtgaaaggtgccaacagacctgtggcgattgagggacagagcctgtgtcgtctgaactcagaaaacgtgagcatcaggccagctgagctccaaggagaaatgcgtcctcctgagaaattgcacgcaggagtctgaactcagaaaacatgagcatcagcagctgagctccgaggagaaacgcgtcctcccaagaaattgcacacagataccccagtgctgtggacaaacacgtacacgtgcttgcacaggggtcccacgcttctcactctgcaggccgccctgtgaggccaaaattcctgtgaacctctggcatccagaagctacaacaaatccaaattaaccctgtggaacacttctgtgatgcacctcctgccttcggtgtatggcaacacaggaacgatactgtgtattctaatgtggtttccacatgcacagaaaattgtacttttgtaggctgtatttgttttaggtgattgctgtaacacattgctacatgtgttggcttaaaagagcagaaatctgtcctgtcgtagctctggaggctggaagtctgaaggtgtgggcagggctgtacctccttcagaggctctggagagaccccttcttgactctcccagcctctgctcaatcccaggcttcctggcttgtagcggcttcactcccatctctgcctgcatcctcaccggcttctctgcatgtgccatatctcccccgcctccctcttctaaggacagaggtggctgcaggcaggacccactgagataattcagatcatcttccatctcacgatccttagtttactcacatctgcaaagaccccttttttcagacaaggtaatttacaggtcagggattaggacttggcatcggtgggggccattatccagcccactgggagtgaacttcgggactggtctaaggacggagtgagcagcgctcttccggaggaggggcagccccacgctctgggccccacacttcgcagaacaggggtttgcacgctctgggccccacactctgcagaatgggggtttgcacactctgggccccacactgagtagaatgggggtttgcacgctctgggccccacactccgcagaatgggggtttgcacactctgggccccacacggcgtagaacaggggtttgcaggtggcagctcatgggctacttctccccgcatctgtttctttccctctggaccttctgtgtgtgatgaggaccagcggggctcacggtccaggagggtggggggccagggctgcccagagagcagttctgtgccactggctggatgtgcagagcaacctggggatgcacggggcacccggcacgtgcacctgctgagtgagggtggcctccgttgggtaggaccttggatttgaaaatctgtgtaggaagcccaaggaagggtgaggaaaaaaggtgtccctgaaacactgtgtagcctggtggtgagcagggtcgggccccacgtttttttagtaattgctcccaagcggccttgggaataacgccctcgctacctgagcagcttctccctgagccgtctgtaatggaaccacgctcacagacgcttgttaaacctggtacgtaactcagggatgtgttgcatttattaatttgtaaatataccatgcagcatatgggccattcatctctgagaacattttttagggagctgtcttatttcagagtagatctgtataggaataagctggtctcccggagcctttgacatgaatattctgccaggttgtctggtgtacagagatcagcctgatgagattgtgtgacctttttgctaaacacacacaatcgtgttaacagtgggctctggcagcagagcaaagctggactcacttctgtgacatactggcagtgtggcttccgacaagtgaattaaccactcctaccagcactgcttcaactaccaccgtgatcagcacaaccactgctgttacatcaccattactaggaccggtgggggtgaatccacaactcatctatgaaagtgagttttactgtggctcgcggagctataaaaagatgcctgacttgaagaaaatccttatttacctttttaaaaaggcattatgtaagtgagacgttacagcatttcttcaaagtgagcctactatatttacaaggtaacttactttcccaaaattaaatttacacaagacatctcaggagtataatttttacatgcagtgaggcaagtctgtgtcactgggtagcactgcatttaattttgcagagtgaatgaaatagcatggcatctgggcctgcacagattcataaagctaaaggaatcagagagatctcctgagttttctatatggccagacacgctgcggggtctttctctctctcacgcacacccacacacccttaatggaagagctggtaaatttaatgtggacttatggatttggggtaactaacttctaaggctgtattaatgccgttttattcattatcattgatatgaatgtctttataattgccagtaattttatagctgctgtcttgctttgatacagcacatttataagaaacataaaaagtactatggaggctggagatggtagggttaactgaggatggacagctggttctttctgctgtgagatagtcctaaaaacttctgtgggttcggcctggcacggtggcttacgcctgtaatccagcactttgggaggccaaggcaggtggatcatgagccatgaccaccctggctaacacggtgaaatcctgtctctattaaaaatacaaaaaaaaattagccagcctggtggcgggtgcctgtagtcccagctacttgggagtctgaggcaggagaatggcgtgaacccgggaggcagaggttgcagtgagccgagatcgcgccactgcattcccgcctgggtgacagagcgagactccgtctcaaaagaaagaaaattctgtggattcctgcaagccagaagggaatatgaatgttgaaaacacagaggccatggtggcttttcctcgccttccctcatgtgactggtttgaggtggaggtgttgagggtggaaggcaggcatctgcagggtgtggaacgggccacgctggctgcaccgtctgtgaatgtcccgggtgcaagttctgctgggacagcagtgatgtccggggatgccaaggcctgggcggtgtcctctcaggagggtttgtgcctccactgatctccaggaactttattcctaagagaccaccgaggagtcgggaggatggacgaccgctcaggttcccccgaggttaaagtgcagaggctcacaggaggcttcagaagatgtgaaatttccatggcagaggaaagaatctgcatttttcatttttcagcctgataatgacatgacttttggcttctgtaaggattgtcattatttcaaaagatatgggacaaagggactttgggggaatggggtcttttgctgttccaaattatgtatttttgtgccctagtactcaaaatgtagtaatatgccaggtttcaaactggataaaagtgtggctggttttcattgctcttcagtcggcattactcatttgagattgtttttcttaagcccagataacacatggagtgttttctggagagtgagtccaccatagttagactctgtcagtgtttgtctgcaaacgctgtctcaccttcgtttttgaaggatgctttttcttgatatcagatcgtaagttgagattgtttttctatcagcattttaaagatgccatttcattgtttttttgtcttctgagaatcagttaccagtctgatttagctcctttgaagtgagtttgtctttcatttcctgactgcttttaagatttttttggtctctgtttttcagcaatttaaccactgagatgagaattaaaaaaagttattcttggggtacaatgtgcttttcaaatctgcatttggatgctttttgtttgtcttggaaattcttagttgtgatctctttaaatatctctcctgttccattactttttctggaactcttattacatgcattcagactttcctgctctcttcactctcttttgtactttctgtgtgtgatggttcattttatgtgtccccttggctaggctgtagcacccaactagattaactgcgagattaaccagcagtcccaggtattgctgggaaggcacattcaacgcgattaacatttaactcattcgactttgaatagagcaggttatgctctgcaacatggctgggcttcgtccaatctgctgaaggcctgaagagcaaagactcaggttctgtgaagagaaataaattgtgcctccacatggcttgtggactctagacgtgccactgccactcctgctgaaacttccagcttgccggcctgccctgtgcattttagacttgccagcctacacgattgcatgagctgatttcttaaaataaatatctatcaatctctatctgtcatctatctatcatctatcatctatctattatctatctatctaatctatctatctgtctgtctgtcagtctatcatctatctattcatccatcctccatatatcatttctgccttctgtgctgcattctggatgttttcttcagaactgtgctcccatttattaattctctcatgtgctgtgtttatttggtattgaaccatcctctgttaaacaaattattttattttctgtatttctgaaattcctatttggttctgtttttttctgagctttcatctctccccctaagtgttccatcttgctttagaaaatgtcctttctcctattgagcgtggtcatattagggtctgtgtctgaaactccaactggagtgtctgtcctgctgcctgttgtttcttctgcatttgggttttatctcctgtgtctgcttgttttttgtgtgtggcaatattctatttataattttttgtagagttattttgatctaatgagtaagaggaccatcttaatttaagtcaggagtggagaccatttcaagctataaacactgtaaggggctgtttgccttgagcccaccttggccctgggaggcaggccgacccgcccccttagcctcccgtgggtgctgaagcacctctcagcccttcagcttctcagggactcttacaggaaaatctcccctcccatccctgtccttccccaggtcctggcttggcaactcttccctctcctgttcactcttgtggcactctccttggtgccaccaaggagaattgcaggtgcccctgccaacatctcccaccatcctcagggtttgtggtgcagtcccatggggagtgggattctccagctttacagaaccttcagggaaccatcattcagtatctgtcaatgctgtacacagttttttttttgttttttttttttttaagataagggtctttagtcccttgttaagttttatgactggcaaacatttctctctcagaatggcagagttttgcaggcctgggtgggagagcacatctaggcagagacgacgttgaaaggttttcatgccagagaaagctcagagttttgactccaggggtgtggctgtgagcaatgagggatgtccatggagaggctgatcctggttcagaagaattgggatggtgctatcagcctgaggcttctgaatccatggagaggctgatcctggttcagaagaagagggatggtgctcttagcccgaggcttctgaagggaggtatggctcactgcagcagggtgaggctttctagcccccgagccagcaaagcacagtggggagagtctggcatcctaagatgatggtgggggccagttggcttttatggcaccgtcctagtctgtgcttttcccgttagccctgtgaccaccttcgtaaccccactgaatcgaggcccatgtgattgtttcaggtctggggaaccaaacagcagcctgaaaccagctggaatcttcccttggtgagaagggagaggaagcccgctgcagcctttccagagtgcctctctctcccgtccgcttacctcacactctcagcccaaccctgcctgtttcccaaaaccctgtgggagcccttctcccagctccattccctcattcctctaggactctgcgcagtgtcaccgccacactgagagtgctcctgatccttttattagggctgagggtcactttttaatccttcttttgcctttttttttttttttttttgacaaagcactcatattttgtttgtccgtctcccctactggaatgcaatcaccctgaggtatggatttttgactattttgttcactgctctattctcaatgtaggattgtgcccggcactttgtaaatcatcaatacacatttgctgaatgattaagcaaatgcctggattatgctgatcaatttctcgatgttggatacatttaatgtattgacaatggaagtattttcctggagttaatgatacaattctcaggagcaatgtaattaagttcgttgcttaaattctactgggaaacaattccttaagatcatggtggaaattaaatgaaaattaattattatacaaaatatttttaaaaggattctccagaaaatgaaaacaaagtttttcaataattttatatttatcataagctatgtgccatctaatttgcctagaaagttctgtgctaatctataaaaatgtcttattaagtagttctttgttgaatttaacttttttagttttcatgaaaagatattaggatttcttttctttctttcttttttctttctgtagacatggggtctggctatgttggccaggctggtctcaaactcctggcctcaagtgatcctcccacctcagccttccaaagtgctcggattacaggcatgagccaccacgcttagctaagactgccttttagattgttctagcaagatttataattttttccaccaaaaattcctgcaagggcatgggaagataaatttctagctctagtgactgtaagaaacagcaggctgctaaaatatttctgtaatgcttatgtgtttattactaaacatttgtaaaaattttgtaggttactccaaaatagacctctgtttaatgtaaaaataatattgcaaatcacttaccatctggataaaatatttgctactgcttcactatgttattttgcaaaatactcttaattatcattaatttcagaaatttctcctgaattaaagaggtctgatactccatagaattttcctcaacttagtgtgacaacattttgaaaatctggactcataaaaaaaatggacataaatggcaacagagagagactttgaatgccaaaaataggtggcattgggaaatttcagaagctattagtattggtacacatttcagtacatatgtgacttcacatttcagtacgtatctaacttcttttctgacaaatggttttgctgtgaaacatggatgcctgaaagggcttcagacgccccagctggcccttttcacactccaggaaattgtgtgctgtggaggaagacagcccgtgctctcctctattttatcaccagcactgcaatgttcatcacgtgaacataaaccaagagtcttaaacaagtcatggttctaacaatcaattctctgggtccatctctcagatttcatgttcgttgccaagaccttgaggtgggctgtaaaaataatcacagttttatcttcagtgtggactaagaaattaatcattgacaacatatctgtttaacatgctgttaacacaaacagcgaatttatcctacccagatttctttttttcttgatgaagagaaataaaaatttagccttgatgttgaaagctcagagaagcatatatcctcagcttggtggaacagcctgtcaaagtggctatttcatctcactttttcctaaaaggatgattattcaaagcatagagttttattaattactatccccatcattttgttcatcttactgaattcactgagaaggaccaagggcaaactcctttaggctatctgtactcaggaaataatgcaacttttgctgaaggattcagcgtttgagacatcctcgaaatgggcttctggtcctgaagttttgccatagatttagactggaaagtgcagaatttttcaagtatatccttcaagaacattactatgcatcccgtgactgtgtgagtaagggtatctttttcagcttggttgcttctttttaactcagagctgatttagccatatctaaattgctgggcctcattctgctaatacataatcttcatcttctaaggcagttctgcaaactgaccttgagggaagcttcaagcaaacttcatttgcttatttgagggtgctttttattattatccctgtgcaagatctctctctctctttcttttggtgcaagaaattctgatgatttcttttcaaaatttgcatgattggtttttaaatgtccatcaggaacaatgcagggacagcttaggggttgcatgcaggcaaggtaccaagatttaggctcatttgcatctgcaaaataatgaaaaccagattcccaataagcatgtaaatggaggctgaaatatttagtcaggctgcaccggccgtggtgtggcaggtgccacctgggatcggaagcagacaggtgtctctcgggcttggctattatctgtgccactcaatgatgtcaggtggatctgaatttctctaattgcgttttctaaaattcactgtgttcacacttaggattggacattcctgtttttatttatgttgacatgttcccagatggacacatgattgaaaatcagcactgggagactggctgctgagggtgacatgccagtgcccagggagggcaaaacctgctccgttgacggtggcttggggagggcgtggttgcatttgtactccatatttccttgtgctgcgcaagcttaaataagcccttcagtaggtgctggacaaagagcggggatggcctaaggaaaacgcgcagaaaaagagtgcaggagccacttggcaaacaggtgaaaatcctctcctttctggggcagaggttttctccgtttcccccacatatctgcctgattctgccacaggcaggcccttcagagagctctcccactccagcaagggaggctgactcaaagacctggtgttctgcaggcccagcatgaggctggcggtgattcggaaacccacccccccgcttcccgctgttcctgtgaaaggccaggagtcgcctcctgtcagtgtgtccttcacaaaaccctcccaagaccactcccggggctttctagggcacctcgcagctgccaagggactcttcatccttgcagctggctgtgtgccaggcagcccgggcaggccccaggtaacgtggggaagtagaggcttggggaggctcgggtctctgaggacatctgggctgtggggaatcctggtgcgaagccggcccagtactcgcggagtaacctggcagcctctggagggtgtggagggcccggggccctgggttccgaagacccgctctggccacgtgaccttggcgccccccgcccctcctcgcccacctggctcttcctcagcatcgcctcctgtgggcggccaggtgggcaggtgggcaggtgggcggccaggtgggcaggtggggcctcttgggtgagcccaacactagtgattctgttttcagaactccttcagacaccgctgtgaaaacagcaccatcacacaatcacgaattcacatcaggacctggcctattgctatatgcagagagatgctgaaacctttcattttttctttttaaaatcgtaggactttgcccattaaatcctaaattgccactagccaacatggatgaagtctgcgagggatggcaccgccgggcacacctgtgtctggcctggtggtgggaaggaggtggagggcccccgggaagggggttcttaccgctgaggagaggccggttgtgccggtaggaggcgggcagctggccgacaccctccatgcggtggctcatgacgcgtgcgaggtggcccgtgtggtgcaggctgcccaccacgatgctctgcaggtacacgggctccacgaagtgggacaggagcgcgccctgcagccccaggacgttccacctgtggggagagccagcagtcagcggagccccacccaggagcccagggagcctggtcctctctgtccgtctgcggcctggtcctgaggacctgtcagtcttcccatcgtgcggaccttggggagctccctgggagtgccccagacccaacccagccatcactggggctctggggacactgttgcctgggactgggctccacaggcccatgtgtgctaacaaatgctgctctcttttctgaaaatgagtcgttagagtggaaactgttatgttctctgtgggacttagaattagatttttttaaaaagatactctgtcccaaaagtgaatctgaatttttctttatattagctgggaaatactataaatggaatttgtttattttagtttagggaaaaatacttagtactccctttgtccttagcagtcaaaatgacctattgtgttgaaattacattaacaaatgaccttgttttggtctgggcatgattttggtttcagaagcccagattggagatgaacaacaaggccattttgtttgaaataaatatagctctgggtgaatgtttttgcttcctcaagcaaaaatgccaagagcactgacattttttccccttaaatttgggtggcaagaggttccatgtgtgtgttttttgaagcaacattctatggtttccactctaaataatgtgcttaaaatcctacctccttcagcagcaagcgttacgtagctaatttcttacatcattgttcttttcattaattaacatttctccactgttagagcaattactgccatccccgcatgcagcgtctcttttcatgattaataaggagtcattacatttcccttcccgaagcagtcaattaacacaggattctttccattaattaccgaatctacctggagagtaatcttctccgagaacccgtgataccaattgctttaaaaagttctctttaaattttattccaaaaacacaagcaatttagccagcgatattaatttgcctcagaagcatctccatgaatgagaaacatcttttaatctcatgcaagaaaaggcagccatctggctggtgggggtttcggggagccgctctccctctctccctctgcaaatgcaggtcattaaagtaatgtgctcatctacataaaactcaaatggaatataaaaggtaatatttatatacaaacaatttagtcctacaatttaaacagtcattgattttatgaaacatttacttcagtctatcagatttgcataacttcatttaaaaaaatattgtggtcatttctacaagtcacggtgcttctcccagaaagcaagggaagggctggccactggatgtgcgagcttctaccagaggggtgaggtcgggcgctctgaagggtaggatgagatggaggccacagagcgcctgtcaccgaggaccttcattccacagagtgtctgcctggatctcggatggtcgtaagccacagagcacctgtcactgaggaccttcattccacagcatgtctgcctggatgtcggatggtcggaggacacacagcgcctgtcaccgaggaccttcattccacagcgtgtctgcctggatctcggatggtgggaggacacacagcgcctgtcactgaggaccttcattccacagcgtgtctgcctggatctcggatggtgggaggacacacagcgcctgtcactgaggacccttcattccacagcgtgtctgcctggatctcggatggtgggaggacacacagcgcctgtcaccgaggaccttcattccacagattccacagtgtgtctccctggatcttggatggtggctcttcagagtcaatcttttccttgatgttcaccgataagtcagagaatggcaacaaatcctgggaaaggagattttttgtaactgagcttttccttcagggaacaatgggaagtgttttctgtttgtttgttttgtttttttttcaatagagacatggttttgccatattgcccaggttggtcttgaactcctgggctcaagcgatcctcccacctcagcctccttaagtgctgggattacaagtgtgagccactgcacctggtctttgtgtgtgtgtgtgttttttttagacagggtctcactctgtcacccaggctggagtatggtggtgcaagtggtgcagccatagctcaccgcagcctaattattttgtattttttcatagaggcagagtcttcctatgttgcccaggctggtctcgaactcctgggctcaagccatccactgaacttggcctcccaccgtgctggaaccacaggtgtgagtcaccgtgtccggccaaggctgacatttttgaggagcggttgagggatttggcttcttcccttgactctgagaccagaggacagaccaaaggctgggaggaaattcagcagtgtggccctcctcgggacgtaagatgcccgttctcagatttggagatgccagaaaacaaggcccaggaaaggaccccgtgcagggcccagggctccgggtactgtggtcccagtgggcctgttaattctcagactgttagtgcgtcttaaaatgtcttataaagcagggaaaggtacatttccgccatctgtaacaaagcaccttcgtgaaataagccacgagttaaaaagtaaaattgggattcctggaagagacgcctccgtgttagaggccgtcagagcacgggctttgaacaaaacttccggaacgtatgtgagtggctgtgatgctgcaggaccgtcggaagacaaataacttctctatctggttcctacctaataacctttacaataaagaggaaatcaaccttctctttgcctggctaccagagattaaacttactctgctaagatgatcaataaaaccaaatgtctttctgaatatgagctggagaattttcagcattcaggattgaatggaaaaatgcctctccttttgttcaaacagctgatattactgcaatgttgacagaaaaaaaacccatgtctagttttcaatatagataatccctaaataaatatatttttgtctctttgtcagtcattgaaataccacagataagtggggaaggtcttggaaaaaggctgccattctttagccaggagatgcaacctgctcactgagtccaggctgcagcctccaggccacaatggaaggaaagacaggtctccggtgggttgacgacacctcaggctgtccctgcaggtgcgccggcatcaggcagggaacaggaccgcccttgcctgttttggacgctttggttttccgccgtgacgcggccctgtgaggagaagtaactctctaaagttacatgaagcctgcagcaaagtcctcagctgccacccgtcccggcgtctgcagctctgcagggctggctgtcaggcctgctgctgggatcatctgggagctttgaggatctccagaggtctggctcccccaaggattttggtgtgactggggagtcagtgcggccatcagctttctcggtgccgcccacgtgattctcctgtgagccagggttgaagacttctgcagcaaagcggcacatttggagccaacacagtcaggtaccagttaggtcgtgatgctggtcagtggggcctcccttgaccgttctcttgctgctctgagcgactgtcttctcagtggacctcaaagtgggatgtctgggccagccatggagcatcacctgagaagttgatagaaatgcagattcctggctgcaccccggagctgctggctcttgaactctggggtgaggcccggcagtgcaagttctaaggaggctccaggtggctctgaggctgctcagttcgagaaccaccgtctccgtgttggttctggggtcacagtaactgtatctacctttcacggcattggaagagcacaggggacagttgaatctctggccagtctgggggtgacatttcccttcctccacaccctacctccaaaccctgtctcacaccttcttcctcccaccttttgacaagacaggtaataagtctgagacgtctctgcatacaggccccaccccatttccaggccactcagacctattctgggggcctttcaaggtgaaatagaagccaacagccttttgactcaataacacacctgctaggaattcacccagcatctgcattctcaatggaacgcctgatatatggatggggccagtcttgaaggggctgtttgtaattgcaaagcagacaaagcacggcaaagcagaaatgggaaatcacctgagtgcgtcttaacagggaactggttacataaatgatggtgcattattgacaccctggcctgcctgaccatgggtcccacagctctcgtgcctctgaagcgggcctggcttgctgggacaccctcagggccaggaggccacagctgccccacctgcaccttctgtcgcgtggacgctccgcccctcactggctcctgccggcctcacccgtcacattgtgtaggacgcttgtgactgctctaaaaccacagggctttcaagctgtcccctccaaggtcccctcctgtgtccagcaccatcgtgactgcctcctgccgggctgcccctgcctggccctcaggtgcctgtggtttaaatctcctggcattgctgagcacgggtctggtgtgcagatggaggtgactgatgcgtaggaggaagctgatggacagttcgtcccttcgccagcagctgtgttgtgttcaaaggtggaaacaaaccagctaggctctcagtgaccccacccaacaggcatttcctcaacgtgactgtgacatccacagggtgggcctgcacctgccttgagcctctgcagcttgggatgcctcagcctgaggtgctgggatgatgccacctgggactgggtcccctgacctcctgggttctcccttaggtcccggccgccattctgcagagactcctgagtccgtgaagtggatccagggcctccaaccgccccagctgatctgccaggaaaggggtccctgctgcccgggggctgcctcggctggcgccacgtggagatgaagtgagccaacccccgagctcaaagggagggcttgggagtacacgagggccttgttgttttagggccacctaaaacaacaggttttaggtggccctagggttctgaggtgctttgcttcacagcaggagacaactcactggagcccgtggcacagcctgagggagacaactcacgggagcccgtggcacagcctgagggagacaactcactggagcccgtggcacagcctgagggagacaactcacgggagcccgtggcacagcctgaggggtctctgggttgcccacagcttccccaggagctcacacaggtcaggccaaggggaagggagcccagtgcacacccccaggctctgcggtccgaatgcttgtgttcccaaaaattcacatggaatcctcacctcccagagtgctccccagccccttccaccatgggaggacgcggcacagggtgccgttaccacctgggaagcacagcctcaccagacgcggaaactgctggagcagagaccttggcttccagcctccagcgccaagaggagcggattcctgtcgtgggccagcgtgttctgcgtggtggccgggatggaccgagactgggtagatgccatcctgactgctgacgtttgggacgtgagacatctgggggcatggggcagcccgctgcggccaggtggggtcatggggcagcccactggggtcaggtggaggtcacggggcagcccgctggggtcaggtggggtcacggggcagcccgttggggtcaggtgggtgtcacggggcagcccgctggggtcaggtggttcacggggcagctgggctcaggtggggtgggtgggatattcagccgcttccgattattttcagtaaattacttccaggccacacatatctcatttctcttctgaaaaacccgtctcaaaaactccctttctcttgatatttctctggccaagtctaccctgcaacacgctggtaaaatgtaaaattccttcgcacgagagtgaagaggatgatccccaggtgcgtctctccattcccgggtcctaacgattcctccttaagccggctacctgcgcgggggccacgctctcccactgggaggatggtttctgggacatgcggcgtctcctccttgtgcctgtgcgtctgagagaactggggcgtctccttgaactgggacgtctcctcctcgtgcctgtgtggtctgagagaactggggcgtctcctccaactggggcgtctcctcctcgtgcctgtgcgtctgagagaactgcggggtctcctcctcgtgcctgtgtggtctgagagaactgcggggtctcctcctcgtgcctgtgcggtctgagagaactgcggtggccccttgtgggcctcttggttctggggacagaggacacttttcactcagcccggggacctttggttctttctgtgaagatggcgcccatgagatgacgccttgtgactcaggtacctcagccctgcgcctccgtctctgcgtctctgtattgggttggtggcgtccacactgtctgcgtcgttgctgagcatcccaggtccccactcagcccggcctcgtgttttctcttgtcctcctgactggagttccagttcttaccttgcagatggtgcgcttgtcaccctctgccgtctccacagcatctgggccgggtccccccaggaactgggctctggtctcaggagctgtggccgaggtcggtggtgctggtgcaggagggcagagccgcgaaggcagcggggctgctgattgtttcattattactttttatatttgataagtgttagtgaattgatcactgcttctttcctcactagaggtgttatgtcacttaaggccgggcgcggtggctcacccctgtaatcccagcactttgggaggctgaggcgggtggatcacttgaggtcaggagtttgagaccagcctggccaacgtggcgaaaccctgtctctactaaaaatacaaaaattagccgggaatggtggtgtacgcctgtaatcccagctactcgggaggctaaggcagagaattgcttgaacctgggaggcagaggctgcagtgagccgggatcacgccatgcactctagcctgggtgacaagagcaagacttcatctcaatctgtacaattttactcttttaaaaggagtaaaaatatttttaaaccagactgggggaacttggggttcggtgtttaaaagcagttctgttaggaaggacctacactctgagattagaacaatgaacatcactcatttgacctcagtggagtcaacaaatcatggaggaaggcgtcagaattgttcccaggtgggctgcgtggccaagaggaggcacgagaagctgttgttgagggaacattgagcagctgatctctaggtggggggagacggcactctgcacaggctaaaatttaggtttagaaatcagccagtgccgtattccccagagagcagctgtaatttcttatggttcattttcatggagaaagttttaatctgttcatttaaagacacattgtgatcaataatcaagctcaggtacttaaaattagaaaccatatctgaaggaacattagttccaggagatttagattttttatatgccgctcaatgtttgattaatcttagagacaaaagctaaaagcacctctgcagttttcctcattcttttaggagcctggggtttggctgttggtgagagtctagcctggctccatagagctggaaaaacaggccgcgtccacaggccttcaggatgggactgttaggcctgcggtgtccgaccctcttcccatgcaggggcagggtttggtctccagggcactcctaaccttaccttgtggctttgcaggtcaattcttattgacctgtgactaccactttctgcagttccatcccatcttcccagggctatggtggtggtaggattttaggaatcgagtttactgtgactttatctgttctctgatttcctgaagaccggataggtgatttctctcacctgccagtgccagcctcctagggctgctgtgggacaaccacagtggggtggcttgaaacagggatgttcccccagttctggaggccagagtctgaaaaggtgtctgcagggtcgtgctttccctgggtgcgtgtggctggtgccaccccccggggtccctgtcctccaagcacccactggctctgaggtcacagaggaggccaaggacacctgggtgtgtctgtccctggccccagcactcaggtgcaggcagccgggccccatgctgggctctgtccctgcctcccattctctcacctccctgcttccccagcccctttgcatcagcacgaggccctgggcggactgaggtgcctcagggacatgggactctagagcgtcctctcatggcctggacccccagtgggcctggctgcacatcaggccgtttcctctgggctggtcttagccaccaggcagcacccatgggctcttaagtggtcatgtaattatcaagtcagtcgtgtttgctgagcccctgagatgtgaggacacagttctaagtgccacagggagggcctggttcctgccctctgggagggcctgatttgtcgggggagacaagatggtcacagaccattggcccaggaagaggggcttctgagcaggggcttggcccacagctttctctgctggggcgcccggagcctgatgagtggtcggtgctgtcagggcactgaggcaggtggggtgggggttctgcccagtaaacaggctcagggtatcctcttgtggttcatcgtgggtccccagataccacggtggatttcagatgcagtgaggggcgtgtggctgccaatacccccagatccttctgaatggcggagaacattaggtgtgcattgtgggagacacacaggatggagacaaacgactcgttcagtgatccccagagcaacgctgagggcgcctgagagggaatcacaaccccatcagcacagggtgacctgcctcagcccttaggtgtggggatggctgcactatcactgacacccacacccatgcccacgcctacaccatcacccatgcccacacctacagcctcgcccacacccacgccatcacccacacccatgcccatgcctacaccgtcacccatgcccacacctacagcctcacccacacccacactatcacctacagcaacaccgtcacccatgcccacacctacagcctggcccacacccacaccatcacccacacccatgcccatgcctacactgtcgcccatgcctacactgtcacccatgcccacacctacagcctcgcccacacccatgccatcacccacacccacatcatcacccacactctcaccatcacccacacccatgaccacgcctacaccatcacccacacccacatccacactcatgcccatgcctgcaccgtcacccacactcacatccacacccacaccatcacccatgcccacacctacagcttggcccacacccacacacccacaccacactgtcatccacaccctttcccaacttgagtgctctcctgtgccctggtgcactgaatgactgtggccacaggaggccagaagcccacacagaggacggaggggacatcagatgatgtgtaaggaaatgtgacaaaaggtttctccacaatgttttacggctcattctaagccactggaaaaatttcaagatttctatcacacactttcatattttgctgtaaactgatcttaccactgacattgtgaagtgaaatctattattattcatggaattccgtacccagaagaaggtctgctgtcacccaagaatatcactatgggtattattggtcctaaaggtgatgcctgtgcattacttttgatctgtaggtgggaagtaatgtagctgtgttgtttgtttggatcttttgatacaaaagatcatttttcattgatatcaaagggaaattgcaaagagaatgacctatttgtctggcggacacactttctgtaccttaatgatacatacaattctatccatttattctcattttaatacatgaaagtggcacgaagtcggagatcaaaagccagccagacattaatctcatggctgctcaaacagaactgcgtctattcccagagaaatttctaaacgaagaagcaaatatgaccacgggttcccggcctcgtgtgggatgagactcgtgctgtctaggagagaaaatctgtaggtttcactggttttagcacatccctaaaatgtatgagcagcacacatacctctggagccctggccaaagttagtggctgagcagaagacacgtgcttcgcctccataaagtcgtctgcgtggcacgtcagaagcctgcagtcctttcaacttccagttcccagggcatcatcaatcacgtcgcagcgattcctatttcacgtcatggccattctgacaaaacagcaggtttccttcgctcatgagtgcagtgagcggttcctggatgctgaccgtgtggagcactttgtacctcgtgggggtgtaaagaagcctggcaggaagcctggcaggtgggcctcaggcagatggaaaggtggggacagttggaagcagccccttcccgcgctggggcctccccgtggtgtagacgtctcctcgggacgagtctcagtggagccatcatagccaagtcagccggtgcttgaaggctgctgcagctagcacctgggcaacgcggaggctgtacttgccagcctgtgccagggaggctctgggcactctccctgccagcccaccaaggtgttgccaatggcgctgtgaggggttcaaaacccttgtcctctcctgctgtggctcagcctcccatcgctccctccctccctccctcctatctatcttctatcatctgtcgatcagtcatctaatctataatctatcatctatctaatctatgatctatcatctaattttcatctatcatctatcattatcatctatcatctacctatcatctgtcatctattatctgtcatctgttatcatctatcatctattaactatcatctgatctataatctatgtatcatctgtcatcttcatctatctgtcatttattgttctatgtatgcctgctatgtgctgtatcatctatctgtcatctctatccatctatctgtctgtcatctatcgatctatgtatgcctgctatgttcctgcacccactgtgccagacactgaatgcatgacgtggaatgagacaaggtccccacctgccagaagcttagagtttggtgggaagcatggattctaaggagggtgagggcctcccgggttcagacagtggactcccagcagcctcaaatatgttatttctggacgagaccatggtatgctgctcacagtcagctctcgaaagaaagaaacaatcacgtgtgtagctttccaatttccatggtgtaagcaccatcactgtggccaatttcaagggcccagtgtgaggtcactgagcaggtttgggcagcgatgaaggggtttggaaaacagcaggattttgtggtatttccaccacacagatataagaggtgtaaataatttcaagagcacaaataacagtaaaataatttggagtggtgagttttgagtacctgttacctttgttttactatatttagttctaagtttatgtaatttagtttttaataatgacttatttgacaaccacctttcaaaactgcctgcacatctcaccatggccctcaggatgacgctggctcctgtgcatcctgcgccgggcatggtgcctcacgtgaggtcatttccacggccacgtgtgtcctcctgccgcttcacagacggtgacttccacctccatgtcctcagactccactctccacagagccctgactgtcattaactccctgacttagaatatttcatccgtatttgtgtatgaagggtcctttatgttgaatgttatttaagccctaggtttaatttttgtttttgtgcaggatagaaaacagatgaacacatacgttatcagatggtctctctgtacaaataatgcacggcccagatgcttatggtctggaatcattagcataacatatgctgctgctcagaaacggcaagtgcggcgcaattctgaaacagctcctgccttagcaggtacatcctggtctatgctcaggtctgattttggcagatacacaagtaccttcttgccaaaggctgtgtccccatgtcactgcttgtgcctggcccagagcagaggctccgagtggtggcaccacttctgtcattgtcgggaccatggctgcccctcctccccctcctgctaaaccaacaagggctgttgactgagggcccccgagggccactgagtgcaccccacagtggcaggcaccctgcaaccaagtgtccctgagtccaccccaccatggcagacaccctgcagctgagaggccctgagtgcacctcactgtggcaggcaccctgcagccaagtggccctgagtccacctcaccgtggcaggcaccctgcagccaagtggccctgagtccaccccaccgtggcaggcaccctgcagctgagaggccctgagtgcacctcactgtggcaggcaccctgcagccaagcggccctgagtccaacccaccgtggcaggcaccctgcagccaagcggcactgatgagcccttggaggtcagaactcagacgcagaagcagacagtacctggaactgaacccctgcaagctccatgcagagaacagcgtggcagcactcgaggagggaaaggctttggggaagagggagggaggcagaaggagcagctcagggagctcatcaatgagggagggtgagtggagcagagatgaagagatgagatacacacagccagggaggaggatgagatggagagggagagacagagacacagaaagacagagacaagcagacaaggacagagataaaaagacaaagagagacagagatgggcacacagagaaagagacagagagacaaggacagagatggagacaaagctagagacagacagggagagagatacagagagacagagggagagacatagagacagacgcagagacagagagaggccgagagcgagaggaggagggagaagagatgatggggacaaggggaagccaagtctaagacaggagagaaccagtaccagaaccagaaggtggctgggcttcgaggggcctgggccagtggctaggggcatttcaagccttgcctgtgcccccacacctgggcacccccctgtccactgcacccctgtcctgtcaccagactcggggatgaagcacttgtgaatggagagagaggacgcaactctgttctaacccggcaggtgcttaggattaattcctggacaaattcaggaattctcactctagctgcccagagccacgggtgtgacaatttccacaaacttgtattctgttttcaaaaggagtctagaatcacccccaaatcccggacactgaaagcccctggccaggaagcagtgtagacctttgtttttcaaggagattttgttacagagagacaaccctgccccttgagtggccactgagtgcttggacctgccagcgttgtgtgggtttgcatctgtgtccagcatctcgtgggtttgcacctgtgcccggacctgccagtgttgcgtgggtttgcacctgtgcccagacctgctggcatcgcgtgggtttgcacgtgtccagcatcatgtaggtttgtacctgtgcccagacctggcattgcgtgggttcgcacctgtgtccagcgttgtgtagctttgcacctgtacccggacctgccggtgacacataggtttgcacctgtgtccagcatcgtgtaggtttgcacctgtgtccagcgtcatgtaggtttgcacctgtgtccagcgtagtgtaggtttgcacctgtgcccggacctgctggcgttgcatgggtttgcacctgtgtccagcatcgtgtaggtttgcacctgtgcctggacctgccagcgttgcatgggtttgcccctgtgcctggaccttctggcgttgtgtaggtttgcacctgtacccagcgtcacgtgggtttgcacctgtgcctggacctgccggcgtcgcatgggtttgcacctgtgcctggacctgccagcgttgcgtgggtttgcccctgtgcctggaccttctggcgttgtgtaggtttgcacctgtacccagcgttgcgtgggtttgcccctgtgcctggaccttctggcgttgtgtaggtttgcacctgtacccagcgtcgcgtgggtttgcacctgtgcctggacctgccggcgtcgcgtgggttcgcacctgtgtttagtccaccatctatggatgttgaagatcccagggacggccaagtttcaattctgtaggtgctaatttacttcatttttctggggcaccagagagtaaatttagaaacccaatgctatcttagggcaccaagagaatttcagttgaggtgaaaattactgctttttcctcatcatgaatagatgaaaacattgtaaaggaagaatacattttcttttgaagaatgagctatttgtcgacaatgggctgttccctttgatgcagaaaccacggctttggtccactgtcattaggctgaccctgtggctccccagccaggagtgcccagagccaggaaggaaagggcaccattttccccagctctcccacgatttccatgagaaggtggaaccattgttgttagggctggggtttcatctgcctggagtccagaagccggtctgtgtagatcccggggagcagagctgtaggggcctgcaggggcgggggcaggtgcggcgggggtctcccgttttctcctgggccctgtgtcccctgatgtcacccccctgacctccagccccttgggttttgtggacgggccagggcccagcactcgggcttaggatgggtaaacagttgtcctgttatctgttgggcatatggcaggtgcctgtcccatgcaggcactgcctgccccatgggcatctgtctgtgctagaacccctgggtggctgcgttttgaagaggattttacgggggctggctgtgcgcaccctctcccttctctccgttctctccccagatcgtgctgtggttgtagggagcccaggaccccatgggcacaaaagcctccatgcaagcatcagaggtgatgccccgggtcctgctcaggccttcggcttcctggccctccccactcagcctccttcctgcacatcctggggaccaacctttgcatctcctgcctggctccaccacaaaacgtccttacagagggtctcagggccacagcctcgttgggagttgggggtggcacccggagaccacatttgcaccaaatgcgctgttttcactccagctgcagatgacagaggaacaggacgaccagagtgtccaagggtgttctgggtccctcaacccagacttcctgtgaccacattgttgttagtttatcaggcttgtggggaattcatggctcttttagggaaactcatgctgtccccacacctgtgacccctattttccaaaccaaagttacagaaatgtcctgcattggggatggcgctttcagggcgtcagaccaatgtgggggaggtctaggggcttcagatcaacgttggggaggtcttagggcctcagatccacgttggggaggcctcagggcctcaaatccacgttggggaggcctcagggcatcagagcaacgtgggggaggcctcggggcctcagagcaacgtgggggaggtctcagggtgtcaccaacgtgggggtgtcaccaacgtgggggaggtctcggggtcagatcgaggacggagaggtcttgggacattagaccaaggttgggggaagtctcagggcatcagactaacctgggggaggtcttggggcatcagactgaggttgggggaggtcttagggtatcagactgaggtcaaggaggtctcggggcatcagaccgaggttgggggaggtctcggggcatcaggccaaggtagggggaggtctcaacgcgtcagaccaaggttgggggaggtcttgggcagagcagctcaggagcttggggcgtggcagcgactggaggtgctgggagggaggcgggtgcccattctgcagcttcctgctcctctgcacagagctcagccgaggcctctcatcccgagacctccacatggaggctttgaaaactccatccaagaagacaatatctcgggatggtaggggaaaggtgttccacccagctgacctcaaggcctttggctgtccctggacattagtcaggtttttgtggaaagcccagtggggagggaggccctggcttctcgttagcctatggccaccccgactggccggcagcctcaggccaggctgtgtttgccccatgcagccacagcctggggttgccgggccttgctcggggctgtttgcctctgcagcggcagcctcgggtggcagggccttgctccctcagggactcggggtgccttggcctcagggtgtgggactgaacatgtggaatggctgtggagttccacggctcaggcacagggccctgaccgcatgtgcccagcatcactgacctcaccagaagtgggatgcagggagcctggggcttggcactccccaccggccgcagccaacatcctcgagaggaagccgtgggcctcacctggcgatcttgtccgtgcaggacatggtgatcagctgctcccccagcaggacgccgtcccaggtctgcactgcgctggggccacgcacggggaccgtcccttccccggactcgatcttggtgcgcaggtgcccgcggaacttcctgacgaggtgtttgctgctgtgcactaggagataaaagggcggggaggggtgagaagagggaagccgccttggttttgggaggtgggagaagaggaaggactgcaacagaggtcaaagggcccctcaccatggctgggcgtttggcacgaggaaggggcttcagaaataagcgccatgtggggttgggctccagagccacaccatcccgcctgggccgggccaacttcccagtcaagggtcagggagtaaaaaccccaggcttcatgggccagactctcttttcaccaacacccgcctctgttgcgtgagtgcagccacggcctggaccgtgctcaggccagtaaggggccaccgcgtcctcaatgcttcatttacagatgcagacttgaacacgcagttggacgtgtcgttttcagaggttgtgaaacaccgtttttctcacttttcagccattaaaaatgtaaatatttatgcttagctggagggctgtgcagaaataggtggtgagtgggactcagctcttaccctggtccaggtgtcagtcccggctccatggtaagctggctgtgtaaccttgggaaagtgtctcaaagtcactgtgacccggttacttcctctaatgacgagggtaatagcagtgcttgccgcccaggctgtgaggagtcggtgaggtggctcctgtgaaggtgctggggttgcctgggcacctccactcttgctgtgtcccctaattaccaagggtcgccatgggcaggagctccgccaggcccagaagtgacggagcgtctggtgggtctctgtgggtccctcaggtgttctgtgttctcctttctagggtccccttgacaccccccgcccccctataccacattccccacaattacttggagaactagcatgagcaagaggaagcttaaatttatgtttctctttctttgaaaaaattttgtatgtttttgttttgttttgtttgagatggagtctcgctctcttacccaggctggagtgcagtggcgcaatctcagctcactgcaacctccgcctcccaggttcaagagattctcctgcctcagcctcctgagtagctgggattacaagtgctcatcaccacacccagctaatttttgtattttcagtagagatggggtttcgccatgttggctaggctggtctcgaactcctgacctcaggtgatccgcccacctccgcctcccaaagtgctgggattacaggcctgagccactgcacccagccaaaatcttgtacattaaatctggattatattgtaatatggaaatggcccactgctttgcatttgaattatatataaaatagtatagtgattatatcatttacatacatatgataacgtaagtgaatattaaatgctttctttagaaagttcctattgaagttttagaagctgtggaaatgcaatttccccctcactttcccccactgacagtgcttgatatggctgggatccgtgtccccactgaaatccatgttgacatgtaatccccagtgtcggaggtggaatttggtgggagatgactggatcatggggcggatttctcatgcccagtttactaccgtccccttggtgctgtcctcgtggcagtgaattgttctcatgagacctggtcatttaaaagtgtgtggcatcagccgggcacggtggctcacgcctgtaatcccagcactttgggaggcagaggcgggcggatcacgaggtcaggagattgagatcatcttggctaacacagtgaaaccccatctctactaaaaatacaaaaaaaaaaaattagccgggcgtggtggcgggcgcctgtagtcccagctactcgggaggctgaggcaggagaatggcctgaacccaggaggtggagcttgcagtgagccgagattgtgccactgtactccagcctgggcgacagagcaagactacgtctcaaaaaaaaaaaaaaaaaaaagagtgtgtggcatctcccccgccctctcactcctgctctggccatgtcactttctgccatgattgtgagcttcctgaggcctccccagaagccaagcagatgccagtatcatgcttcctgtatagcctgtggaacctcaagccaattaaacctcttttctttataaattacccagtctcaggtgtttctctagagcaatgtgagaatggactaatacagtgctgaatggtaactaatgcttgggtttatataggaactttctcctaaagatcccaagtaatttccagtgtattttctaattgtctgtaagagctgacattctttcactatacattcatagtacttaaggctatgccttgggaagaaagatcgctgcattctttggagaaaaaaccctttgagaggcttcagatggcttttcactttgtaaccaactagatacttgatgagataaaatttggaccggtctttgagtcattcacggaaaaaagagcgaatgagaggtattgagcctgggcaggcacagcaaataatgcccagctcttccccagataaagcacaaatctcttctttgcagctttaatggtgatggtgatgataatggtggtggtgatggtgataatggaggtaatggtggtggtgatggtgttaatggaggtgatggtgatggtgaagataatggtgatgatggtggcggtggagacggtgatatgatggtgaagataatgatggcaatggtgatgatggtgatggtaatgatggtggtgatgatgatggtgatggtgatgatgatggtaatggtggtggtgatgatggtgatggtgataatgatggtaatggtggtggcgatgatggtgatggtgatgatggtggtgataatggtgatggtggtggtgatggatgatggtgatggtggtgatgatggtgatgatgatggtaatggtgatggtgatgatggtggtgatgatggtaatggtgatggtggtggtggtgatgatggtgatggtgatgatggtggtaatggtgatggtggtggtggtgatgatggtgatgatggtgaagataatgatggcaatggtgatgatggtgatggtaatgatggtggtgatgatggtggtgatgatgatgatggtaatggtggtgatgatggtgatggtgatgatggtggtgataatggtggtggtggtgatgatggtggtgatgatggtaatggtgatggtggtggtgatggtggtgatggtggtaatggtgatggtggtggtgatggatgatggtgattgtggtgatgatggtgatgatgatggtgatggtggtggtgatgatggtgattgtggtggtgatgatggtcgtgatggtgatgatggtggtgatgataaattgaacataaaatagttcgtatgactcaaaacacttggtttaaactgactttttgcaggtggggtctttatgaacatcaactttctgcggaaggcaacattgaaagcatggaggagccatcacacctaacagtttccacaacattaccacaatattagggactttactctttcatttgggggatattttctcagggaatgtggttgttgctgtccctccatttctgttatagtattcttatattctcccaacgttttaactattgtggtctttttcgagatcttgaaagttgcctattatattgtaaggcctttctaaatttttaccagttgctactgcacaactaactttccatgaagtacacttgatagcctgttaatgccatgacaacagggaggccctgctttaattaacagctagttcctaggagttaacccaaagctttcaggttagactaattttgcctgaggagccaggtgcatgagttgctcctgagtgtttatttttggaggtgttcagtcttgggatgccttctccacaggctccctgatgagtttgagcagccccagggtggcttgaatgtcggtgatcctgcagagcccatttcctctggctctttcctggctaattgtgagaggtgggaaggagttgaagatgccacttaaggctgacaaaatgccagtccaaccagcaattgcagtgagctggccataaatgatctgtagtggatttagagtgtgcctgagacagtgaaagtgtagaacctcaaactcctgactgctgtgtctacatagatgctcacaaatccatccaaacattctggtccaattctgacagtccaagtcatcagactcttcattacagtgcttattaacctatataaaaccctagataaaacccttgtcttttgaggtcaatatcaaggtaaataaggatagtttttagatgctcatttcttttttttttttaattttattattattattatactttaagttttagggtacatgtgcacaacgtgcaggtttgttacatatgtatacatgtgccatgttggtgtgctgcacccagtaactcatcatttagcattaggtatatctcctaatgctatccctcccccctcaccccaccccaccacagtccccagtgtgtgatgttccccttcctgtgtccatgtgttctcattgttcaattcccatctatgagtgagaacatgcggtgtttggttttttgtccttgcgatagtttgctgagaatgatggtttccagtttcatccatgtccctacaaaggacatgaactcatcttttttttatggctgcatagtattccatggtgtatatgtgccacattttcttaatccagtctatcattgttggacatttaggttggttccaagtctttgctattgtgaacagtgccacaataaacatgtgtgcatatgtctttatagcagcatgatttataatcccttgggtatatacccagtaatgggattgctgggtcaaatggtatttccagttctagatccctgaggaatgaccacactgacttccacaatggttgaactagtttacagtcccaccaacagtgtaaaagtgttcctatttctccacatcctctccagcacctgttgtttcctgacattttactgattgccattctaactggtgtgagatggtatctcattgtggctttgatttgcatttctctgatggccagtgatgatgagcattttttcatgtgtcttttggctgcataaatgtctttttttgagaagtgtttgttcatatccttcgcccactttttgaatggggttgtttttttcttgtaaatttgtttgagttcattgtagattctggatattagccctttgtcagatgagtaggttgcaaaaaattttctcccattttgtagtttgcctgttcactctgatgttagtttcttttgctgtgcagaagctctttagtttaattagatcccatttgtcaatcttggcttttgttgccattgcttttggtgttttagacatgaagtccttgcccatgccaatgtcctgaatggtattgcctagattttcttctagggtttttatggttttaggtctaacatgtaagtctttaatccatcttgaattaatttttgtataaagtgtaaggaagggatccagtttcagctttctacatatggctagccagttttcccagcaccatttattaaatagggaatcctttccccattgcttgtttttgtcaggtttgtcaaagatcagatggttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggtgatgtgggctcttttttggttccatatgaactttaaagtagttttttccaattctgtgaagaaagtcattggtagcttgatggggatggtattgagtctataaattaccttgggcaatatggcctttttcacgatattgattcttcctgcccatgagcatgtattgttcttcgatttgtttgtgtcctcttttatttcattgagctgtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgagggaattttgggctgagacgatggggttttctagatatacagtcatgtcatctgcaaacagggacaatttgacttcctctttttctaattgaataacctttatttccttctcctgcctgattgccctggccagaacttccaacactatgttgaataggagtggtgagagagggcatccctctcactgtcttgtgccagttttcaaagggaatgcttccagtttttgcccattcagtatgatattggctgtgggtttgtcatagatagctcttattattttcagatacgtcccatcaatacctaatttattgagagtttttaccatgaagggttgttgaattttgtcaaaggccttttctgcatctattgagataatcatgtggtttttgtctttggctctgtttatatgctggattacgtttattgattttcgtatgttgaaccagccttgcatcccagggatgaagcccacttgatcatggtggatgagctttttgatgtgctgctggattcgttttgcccgtattttattgagaatttttgcatcaatgctcatcaaggatattggtctaaaattctcttttttggttgtgtctctgccaggctttggtttcaggatgatgctggcctcgtaaaatgcgttagggaggattccctctttttctattgattggaatagtttcagaaggaatggtaccagctcctctttgtacctctggtagaattcggctgtgaaccccatctggtcctggactttttttggttggtaagctgttgatcattgcctcaatttcagagcctgttattggtatattcagagattcagcttcttccttgtttagtcttgggaggatgtatgtgtcgaggaatttatccatttcttctagattttctagtttatttgcatagaggtgtttgtagtattctctgatggtagtttgtatttctgtgggatcggtggtgatatcccctttatcattttttattgcatctctttgattcttctctcttttcttctttattagtcttgctagtggtctatcacattttgttgatcttttcaaaaaaacagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcttcgaatgtgtcccagagattctggtatgttgtgtctttgttcttattggtttcaaagaacatctttatttctgccttcatttcattatgtacccagtagtcattcaggagcaggttgttcagtttccacgtagttgagtggttttgagtgagtttctttctagtttgattgcactgtggtctgagagacagtttgttataatttcggttcttttacatttgctgaggagagctttacttccaattatgtggtcagttttggagtaggtgtggtgtggtgctgaaaaaaatgtatattctgttgatttggggtggagagttctgtagatgtctattaggtccacttggtgcagagctgagtttaattcctgggtatccttgttaactttctgtcttgttgatctgtctaattttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgaattgatccctttaccattatgtaatggccttctttgtctcttttgatcttcgttggtttaaaggctgttttattagagactaggattgcaacccctgcctttttttgttttccatttgcttggtagatcttcctccatccctttgagcctatgtgtgtctctgcagctgagatgggtttcctgaatacagcacactgatgggtcttgactctttttccaatttgccagtctgtgccttttaattggagcatttagcccatttacatttaaggttagtattgttatgtgtgaatttgatcctgtcattatgatgttagctggttattttgctcattagttgatgcagtttcttcctagccttgatggtgtttacaatttggcatgtttttgcagtggctggtaccggttgttcctttccatgtttagtgcttccttcaggagttcttgtagggcaggcctggtggtgacaaaatctctcagcatttgcttgtctgtaaagtattttatttctccttcacttatgaagcttagtttggctggatatgaaattctgggttaaaattcttttctttaagaatgtcgaatgttggtccccactctcttctggcttgtagagtttctgccgagagatcagctgttagtctgatggggtccctttgtgggtaacccgacctttctctctggctgcccttaacattttttccttcatttcaactttggtgaatctgacaattatgtgtcttggagctgctcttctcgaggagtatctttgtggcgttctctgtatttcctgaatatgaatgttggcctgctttgctagattggggaagttctcctggataatatcctgcagagtgttttccaacttggttccattctccccatcactttcaggtacaccaatcagacgtagatttggtctttccacatagtcccatatttcttggaggctttcttcatttctttttattcttttttctctaaacttctcttcttgattcatttcattcatttgatcttccatcactgataccctttcttccagttgatcgcattggctactgaggcttctgcatttgtcatgtagctctcgtgccttgattttcagctccatcaggtcctttaaggacttctctgcattggttattcagttatccattcatctaattttttttcaaaacttttaacttctttgccattggttcgaatttcctcctgtagctcagagtagtttgatcgtctgaagccttcttctctgaactcatcaaagtcattctccatccagctttgttccattgctggtgaggcactccattcctttggaggaggagaggtgctctgatttttagagtttccagtttttctgctctgttttcttccccatctttgtacttttatctacctttggtctttgatgatggtgatgtacagatgggtttttggtgtggatgtcctttctgtttgttagttttccttctaacagtcaggaccctcagctgcaggtctgttggagtttgttagaggtccactccagaccctgtttgcctgggtatctgcagcggtggctgtagaacagcagatattggtgaaccgcagatgcttctgcctgatcgttcctctggaagttttgtcttagaggagtacccggctgtgtgaggtgtcagtctgcctctattgggggggtgcctcccagttaggctactcgggggtcaggtggaggcagtccacccgatctcagctctcaagctgcatgatgggagaaccactactctcttcaaagctgtcagagagggacatttaagtctgcagaggttactgctgtctttttgtttgtctgttccctgcccccagaggtggagcctatagaggcaggcaggcctccttaagctgtggtgggctccacccagtttgagcttccaggctgctttgtttatctaatcaaacaactaactcggcaatggcgggcgcccctcccccagcctcactgccgccttgcagtttgatctggactgctgtgctagcaatcagcgagactccgtgggtgtaggaccctccgagccaggtgtggaatataatctcctggtatgccattttttaagcctgttggaaaagtgcagaattagggtgggagtgacccgattttccaggtgctgtctgtcacccctttctttgactaggaaagggaattccatgaccccttgcgcttcccgggtgaggcgatgcctcgccctgtttcagctcaagcacggtgcactgcacccagtgtcctgcacctactgtctggcactccccagtgagatgaacccggtacctcagttggaaatgcagaaatcacctgtcttctgcgtcgctcacgctgggagctgtagaccggagctgttcctattcggccatcttggctcctccccctagatcctcatttctaaatgaggatgtgctttagaaaattgttcaagtgaatcttttatttttaggggagaatcaaaaggaattggagacaaacaacaagaggtttgtcccctggggagctaaagatttatctaaaaagcgatgcatggttgctaccatcacaagggggagagagagcaccaaaaatgaaacaaaccacaggcatgagaaaagaagaaaatatttttaaacaccaaataaattttagattttcaaactgtcttcaaaaggcatatcccagaaagtctgcctgtgaagcaacctagtattcattgtaataataatatccacagaagttaccatgtgtccacgtgggtgcactttgccatatttgattgatgatgatgatgatagtgatgatgctggattataaggccattaaaattcattatcctgcaatgcacggatattatcatattttgcatatttctgtaactcaatgggaaaatctgaagcaggaatttaaggaactgtattttatattccctgacttcctatgggattttcgttaaatctcttcaactacctttctagtcgttgaatggaattggcttagaacaaacgtactaggctcatagcatgtacttgtaggtaaatatatgacatcatctatttttcttggcattttctggacacagactggagaatttaagctgctaagttctcagaaaatggctgtaagaactgagtttaccaggttatttaaaaaccatgccaagaaagaagaatttgcaggcaggtcgttggtgggttgggaggagaggagctgctcaaccacagtgaagtacagagatcctcatcttctgctccatctgggctctttcagaactgcctgagttctatcccaggcctcccagggccactaaaggacccgtcgccctcgtgagtctgtgctgacagcagtcattggaaccctgactctaacatagacacacacagcatgttctcctggtgtgggaataaatgtctttcaggcatttgtccctgccttaactgacctggcccctctaggtccaggggaaagccacagatgtggcagttttgagtcgcttgagatgaatggagtagccctgggtcacatgacattgaagactgagtctgcggtctctgtcgcgaaagcagctttcccctcggtcgcatgcgatgcaccacgaacacttttcattcctgcctgtgatgccacagagcggggagtccagccataagctctgcctggcctctgcagacaggcaggctaccaggccgtccatgcctccaagccctttctacaaagccagcaaggaaacaaatgcccagtctgaagagatgatttaaggagttcaaacctgctggctcaaaacccgacctgtgctcagaaaactagagtcttggatgcccctctgccccgaatgcatcagaatctcggccagagtgcatggggtgagctgcattggtaaacactggcctgggaccctgatagataagccagagctggaaacaacaaacttgaatgccttccgaagctagcaggtgacacagctcccaaaatacctgagaccaattggcattgataccatgtctgaggcctccaggaatggggaatttatgatctagacaaatgtttttgaggggaaaaataaaatagggccatctagaatttctcgagccacatgcatcccaggaaagtggggctggatggcaaccccagggcccttgtgttgtgtctaagacttggagcccctgagcctgggcctcgggtggctggggcttggggaattcctggtcctgctgagctgttggagcaggttgctgccgggagccagctgctcagcagccaccagagagtcagaagtgtgctcctagaaaccccaagtcagactcacttctctcctgggcctttacatgatacttactatcatgattatttaaacctatctacagaaattttttcttatgccctactctgtgttccttcatttttaaaagaagggggaacaatcttgggcaccaaacttctttttgacttaatcacgtcatagttatattgatagatctgatgcatcagatacgtgtcgtgtgcttgtgtgtgcacatatgcttatgtatgtgtttgtgtgtgcacatgtgcttatgtatgcgtgttcatgtgtgcacttgtgcttgtttgtatgtgcacgtgattacatgtgtgcacatatgtgcttctgtgtacatgtgtttatgtgtgtgcgtgtacatgtacttatgtatgtttttgtgcacatgtgcttacgtgtgtgtgtgtgtgtgtgtgtgggtatatatgtgtgagaaagggagaagtctggcacagttgagagaggggctagcaggcgtggccactgtggagatgcacaatcgctcgatgcaggccaaaggggagactgaggaagggatgagctcaagtgaccaggaccaagcactgtgctggtgagaggagacatggcaggtccagaaggggccagaggcagagagcactcgagaagactgaaacctctgtgcagagtctccttcggtttcagatgagctcctctggcccccagcaaaggtctcggtggaggggactgagctctctgcactctgcggcctctgcatttgtgagaataacatcatggccctcagggcttcctttgttccctgggcttcttttgggaatgtggtcctctgaattggaggggcagtgccgctgggtttctgcagggttaatccataggagggaggcagtgccagctgcagacctctgggaacagtgcaaactggatgtgtccagctcccgccgccagcctttcctttgggggcttgtcaccatcgacactgcccttggctagccctggaggagcccctcacagcaaaagcctggccactggcatccccttatccatggtccaaccctctttaaagggtaacaaagacatacaccgcctgagttagcaacgtggagacccctgcctcttattgtaaaggagcttaaagcatctctctgcaggggaaatggcaggagttgttcctgaaggtctctgccttcctcaggcagttcaaaggatgcagagccagctctctgaagggtccttccaagcagagaacagcaggaacttgagttctcctgcctttactgagtgactttggcagatgagtccctgttataggagagttcaccaagtaccttccttctccacgctctccagatgggagagcggaggagtggcaccagcccaatgcagaggcacagcacaggcaggagtttctcaattttgcctggcatatctgctgcaaaaatgtgagaaaaatgctttattttttctcctaccagcacctgccacttcttaaaagcaccatgaaataaaagacatctgtgtctggaagtgaacctcagggtgcctcggagaacgtatttgtttttctaaagcacagacactgcagtagaaagtgagggctggctggagaggctgcagttggtgatcgatgtacagagatgtgggaggcccagtggactagaactgtcccctggggagaccacggggtctcaggcgtggacaaggctcctgctgttctcactcagccctctcccaactcccaccagggacacattagccaaggaagaggctggataactcagcgccaaccccaagcatttggcgggacttttcctctcaattctgagggttcctagctgggtctttacgatgccaaccctttaaagaagaatggaaagataattcccagtagctgtccaatggaccagatttcacaaaattcccaatagctgtgcagtgtaccagatttcacagttttatagggtgagctggtatcatgtagctctggcttgctgaatatgtccagtgaaaatgaagccactcctggtggtttttctgtctctctcttcctgagttggcctggtagtggggggtgccctgtgtgatcttgtggggccacactgggctcccttccctctggggagggctgtgtccacttctcaggtactcaggctgcccctgcctctctctccctactgcaggaagttcctttaaaagtccctgaggttgaacaggcttccttttcttcattcccagtttgacgggattctctcatttaatttccaaagggtgtggaaatactacccaaattcaaattcacttacagagaaccctatccagccatgccagaggatccacttacagagaaccatatccagccatcccaaagggaaagcagtggggctggagggaagtccgcaaaaaggaggaggaatgtttctgggccagcatcccatgtgaggactgcagaatcaggctaagctcgtgtgagattaaagacaccattatccccacaccttcttgtctttggtggaggctgcatgacaagcctgacaacagcagggcataacaaaaatgcttaattttccttaccttggtaattaaaccaccatgtagccttccaccggaggagagtcaggccaaagccaagccttaatagctgtgtgctgtccatgtatgtctgccagagatttcctccctcatcaggactggactcctcatcatacacatatcacatacaccacacacaccacacacatagcacacacaccgcacacacaccgcacacatagcacacacaccacatacaccactgcattgcctgcattgaaagatctgcctggagctgcttctggaaagggtgtgggagcatgtgaatgtgtgtgcggtgtatgtgatatgcacgtggtgtatgtcgtatacatgtgtgttgtatatgctgtgtgtggtgtgtgtggtctgtgtgtggtgtgtgtggtatgcgtggtatgcatgtgcttgtggcatgtgtgtggtatatgtggtgtgtgtttgcagtgtatgtggtatgcatgtgtggcatatatggcatgcgtgtagtgtacatgctatgcatgtgtatgtggtatgtgtgctgtgtgtgatgtgtggtatatgtggtatgtgtgtgtggtgtatgtgctatgtgtgtggtgtgtggtatgcatgtggtatatggtatgtgtttgtggtatatgatgtgtgtggtgtatgtggtctgtgtgtggtatatgtggtatgcatgtggtgcttgtgacgtgtgtggtatatgtggtgtgtgcagtgtatgtggtatgtgtgtagtgtatgtgacatgagtgtagtgtatgtggtatgtggtgtgtgtggtatatatggtatgtgtgtggtgtatgtggtttgtgtgtagtgatatgcatgtgctatatgtggtatgtgtgtggtatatgtggtatgcgtgtagtgtatgtggtgtgtgtgttgtatgtgtgtggtgtgtgtggtatacatgtgtggtatatgtggtgtgtgtgtggtgtatgtggtatatacatatatgtgtgtgacatatgcagatagcactaagcaataggatttcatcattaaaatgaaagagaggagtttccctgaagcaccttttcttttatcatggagttgctgatgtcaagggtggcttcaagggagagccccaccctgccccacgccctgccctccgaccctggcaatcgcagcatcactgccctttgctgatggagaggacagaggggcaggggctgcgtggatgcgttctgtctcacctccatcgataaatgctcacagggcgggtttccagtggaactttgtagttcacctggggaaacccctttgcagggaatcactcatccctggcttggttgcaaaagctgagcttttttcctccccaacgctgtaagcaaaggcaagcagagccagtgagaatttgctcccagcctgcgtaactctcactggccttcccttcattccattttcccagcccaggacacagggattgtctgagttattaaagcagagaactatggcaattaggtagctaattttaggcctcagactactcttctgccaattacttgagcatttcagactaagattttggaggcatggttatcccactaattgtagacgcaatccccttccagtacccaagggccccacacaccgcgcccctgccctgggctgtgaaagcccaggacagagtcccagatagagggagctgggggctgttggcctacagaaggtaaaagcatggtctcttacggtctgtggtgatctcgtagggagagtggagtcttgcgtctccacagggggaggtgctcacgtagagatggaagaggatgttctctcgcagccggtagccaccttcttttaaccgcacgaatatcgatcgctctgagtcctcgcgccgcttgctagggtcacaaagaggtttggggtcatttatcacaaaccaaaccagaaatgttccaaccaggtgaacgcttgagtcctgttttgtagagttgttccccaagttttcctttatatttttccttttttttttttttttttttgagacggagtcttgttctgtcacccaggctggagtgcaatggtgccatatttgctcactgcaacctccacccactgagttcaagcaattcttctgccttgagtatcaagtgttactcagcctcccgagtagctgggattacaggcatgcgccaccacgcctagttcatttttgtatttttagtagatacagggtttcaccatgttggccaggtttgtcttgaactcccagcctcaggtgatccacccacctcagtctcccgaagtgctgggattacaggtgtgagccgctgcgcctggcccccaagtttctccttcttcacaccccatagtgtgtctttcccctgtaccaacacttctagaacaggcagcaatgaaactacgtgaatgcgaacatgactggcagaaaccctgctttcttacccccgccttgacatttacctgtcagggttattattattcttttctaaagataaggtctttctctgttgctgctcatgctggagtgcagtagcgtgatcacggctcactgtagcctcagcttcctgggctcaagtgatcctcctgcctcagcctcccgagtagctgggactacaggtgcacaccaccatgcgaggctaatttatttacttttttttagagacagggtcttgctttgttgccccgagtggtctggaacttctgagctcaagcgatccacttgccccaggctccgaaagtgctgggattacaggtgcgagcgaccatgatctttttttttttttttttttttttttttgtgacggagtcttgctttgtcccaggctgcagtgcagtagtgcaatcttggctcactgcaacctctgcctcctgggttcaaacgattctcctgcctcagcctcctgagtagttgggattacaggtgcatgccaccatacccagctaatttttgtatttttagtagagatggttttgccatgttggccaggctggttttgaactcctgacttcaggtgatccacccgccttggccccccaaagagctgggattacaggcgagagccaccacactgggccccaccatgatcttttaccaagccattttttcccactgctgttcgcccacatctatctgtctacacacctgtgattctgtggatttgccagtgctgctcatggccatacctcacagtggactgtgggtttgacgtagcctgagtgggcagcttgtgtgtgattaaaaggaggaaaagagctgtaggaaggcctgggctccgtcaccagcacaggtgggagtggagaaccgtggcgaaacggctttccttctgcatccagccatgacccaggtggggcgggagagttcccagcctctctgatggtgaatgatttgcctgttgcaaaactcccaccagctgtgaagctggagctgagcagccccacctctgccccatcggagtgggcgctgaacgaacatgcctgcatttccttcttcggtgtttaccctctgtctcccggtgtttactcccccctccctcccggtgtttactcccccctgcctcccggtgtttactcccctctgcctcccggtgtttactcccctctgtctcccggtgtttactcccccctccctcccggtgtttactcccctctgcctcccggtgtttactcccctctgcctcccggtgtttactcccctctgcatcccggtgtttactcccctctgcctcccggtgtttactcccctctgcctcccggtgtttactcccctctgcctcccggtgtttactcccccctccctcccggtgttcactcccctctccctcccggtgtttactcccccctcccttactcccctctgcctcccggtgtttactcccctctgcctcccggtgtttactcccccctgcctcccggtgcttactcccctctgcctcccggtgtttactcccctctgcctcccggtgtttactcccctctgcctcccggtgtttactcccctctgcctcccggtgtttactcccccctccctcccggtgtttactcccctctgcctcccggtgtttactcccctctgcctcccggtgtttactcccctctgcctcccggtgtttactcccctctgcctcccggtgtttactccccctctccctcccggtgtttactcccctctccctcccggtgtttactcccctctgcctcccggtgtttactcccctctgcctcccggtgtttactcccctctccctcccggtgtttactcccctctccctcccggtgtttactcccctctgcctcccggtgtttactcccctctgcctcccggtgtttactccccctctccctcccggtgtttactcccctctccctcccggtgtttactcccctctgcctcccggtgtttactcccctctccctcccggtgtttactcccctcttcctcccggtgcttactcccctctgcctcccggtgtttactcccctctgcttcccggtgtttactccctgtgtcctggtgtttactcccctgcttcctggccatctaccttctgccggtcttgctgttttcacacgttctgccccatgggtgatggattgtgttctgtggggccctgagatcacacaggcaacagaacagacattttctccacaggaagtccttgcggcatccagcagtcttcctgcctctgtgcctgcactctgcccacagccaccatcccccactgccccggctgcctcccccaggacccttggcaaatgtatcccaagcctgggccccggcacagggcctgtcagccacgtggctgccctggaccccccctcccctgtgctggttccccatgcagggcaggcgtcgggtgcacctgtctgtggacccccccagctggtggcacagcaccaagcatgtaaccagctcctggtaaatattggtccagttgccttctctgacacaaacaagagtgagggatcttggtgatagtcccagttgagcaggtggacatttaggagaaatccttccctacattctgagatatttctgttcccccatatccaactcctgctgcaccccgcaggcctcagggaactgagggatgggttcaacctgtggctccctgctcagaggctcagataagaatgagctgagtgtgggctgagcacagtggctcatgcctgtaatctcagcactttgggaggccgagatagggtgaccacttgaggttaggagtttgacaacgtgatgaaaccccgtctctactaaaaatacaaaaattagccaggcgtggtggtgaacgcctgtagacccagctactcaggaggttgaggtgggagaattgcttcaacccgggaggcagaggttgcagtgggccaagataatgccattgcactccagcctgggcgacagagcaagactccatctcaaaaaaaaagaatgagctgagtgtgttaaggtgttgttttcagcagcgtctgcttagggctacacgtgggcctttctccttttgtgtggcttttgcacagctaatgggcatggagatgacccttgccaaagccccccaaggtcccattactcgtagatttgaggaacgcagatggcttcaagggatgtgaaagagtagacagcagacacaggagggagcgtttcaggagaggagcccacagtgagcccttgggactgaatggcccagcctgggggtgtgtcgcggaggccacgtgctgcaaaccacctgggttttgctcctctctaaagtgtctcagggacaggaggctgccccatgacagccaccaatgcctgatggccagagcaggccagggaaccctgggaatcccaatactggggcacagttctcaaggcctcagcggcctcttcacatgtacttggcacaggaggcaagaagacagcgcgtctccaagccaccccttgggcactgcactcacgttctctgagggcaacggcggaaaagggggcagtgcaggaatgtggggggcatggggaaccgaggccaggagagggtggccttgcccggaaggacgagggctgcaaaggtgttttctggagggaaacgtggagtaaggaggaagcctggaattttagcatcttcccagcgcacacggcggctttattggtgtgccagggatgtctctagtctgaataaaaagggatgctttctggctcaccctgtgccaggatagagggaagcgtgttctgagccaggcatggggccccatctgctccctggcagcccccagccgcggcgtccgccttccctggagcccgtccccagccgctcacctcaggtgcagctccagctgcgtgtagaggaagtgcaggaacgcccgccgggccacgacctccgcgtggcagtcattcaccaccagcccctggtcactgaggtgctcgccgctgatgcacttggtccccgaggacagggccacgacctgcgcctgccgagcatccaggcctggggacacagatagcatcagagcagcgtggcccacggcccccgtctccctcctcctcggtcttttcagggtctcacaacagcggtttccctgggttaggaaaccttggaaacactgcgttttgagagctgggaagcgaggcttctgtgtgctccaggctgtcacgggtgaccgcccgcctgagggattcccatctacttcatggtggcctgagacagcgctcagagtgcctctgctatccttaaggttgctgaaatgctccttaggcaccataggagcagagttttgaggtcaaacttactaccagggcagttttctccacctgagtcccaggtcccctgtgagtgggagcagtgctagctgcggcctgggcttcctgcccaacctctaaccacctttgtgctttctcctgtcctccaacgggatcagggcaggacaggagctgatgaacccttcaccctaacacagaaacacagatgaacctgtcatactaacacagaaaggaggctggatgtgtcattttaaccatagtcaaaggaaccccatccacaaaaatgatactctcttcagggactgaaaacaaacaacaaagaaacctcaaaaacaacccccaacgtaatgtccttaaagtataatattcatcactttgtttaaggaggagaagctggaagacacaagccaatgtttgctgtgctctaacaggtctgtgtggatgtgtattttctctgcacttagatggtgaattccttgaggacacgagtcagaatttccaccaaatactccaagcaagggctccctagggagtccgtgtcattagacgggtcagtgttgccgatccaataacaaatccatcatccaggcccttcggctggaggtggcaggaatgttgcgggtgcccaggagccttgggatgtgacagccactggctgggcccggatcgcaggccaagggagggcagcacggagacgcgttagccgctgaccgcggccacgtccacagagttacctgtaaatacacgtccggaccatttcttggaagaggtgacacacaaattaatgtcacgccagaagcaggcctccctcccatcttaaataaaatcgactaattaatgtcacgccagaagcaggcttccctcccatcttaaataaaaacagtgctggctggtcatgagcgcttctcgcttctcacacacttgttcctctgatgtgactttttctcccctgagaacttagttcttgagccctgagggcatctgccctctctgggcctcaccgtgggatctttcttcgtgagataaaagggtggtgtcagcagctaccagtgacagccagggagaattcggggccgggagggaccgagcactggggaagtaacctgcagaggcccagcagcatccttgcccccatggctctgcagctggggtctgtctgtccagcctccttccttccaggcaaagcggtctagcacagcccccgcctcctgcccatgtccactgctctctccgctcatcccagcttctcccagcagcccccgtttctgtgcccgaagagaactccatggtcctggtcctgttgtctacccactgccccctccctggtgggacgggactgctcctgagctcaggaagtgaccagacttccccacgccgctttaatcagaacaggacacgaccagccgccctgaggttcctcccccaggaaagctcgtgagcagctgccgggttccaggtccaggcctcctcctctctcagccatcctgggtgcgggggctgccccctagcgggggtcccagaagttgacgagcagatgggaccaggatctaaggctacagggagctggggtgggcagctgctactgactctgccaggggtgggagccaccatctcactcaggccgtcagtgacatgtggactgttgagaaatggttcacaaggatgacatcgtgatgcagaaaccacccctcaggttccagcttcgttaaagctggtatttagagaaatgggaaacacattgataacgattcctaaccagtttcagtgttcacgaccggtgcgcatgcagtctctggtggaaacggacagctcttcaggaataggtgctgtggcctgtgaggccccggcctgctccttctctttggattccgtggaaattggagctgtagaaaaaagcaactgctttccctttacccctcattgattcccagctccgtttggctccagactctgccacactcagcacaattacgtggcccaagaagtgtttgcatattcagttttcatgattctcacccccaccgccagcaccacgttcccaacacaggagacgcgaagcctggaccgagggagatgacgcggtcagaaacggctgcagcatgagacgtcgtatgagaaatgtcgcggaagtgctgtacatggaatgtcaccagcatgacagtgagggaggaaaagggagagacggactcacacccagggagcttctgcacaggtggcaggaggaggcgtcctaggcagagtgggcatggtggtcagaggcacggataggaaagggcacaggcatattctgcataatctgcgtattctacgggccgttggagcccgtaggagatgtgtgtgggaaagtggcgaagcttcaaaggtgggtggaaatcagtcacagacgccttgagtaccaccctgaagatctagctcttcaccaatagacaatgggagctgtgaaagggttttccggaaggacagcagtactgttgcccatgagtgagtgctgggttgcacaggaggagagaaggggccaggacactgggtgggaggctggggctggacatggtgcatgaggacttaggaagcaccctcaggagtggattggtgggagggacccagagagcacagcaaggaccgaatccacaggatttgggaaatttacacagaagatgagggagaggaagaagccagaaaatgtgcttgagtaccacacattacaaatgagaaataggaagatttttatttatttacttattttttgttttttctttttcttttttattatactttaagttttagggtgcacatgtgcacaacgtgcaggttagttacatatgtatacatgtgccatgttggtgtgctgcacctgttaacttgtcatttaacattaggtatatctcctaatgctattcctcccccctccccccaccccacaacaggccccggtgtgtgatgttccccttcctgtgtgcatgtgttctcattcttcaattcccacctatgagtgaggacatgcggtgtttggttttttgtccttgtgatagtttgctgagaatgatggtttctagcttcatccatgtccctacaaaggacatgaactcatccttttttatggctgcatagtattccatggtgtatatgtgccacattttctgaaaccagtctatcactgatggacattttggttggttccaagtctttgctattgtgaatagtgccacaataaacatatgtgtgcatgtgtctttatagcagcatgatttataatcccttgggtatatacccagtaatgggatggctgggtcaaatggtatttctagttctagatccctgaggaatcaccatactgacttccacaatggttgaactagtttacagtcccaccaacagggtaaaagtgttcctatttctccacatcctctccagcacctgttgtttcctgactttttaatgattgccattctaactggtgtgagatggtatctcattgtggttttgatttgcatttttctgatggccagtgatgatgagcattttttcatgtgtcttttggctgcataaatgtcttcttttgagaagtgtctgttcatatccttcacccactttttcatggggttgtttgatttttcttgtaaatttgtttgagttcattgtagattctggatattagccctttgtcagatgagtagattgcaaacattttctcccattctgtaggttgcctgttcactctgatggtagtttcttttgctgtgcagaagctctttagtttagttagatcccatttgtcaattttgtcttttgttgccattgctgttggtgttttggacatgaagtccttgcccatgcctatgtcctgaatggtgatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtaatatagtttgaagtcaggtagtgtgatgcctccagccttgttcttttggcttaggattgacttggtgatgcgggctcttttttggttccatatgaactttagttttttccagttctgtgaagaaagtcattggtagcttgatggggatggcattgaatctataaattaccttgggcagtatggccattttcacgatattgattcttcccacccatgagcatggaatgttcttccatttgtttgtatcctcctttatttcattgagcagtggtttgtagttctccttgaagaggtccttcacatcccttgtaagttggattcctaggtattttattctctttgaagcaattgtgaaagggagttcactcatgatttggctgtttgtctgttattggtgtataagaatgcttgtgatttttgtacattgattttgtatcctgagactttgctgaagttgcctgtcagcttaaggagattttgggctgagacaatggggttttctagatatacaatcatgtcatctgcaaacagagacaatttgactttctcttttcctaattgaataacctttatttccttctcctgcctgattgccctggccaaaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccattaatgaagaatggccaaatttggggctgaccgatttaatttgggggaaaggagagggcgggcgtcatcatctctcccctcggtgccatgagggtgatgaggcatcaggcagcatagtgaggtggagaacagagctcagtagcagttgaagactgcgagcaaaaacgtgtcaaaaacagaaacggcaccaaccagcattcagataaacacgcttttcttaacacccccatcacaggggacagcgcgagggtgctgccaccatggcgggaccacaggcaggtctagggccctcatacctatggggagaaatggggtccttggtttatgggcatcaccctccaggtataaaccagtggtatttggggctgtgtcaaccctgcacagaggtgtctaacattctcctttttcggtgctctggttccccacatggagatccttgattgctgggatgggggtgaggccatgccaagccgtatggacaccaaaaatgctctgcactcaatgagcaatgctttgtgtaaaaatgtgcccaaagccaggccgccttgcagcagaggctgggtcggggatgctccagtaggggcttattaagtcaggaagacaggatggggcagcaaagacgccaggcgaggggaggctgtactgaggtcccgtctccagctgaccaaacaggaagctctggagtgtgaggcaaaggtgtgcgacgtgtcagtcatgagctgtgggcactcccaggcgtgcaggaggtgcaggaagacttaggaagtcctcctgaggtcccgtctccagctgaccaaacaggaagctctggagtgtgaggcaagggcgtgcaacgtgtcagtcatgagctgtgggcactcacaggcgtgcaggaggtgcaggaagacttaggaagtcctcctgaggtcccgtctccagctgaccaaacaggaagctctggagtgtgaggcaagggcgtgcgacgtgtcagtcatgagctgtggacgttcccaggcgtgtaggcttctggtggctagggccattctcaggaggaggctgcagctgtgagctgctcctggccggtactcggagccaggagaagatcaggaagcccaggatggggcggctgtggtgccaacagcatttactccaatccttccaatgatgctgttaagccaataaaatgcaagtttgtatagaagcatcactccatacatagtggctattggtgatctcttttcctataaatggctattgagagtaaaactactactctgtaagacaacatgagaagtagtcacagaaaatatacgaatttctatagaataagtggaaaagctggccaaacagcagggctcctgcacccccgccaaagcaccaagcacagtgagttttgtagaattcgactgaaccttcaagtagcagatggtttcaaggcaattgtaagtgttctggagcatataaagacaagagaagccttcgggttgtgtgttatcatggaatgcctaaatcattgccatactgacgtagcctgcacaacaaagcagacaacagaggaccctcagttagacaaaatactagccatcaagtagcagaggaaaagagcactacagtacgtccctgcaacatgggcttatttctgaaatgtgataatcagttatattaaaaaattaaggccaggcacacagtggttcacacctgtaatcccagcactttgggaggctgaggacagtggattgcttaaggccaggtgtttgagaccagcctgggcaacatagccagaccccaagtctacaaaaaatacaaaaagtagctgggtgtggaggcgtgagcctgtagtcccgggtacttgagagactgaggtgggaggatcacttgagccctggaggcggaggttggagtgagctgagattgcgccactgctctccagcctgggtaacagagcaagaccctgtctcaaaaaaaaaaaaaaaaaatggatttatatgcaacacaaaaataggcataattacagacactgataaggcatctgacaaaatacaacaaatgcttttgataaaacactgagtttttatcaaaactcaactctgtcaagtggaacagagggatttttttcctgaatgtgattttatgcacacacacacacacacacacacatacacacgagtatcatgctctatggggaagcactccaggcatttttatgaccattcaggaacatctgctgcagccattgacgagcacaacaagagaaagaaattagctctgtagtaattggagaggggcaggtaacacaagcactgtctgaacatgttatgattctgtgtctggaaacctccagagaatccagttgacatactgctagaaacaatgagagagcttaatatggtgaaagcgttccaagttaatatacagaagtcaataactttcatagagacacacagcaactagagagacactgtaaaggaaaaatgactccatttataatggcagcaaacgagataataggaataagtttaacgagaaatgaccaaggactatagtgaataaaacttaaaaatcctattgaaggacacaacaaaatttaaacaaacagaaagacttgccacatttttggatagggaggtttaacataatgaatcctctctaaattgattcataaatttaacaggattcccaaagaaacagcaatggtgctttgttttggacaagacacctggttaaaaagtataattttgttttgctttgccattgctatggcttgggtatggtttatttgtagccaaaactcctgttgagatttggtcctcagtgtggcggtgttggggggtgatgggacctagtgggaggtgtttgggtcatggggtggattccttatgaagggcttggtgctgtcctcaaggcggtgagttcttgctctggcaagatggattagtcttcaaggaaatgggttcgttcctgtgagagttggctgtaatgaagccacgatgtcccttagtcttcaaggaaatgcattagttcccatgagcgtgggctgtaatgaagccatgatgcccctctggttttctctttacaagtgtctgcttcccccttgaccttctccatcatgttatgatgcagaaaaaaagctctcaccagaatccactgccatacccttaaacttcccagcctgcagaagcatgagctagataaaccactattttttataaagtacccagtctgatgtattctgttatagcaacacaaaatgaactaagatagttatttgtttttaactgggcaagctgattctaaaaggaaacccagaaaattctgaaaaagaaggctaatgctggagacaagccctagtgtacatcaagcaggttatagaggctccatgccaggtcactgtggggatggggtgtgaagtgaaacaggtggaacaaagtggggagtccagaaattgacccaacacgtgcaggaatttagtataggacaaaggtaatcacatctcaaaccactgaggcaaagagagactatccaattaatggtatctaacaactgcatagtcatctgagaaataaaattgcatctttatctgacaccatgtaccagagtaaattccaaattgatcaatgtttagatgtaagaaatgaagaactgtatttgaatgtttacagcatctttacccataattgccaaaacttggaaacaagcaagatatctttcagcaggtgaatggataaatcatggtacattcagacaatggaatattactcagcactaaaaataaatcagttatcaagccatgaaaagacatggaggaaagttaaataaaagttaagtaaaagaagctgatctgaaaagtctacatattatatgatttcaactacagggcattctggaaaaggcaaaactatggagatatgtaaaaaggtcagtggttgccaggggatgaggcggggaagggatgaatagatggagaacagaggatttttagggcagtgaaactactctgtttgatggtacaatggtggatccatgtcattatacatttgtccaaacccatagaatgtccaacaccgggagcgaaccctaacacaaagaatggtttttgggtgattaaagaaataaagatgcatatgtcataaataaaataagggataatgtataaacttggtgggtgctatggtttaaatgtggtgttttctccaaaatttatattgaaacttaatcctcattgtggtggtattaaaaggtggggcctttaggaggtgattaggggatgagggctccaccttcatgaatggattaatacccctataaaagagacttcagacagagtccagccctcttatgccatccatcccatctgccatgtgaggatacagtgttcctcccctccaaacgatgtagcaacaaggcaccatcctggaggcagagtgcagccctctcgacaccaagcctgctgacgtctggattgtggacttcccagcccccagaactgtgagcaatgaacttctgttgtttataaatggctcagtctgaggtactttgttgcagcagcacaaatggatgcagacacagggcttctccccagcacattacccatctctagacaatgtctgggaatgggcttttattatttacttggaactaagtcattctcagcctgttccaatgttttaaaggtaaatttcttatactgtatctggttttggaggaaaaggattaccaaatttctaagaagaaaactgaaagtaaaatataccaaatagcatcaaagaaatacatttcaaaattatagaagatatagagagaaaggaataatttttactccacatgtagactgccccaagggtgtcatgtgtaattaactctgcctccctatttcctagaactgtgcccactgaatttaatgactcaacaacagggtttccacagcttgccttgagaaagactcttccacagtttatcagtgctcagtgttaggaaaccttcttcagtgttcagcctaactgatcttctgtacaatttcagtccacttcccagacttcatctttaaagctcccagtctccttgtggttggtattctctgaatactcgcagtgaatatcatgatcggcctgcaatcccacatctagtcattatttggtcaaagtctatgttttattttcaatcttttcctgcaagccaattttttttttttaaatcttctggtgtttctgcttccattctctatatttcctctaattagttcgaaatcaggtagattttaaaatgtctggcttggggacatcttgtctgttggggacatgattggactgagactgaaaggaaacagctttgcttttgacaggggagatttttcttccactagggtcttgatttatggctttcctcaggaatcagaagacaccagtgtctcctgggcttttattctctaaacatttcaaatgcattgattttggaaggaaaacaagttatgtgtaaatgttttgtgctctcctctatgaatgacaatacatctggggaatatcagataacaaagcactgtagtcagagtttaacaggctctagggcacaggtagccctgtttctgctgcttacttgaggcaagaatttaattgtgttcagttatcttgtttggaaaaagtttttaaagattaaagaaaataatgcgaagttcttaacatgtgcctgatacacagcaaaaatgccgccatctttagctattatgatacatatatttctgttctcttgtaatcatatttgtttttccatctgcaaccaggatgtttctgtgacttcccttgctagaataacacacaaaaaaccatgtgttccattattaacttctactgactatgaagcacatgttcttgcaatgagaacaagagggctggtgtgggaaagcttaaagacaagacacgttcaagaacacctttcaactaaatctgaccatggcattgcaccatgggccaaataacaattccaggatgagcactcgcttgctttaaagtatcaagggcatattttaatgtatttccatttgtttatccatccattcattcagtgggcattaaacacctaccttattcaagggaaagaggataaaaaactgtgcagtctcaaagctcctttcacagcacatgctcacaggcagggagaaggcagcatggcaggagagcagaaactgtctgtggttgggctacaccagctgtagggacaccttctcagaggatggggcaaccatggacatcaaagccagtgttaagagagggagaaagaagagacctgtgtcctggactagaaggtgtgtaaccactggccacgtaaaggaggaagagtagctgaagactgggagcagcctgcatgaaaacaaggagctctgtggtgaggatgtggtggcatctgtggttaggatgcggtgggctctgtgggtaaaatgtgggatctggttaagatgcgatgggctctgggttaggatacggtgggttctgtgtttaggatgaggtgggctctgtggttaggttagaatacggtgggctatggttaggatgcagagggctcggtggttagggtgaggtcggctctgtagttaggatgtggttaggatgccgcggtctctggttaggatgcagttgactctggttaggatgcagtggattccgtggttagaatgcagtgggctctgtggttaggacatggtgggctctgtggttaggatgtggtgggctctgtggttaggatgtggagggctctgtgtggttactggtgtagaactccagtgcctgtgaggcagtagtagtttctggagggcctcctgttgtatgggtgacatcaccagaaccgtctaccttcttcccaggtactcctgagtggagatgatgggtagaagccttgctcaccatgttgtcttcaccagaactgggagaattgctctctgcataaaagatgtcaagcaagttttggccattctttcttatacttgtgtgatcagaggaatcttttggtcactgttgaaatcacagatgtggctccagtctcctacaaatcgagaaccccaaaactattgaatgagcatctccttgtgaggttcctgaaaatctgtttttaggcaatgttttcaggttattcttatggtcaggtgaatttggggagcagaagtatgtgaaaaaaagcagatgcagaatattcactttttcacctggctgtgtgatgtcattggatgcagtttgggaataggtgctcttcactgaggcagattctttggtttggcaatttgaaagagaaaccattgaatcaaggggcagtttctcttgagcgttgcacacatatggtgctcaatagattgtaggcatctacaaagaaaacccactctgtgggcatccacagatgccatggtccccatttgctgtacctgagcttcaaagaatggtgggcaactgattagtgaatcccaaatgctgactctgtccaactgtgtgaacacgctgtgaaagccagggtttctcagcctcagcacttagttgtcaggataagcacagtaatcacatactcattaatttccttataaaatgctcccagaggacatgccaccctcactttcaggtgctgagactgccagtcatgccggggctcagccccagtgagggagcaagcggggccaatgctctgagctcctcatggggccaaaacatgagggagtgcttggatccaggaatgtcagaaatgaataactctgctgttttaacactcattctttttccttccaaaatggctggggcttgctttgtcaacacagattcacatgttgctctgacaggaaatgaggcaatcactggccctgggtgccacgtcacgtagcttgtcctcgtcagtgcagctgacgctcaccaagccttctgtgccaggcacatgtgagcgctgggtctacacactaatcaaacatgctgctcactccacataacatacaacacgacaaaggcattgagagagcccagaaaccatgccaggctgacgctggctgctgtccacctgtgatggcctcgggcactgtggcccccactacaacccaaagagggtcaggccatggacagggatgtgaccagatgtcagctggtcaacgctctttgctgttccccatcagggaatggaacttctccaaacctgatgggctgtcggtgaggttagaggtaagagggaggaaactgaggagatgccagtgacctttctgtgggccttgggcagggagctggctgcatggttcgctagacagtgtgacctcatgagagtggaggggatccctcccaaacaggtcacacgtgtgtctgtgactcatggtgggtcaaacacactatagccccatcagcgggcaggacaagttgggccctgacacaggcagcatccaggcaggcaagcacattgacaaccacatgtcagccctgggagctaacggtgtttacatgacagtggcacatctggcacattctcctactgaattaacttgacttttccaaagtatacttgcggggcatgagaatggacaggcagatgcagcagtatttgctgctgcacagacctctccacactcgtcccagcacagtgctcaacttggagtattgcccagtattacagctcagtaacgaagagggacttgaagctccaggagatgtgagcaggcactgtggatgcctgcaccagtgttggtttttgaacatccagctccaagctgtcctccctcactggctctgctgtggagactgagatgcaaaactctccctttccaactctccccgctacttcctgcacagctgagtggccagcagcaaaatcctgaccaaaagaagtctgtgggatggaacatgtcctcctcctgccctgatggggtctgggagcatgacctgcagcagcgggtgggatgaggagaggtcagggggccacacaccctgaaaccacaggggcctgaatggcgcctgccaccactgtctggcatgtgggccactgttggttactgagacaataaaaaggtgcgtgtttgcaacactgctaatcagctatctcacttcctgcagccagtggcattctgagtgcataaaacctcaaaatacatagaatttggggtaggataccacatatatcaaaagatggggccaggcgagcttatgagaaggttattagttacgatcctcaacatcaacactgcaagggtttcactggatataaatatggtaattacacatttagtaaatatatttaatgccctgttcctacccccaagaaagaggtagaatgacaacaaacgctttgcaattaatagattgaaaagtctattaaaagtctatttatctcctcatttgcattgggctgagcaagctcttcaccccatatcaaaggaacaaataggaaacacctggtatgatcgatgaacggtctcttctcctaccgaggatggctgacaaggtctcctcactggcactaaaaccagaaataatgagagcatgaagcccgcgctcataaataattcatggactaaatattgtaagtgacagtgctttcttcatttttaagcaaccacttggtatgcttttgttctgtttttaagaagatcatatttgaatcagctcagaggcgagctgtgttcaggccctgtgagctccacgccctctctgctgacctctaatactttctattcttttcttgactgaggtgtgagttcccctgggctcaaatctggctggttagttagagcacccattcttgggtaatgacccaaccacacagggaggcactgacctaagttggggaggccgccctgaacccactgtcgattgtagcttcatactctcctccccttctctgccctccactgagcttgtcatggactggctcctccctgagccacctgttgccaggatggccccaaagctgagactgctttcctccatcgggagctcctcctcagcccgagaccccacttcccttcctcttcagggtcagcactcagggatcagatgcccatcccctctctaacctgggagcctgcctccatgcacacctcttcctgtcatcagtgtgatgaagctgctgcaggggctgggtccagagcgctgtgcatgaggacttcaaaagtccaacggagcagcagaaggagacacagacacactgtgcagtgagggtgtgtgggaaagagaggtgcggagagaggaaagtttggttataacagcatagggcaggaagccaggagaccctgtgtttcttggtgtgaattacccccaggttccaacgtggatgtgtctggaacagcaccaaaggttcctccagtgtttccgcagggaagtcctttcaatatcacctaatgcagatggacacatcttgaaaatttaaatatggggtctactggggaagcagggagtgtaaaccatgaccccaggtgcacacatttgaaagtccacacttacttcagagggttacagcttcactcagtttcacatttgttcactaattagcctgaatcctttagaatatctttattatatctccatccacacagtggggaccctgtcaacgatgattaactcctgctcacagataatgcacagtcatttcctgaagcttctttcttccttctccttccctttcctagctctctctttttctctttctctctccctccctccctaactctttttctttcttgccctctttcttaagtgtgcttaaccatagcatggttcaggtaaatataagaatattttagcttgttaggaagaaactgcatcaactaatgagcaaaataaccagctaacatcataatgacaggatcaaattcacacataacaatactaaccttaaatgtaaatgggctaaatgctccaattaaaaggcacagactggcaaattggaaaaagagtcaagacccatcagtgtgctgtattcaggaaacccatctcagctgcagagacacacataggctcaaagggatggaggaagatctaccaagcaaatggcaaacaaaggcaggggttgcaatcctagtctctaataaaacagtctttaaaccaacaaagatcaaaagagacaaagaaggccattacataatggtaaagggatcaattcaacaagaagaactaactattctaaatatatatgcatccaatacaggagcacccagattcataaagcaaatccttagtgacctacaaagagacttagactccccacaataataatgggagactttaacaccccactgtcaacattagacagatcaacgagacataaagttaacaaggatatccaggaattgaactcagctctgcaccaagcagacctaatagacatctacagaagtctccaccccaaatcaacagaatatacattgttttcagcatcacaccacacctattccaaaattgaccacatagttggaagtaaagcactcctcagcaaatgtaaaagaacagaaattataacaaactgtctctgagaccacagtgcaatcaaactggaactcaggattaagaaactcagtcaaaactgctcaactacatggaaactgaacaacctgctcctgaatgactactgggtaaataacgaaatgaaggcagaaataaagatgttctttgaaaccaaggagaacaaagacacaacataccagaatctctgggacacattcaaagcagtgtgtagagggaaatttatagtgctaaatgcccacaagagaaagcaggaaagatctgaaattggcaccctaacatcacagtgaaaagaactagacaagcaagagcaaacacattcaaaagctagcagaaggcaagaaataactaagatcagagcagaactgaaggaaatagagacacaaaaaaccttcaaaaaattaatgaatccaggagctggttttttgaaaagatcaacaaaattgatagacctctagcaagactaataaagaagaaaagagagaagaatcaaatagatgcaataaaaaatgataaaggggatatcaccaccagtcccacagaaatacaaactaccattagagaatactataaacacttctacgcaaataaactagaaaatctagaagaaatggataaattcctcgacacatacactctcccaagactaaaccaaggaagaagttgaatctctgaatagaccaataacaggctgtgaaattgaggcaataattaatagcttaccaaccaaaaaaagtccaggaccagatggattcacagccgaattctaccagaggtacaaggaggaactggtaccattccttctgaaactattccaatcaatagaaaaagagggactcctccctaactcattttaggaggccagcatcatcctgataccaaagcctggcagagacacaacaaaaaaagagaattttagaccaatatccttgatgagcattgatgcaaaaatcctcaataaaatatgggcaaaccgaatccagcaacacatcaaaaagctcatccaccatgatcaagtgggcttcatccctgggatgcaaggctggttcaacatacgaaaatcaataaatgtaatccagcatataaacagaaccaaaggcaaaaaccacatgattatctcaatagatgcagaaaaggcctttgacaaaattaaacaacccttcatgctaaaaaaacctcaataaattagttattgatgggacgtatctgaaaataataagagctatctatgacaaacccacagccaatatcatactgaatggacaaaaactggaagcattccctttgaaaactggcacaagacagggatgccctctctcaccactcctattcaacatagtgttggaagttttggccagggcaatcaggcaggagaaggaaataaagggcattcagttaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacgaacagagagccaaatcatgagtgaactcccattcacaattgcttcaaagacaataaaatacctaggaatccaacttataagggatgtgaaggacctcttcaaggagaaatacaaaccactgatcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatattacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctgggcatcaccattcaggacataggcatgggcaaggacttcatgtccaaaacaccaacagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatacccagaatctacaatgaactcaaacaaatttacaagaaaaaaacaaccccataaaaaagtgggcaaaggacatgaacagacacttctcaaaagaagacatttatgcagccaaaagacacatgaaaaaatgctcattatcactggccatcagagaaatgcaaatcaaaaccacaatgagataccatctcacaccaggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccattccattactgggtatatacccaaaggactataaatcttgctgctataaagacacatgcacacgtatgtttattgtggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaacaaccaaacaccgcatattctcactcataggtgggaattgaacaatgagatcccatggacacaggaaggggaatatcacactctggggactgtggtggggtggggggaggggggagggatagcattgggagatatacctaatgctagatgacgagttagtgggtgcagtacaccagcatggcacatgtatgcatatgtaactaacctgcacaatgtgcacatgtaccctaaaacttaaagtataataataataataataataataataataataataaaagaaaccaccatcagagtgaacaggcagcctacagaatgggagaaaatttttgcaacccactcatgtgacaaagggctaatatccagaatctacaatgaactcaaacaaatttacaagaaaaatcaaacaaccccatgaaaaagtgggcgaaggtatgaacagacacttctcaaaagaagacatttatgcagccaaaaaacacacaaaaaaatgctcatcatcactggctatcagagaaatagaaatacaaatcaaaaccacagataccatctcacaccagttagaatggtgatcattaaaaagtcaggaaacaacaggtgctggagaggatgtggagaaataggaacacttttaccctgttggtgggactgtaaactagttcaaccattgtggaagtcagtgtggcgattcctcagggatctagaactagaaataccatttgacccagtcatcccattactgggtatatacccaaaggattataaatcatgctgctgtaaagacatatgcacacatatgtttattttggcactattcacaatagcaaagacttggaaccaagccatatgtccaacaatgatagactggtttaagaaaatgtggcacatgtacaccatggaatactatgcagccataaaaaatgataagtctatgtcctttgtagggacatggatgaaactggaaaccatcattctcagcaaactatcacaaggacaaaaaaccaaacactgcatgttctcactcataggtgggaattgaacaatgagatcacatggacacaggaaggggaacatcacacaccggggcctgttgtggggtggggggaggggggagggatagcattaggagatatacctaatgctaaatgatgagttactgggtgcagcacaccaacatggcacatgtatacatatgtaacaaacctgcacgttgtgcacatgtaccctaaaacttaaagtataataatagtaataataaagaatattttagcttgttgaataataggagaatgtggctttacacaccccaaacattgcctggcatgcaggtaaacactggatgctagtgtcctttattttttcaccaacaaagttagtgttatgcttccagtaaaaaaagactcatagtcaaagagaccagaataaaatgagtttagttgtgttgctttgagatataatatggcgttggattttcttttcctggtgaagccttttggacaattagattgaagatagaattgaatgctcagttatgagttaataatcagaaaagtgaagaagtgtttgaacagctttgattggagtactagaccttgagagtgtagcaaaaatatttattttctcctccatttctcatgtatttccatctacccatttccttacttgggataaatgaaggcatttggtgaggatttaactcacggccagggctgccagtcctctccttagttaattcagccttgagggttttcatccgcaccctgtgaattattccaggctaaactatttaaatgagccaggctaaactatttaaatgttcgggtggaacaaatgtccagtcattgattttcttttcctctccattttgaggagggatgtttagtagaaatgtgtcagcattcacactacgcaagggtcagcaccggtttagtgaaatctgtcctgcattttatagtttaaacctaacagtttaaaccaaagatttaaaatcaattgcccatcagcgctccttattgtactcagccgtcggcctccgtgaatcttaatgtgcctgaacagacccacagagacacagcatcagcttcacatttctcggtatccacttagtaatcattaagatcaattccttgaaatacagatgataattcaccatctttcatcgcagcatgaggtttctgtttagggatttttgtccagttcatttgtttcagcttatcttcctcatgcccgactggatgcaaataaaaagaccttgcttttaattttaagatcaaagtgactgccagtcattcaggggagacaacggaaggaaaggttttgaaaaattgggggaataaactccttatactccgcttctcttaggtccttgtgaagatgaacttacacagatgctctttgtatgatggaaagagaagttttaactgtatttaaactgtcatggtttctaaagtgcaaatgggaaaatcatgtttgataaccagctttatctggtacaacacaataacacaattctttattcaagccgaaagcgtggcacagacagtacggacacatttctttaccttatgtgctcattttaggttcaaagccaagcatatgcagcaaaacatagtctacatttcaaaacttggaaaacttatgctccatcgtggaattaattggcacttttgtatttttcctaataagagaggccggaccacttccctcagaagggtttcctagttgtcctgggctgtttttacaaagttgaactctaccaggctgttttcaagaaatgtgcatttttccagggcagttgtaagtaagtccaagaaaattgtggagcgataaagctggaccttagtttaaatgggaaagaatatttataaaagccatattttcagaatatgttttgtaggctagactagcaaaaatttaaacatgaccccctaatgtactctagaaaactccttttttctagttattaataaactcgaaaaataatttcccataaagaggtaatgcatggtcaccaccgggccttgatgcctgcttccaaaaggaacctggaactgggaaggataaaggaccatcagctctacatttcagctctgccccgccctcagggcatcaggaaagccacttggcctcttcatcttcgtgtctgcatttcctgaagtgttaataagaattcctgccttccccacttatcggggttatgtcaatcaaactgattagtgtatgtaaaaatgctgtcaaaattataaatctgcatattaaatgcaaggcatcaccatcaacagcccctttaagaatcattcgctcatgaaacacaagagtttctaaataaagcggtgccctgacagtttggctagtaagtgttgtaggggttcaagaggatgggggagaacatttgcttctctttttccagtgaaacgagaggattcgggagggaacaacgctgaactactgtgtgatggagagaaggggtgagtgggacccatgccctcccagaagacgccctgagcgggggcccaggctctcccggaagacggcctgagtcaggtccacgctctcccggaagacggcctgagaggggggcccaggctctcccggaagacggcctgagccaggtccacgctcccccggaagacggcctgagaggggggcccaggctctcccggaagacggcctgagccaggtccacgctcccccggaagacggcctgagaggggggcccaggctctcccggaagacggcctgagccaggtccacgctcccccggaagacggcctgagaggggggcccagggtcccccggaagacggcctgagccaggtccacgctcccccggaagacggcctgagaggggggcccaggctctcccggaagacggcctgagccaggtccacgctcccccggaagacggcctgagaggggggcccagggtcccccggaagacggcctgagccaggtccacgctcccccggaagacggcctgagaggggggcccagggtcccccggaagacggcctgagccaggtccacgctcccccggaagacggcctgagaggggggcccagactctcccggaagacggcctgagtcaggtccacgctcccccggaagacggcctgagaggggggcccagggtcccccggaagacggcctgagccaggtccacgctcccccggaagacggcctgagagggggcccaggctctcccggaagacggcctgagccaggtccacgctctcccggaagacacggtccacgccctctgagaagatggcgtgtgggtcggcgccgagaaggagtggtgagaatgagaacaaagcttcccagtggaagagagagcagctgtcttcgaggtcaggcctgggagggcccagcctcgtgcctgtaggtccggtgcaacagcgcatgtgctcctggcatagggctcactggattattttaagtaaatggctgtggtagttggccaagcatcctgctctctggggagaatgcctgagggtggaagcatttgttcagcatgaaagatggagtcccaccctacagggaggaaaggaccgcctgagaagggtccagggccggctgggaccccacctcattggcgctgtggtggggggtgggggggggccgtgcccacaaatcctaaggagacctgagctgatggaaatgggccctgggccgccttcccatctgggcgggagcctgtgggagaaggaccagccggccaccaccgcagaagacaccaggccaacgcctacaataccagtctaacgtctcgttcacaagtgtgtgtattcagacgagagccatcagcaggacacgggagaaagaccacgcgaaacagaaagccactgcccctggcctggaggacacgggccagggcgtctcctcagaggagttgagcagaagttacagctacagaacaagaggctcccttgaaaaaggaagaatggaggataagggaaagatttaaataatgaaaataggttgcaaaaattaggagggaaaggcagtttatgagctgtaggataaatttaagaaatctccaaaaacatcgagtaaaagaatgaagagacaaattttaaaagtaaaagcagaaaattaatagagtgttgcaaatttaacaaaaatgcgtgtaaatgaaggaattcataaaacaaatgacataaaactatacaaatagcttaaatatgtcaagagaagtgaatggctcacacctaaacatattcttaaatccaagttaaaaaaaaaaaaaaaacctttccccctcccgggtaggtgtgggtgctggtcactgcagagaaaatgtgaggcaggtcagaaatattggataaaagataatggaaacattacttcaaaatactgagggaaaataattgaaagcttagaattcccccctgggaatctattgagacggatgacaagcaaatcaaggaattttgagatgtgggaatattcacaaagttgatctcccatcgttttagatgatgcttcttgaggaagctctctatgaggggagacaaagcaaggaggaagacaatgattccggagatggtgtcccactggaagagcaggacgccgggtctgcagagcacgtgcctcgatgggcctggcctgggagttctctgggagagaggcaggtaccctctgtgagatgcttccatagaagcctcgtgacttagcacgtatggtaaaggcacaatcttcctctttcttttttttcaataagagaaaaaagaagacattccagaaaaaaacacgcacaatatttcaaaagcgatataagcaagtctagcaacacaagtgaatcaaacttaaacacaacacaacttggagctgggggtggaggcggagcctctgcgtgtcctgacgccaggcagccaggctcccttcccagcggaactgtgctgggagggttgaaggtggttctgcttggctctgtagtgggaatatctgcaacactctcatcagatagatgctgttcagctgttacaatcactcaaaagacaaagtagagaagacttaattatgggcataagaaaggatataaataccagtgatgatggtgtaaagatgtaacacgtataattgagagaggctggctagtggggaaggggctgagggctgccaccctcaacgcacagaacagggagtgaaaccacacccaaatttgatgcaataagaaataaaggtttatctataattgcacattacaaacataataatggaaaatgaaaaaagtatcaaatgttaatagcatgagtcaatagatgttatctagaactgaaaatctagaaatatagaagtatgtagtacttagaatcacaagaaaaaaatttgaaatggttagaggtggcttctgagagtgaaggggagtgaggggtggagtgggagaatacggcttttcattcagaagttctttagaatctttaccatatgactgcattaatttgataaaaataaaaacttctgttcataagtatatatttctgtgattatatttctcataatggctaagaaatggtctctgattcataaacagaactttcaggagctaataaatgtgaatgagttggcatcccatccacaggaggggcaaatcaaattgtgttttatttcaaaataagtttaattttaaaacattgtgacatatacagcaactagaacaagacatattactctgagaatttcttaggtatttgcttgaataactgaactagaattaagatcaaatggcacatcaactttaagtaaatgagtatctaaaaatgtttgtattagtaattttgcacatttctaattttttaaaatcagtgtttgtctctttacaataggaaagtaaatttaagcaagttattcttcagcattcagaagtcactaattagtgaagctctaccttatgaagtctcattttcatgtagtaaatttaattcatatagataaattgcctacacataaagcattgtattcactggcaacttagaagtatcatttccccacaagcctctaaaacattactattttccacatgaagtttgacagtagcttccaaaacttgccagatttgtttcccagaaagatggaaagatattgagttccagcgctgagaaatgctacaaacttactttccaggtcatactgacttatgcctctggggctggaagtgcattgcacaataaggaagccagggtggctggtgcccctcccctcccctttctactccctccccctacccttcctcctttccttttcataccaagacactaatttaacctgagttattcagaaatctgtagcagaaatctgtgtaacactccacattttaaaatttaccaaagttttgtttatatggaccagcaaccctgtgtgtatgtaattcttttatagttcttttatattggatttaaattgttctgtatgaaccattccccactagaatataagagccacaagggtaggcatttggtctcttgttctgctgattccccagaactttgtatgccaggcactgactaaataatttgtaaatagtgccattaccaataattaactaacacttacatggtacttgccatgggctaggtaactttctaagagctggaaatacatgaacacatttagccttcaaaataacctgatcaggtaggtgttgctgttatccccattttaaaggtgagagaacagagtcccagcgaggctcagtggctggtcatgggtcgcagagctctgtgcaggtggggctggattctgtgctaggatgatgctcttggcctgccaaactcactgctccctcagtgagactgctgtaccctgagtgggggctgtgtctcttcctcacagccccgtgggcctacagagcagtgcccagtgtatggcggtgcccaattgatggctgcatgctggaggatgaaggaatggtcacctccagcagggatgagcttggtggaggtgaactcttagccctcaatttagaacattcctaattccacaaagaggcaggtgtcatctgtgtctgaaagggggccagttgctggtggccagggtggggctggtatatttatatactggatgatgtgtttataaagcaactttacctttcaaagaatctcatattctagatcttacccagctacattgtaagaaagcagcttcattttcattttaccaggaggcccacattgggaagatcacacagccaagacatggtgctgggttccagtgttcccacacccagcaagattggagaggaccctgctggcccagcgtggctgagaaccatgccagtcatttggtcctttattttgtaacataaatatgtttgtatgtcagctcgatggtctttttccgccttagattttgccggcacatgcagagcaagtgtgtgtgtgaaacttaatccaaaggtcagttactatttcacagtaatgactcccaagtgtgtgagagtgtagtgagtgtgacgaggaggtcattacacactcgtgaaaaactctggaaatggaaatggttgaattcaaataaccagctggcttgttattaatgggttggtggctcgttgtttccacagggccgattgatcaaatttagccctcattcatcttcccccatcctggctgactggagaggacgccttcttggctctcagcatgcccctcgcggctgggtcacccttgtttctcagagtggaattccctccctgagtttgagatggggaatcttggcagaaaggagagcgttcggggtgggttacaccccaaccagaggaacttaggactctcaggagacgtgggtcctccggaaggggctggccaggccccccagagacgggggatgcccaagcagagctgggccccggcagcctaatcacagcaccatggtcaggatggcttttcctgctaatatgctctggccactgatctctgtatatgctataatattttgtctttctttgtcacagcctgttgtggaagagagagccttttggcctccaagatcaggtagatgctaatgctcctttctttagagatgaaaatgcccacaggaaaagaggaggtggctacctttggtcatgacgattcctgccagcgctttatggcgggcgtgcatgggcgtgaggtccgtcgtcacctcgcggaacttctgtgtgaccagctgggatatggagtctgcgaattcctgaaagacacaagcacaggcctccacgttgggctgagcaggtgccgtggaggatgatggggcactgtcctccccgtcctcacagcctcatccccatgtggccacacatgggcctgctctcctcccctcctcacagccttgtcaccacgtgaccacacacggcctctccctggctgtgcccccaaaactcagaatcatattgagtggcttatgagtggttaaccccagcattgctctcagcagaaaccctgagctctgccaacctccccatggaaacagtgtctacttcctctccctgcctctcagagcagtgactggaggagtctttcggcggggagggaatttttatagggatgatgggccaccgcagtcttctgagtattccagagccagtgtctacacagccagcagtctcagggtgctcttctggcaaaatggctggcgctgtggctctctccacaacttcttctcaccttcctgcacatgcacacagatgcacacattcacatgcaacacacaacacacctagggcacacgtgcacacacgaatatgcacacacatgcacacacacagacacacacatacacatacacgtgtgcccctgcacaccccttaacataatctgattagtgataaggtgactcctggtctctgggaagacagcacacacagtgtggctctgtggccgccctttccccggctcctctgggcccaaggctgcagcactgccctttccttgacatggggccccaagcttttcttcgggggcagtttggctggcatagccgttgcaggccttggagtagggaagcctggttggaccctcagttctgccactcaggagcctgggtgagtcgttaactcctcggagcccattttcctaatttacaagtgaatcatcttcatttccaccttatggtgttttcgtaaggattaaatgcaatacggtgtcttaagtgctcagcacagtgccccacacttggtaggaagtgctcagagatgacggctgtgactattactcttattattttcatcattatcatcatctcccccagtcaccacaggcattgcctgagcctctgagcagccaaatcaattcatcatctcatccaggaggcaggaaacagtcccttttcctggtggactgggcttccccattaccaccaggcatgtgttgatgttgatactgtgcagcattgggcctggtttccacatttccaccgggcgtgtgtggacgctgatgctgcgcaggcattgctgctgataaggacagctctctgattaataacgctaagaaagatagacagtttttaaaaatcccacttgtaggcaataaaacatgtttgtgtgaaaacagccctgcctgccagaagcaaaaaacatgccacaaaacaacctagcacctctccctcttaattcttctgcagtcaagggcagaagtgcagggcccggcgcagtctcctctgctcaccccggggtttgagggcctcaagccgctgtagcctgtaaatgatgtcagctacttttcccactgtgtcgtgaatcaatatggaagccccacataggacagattgcagatgaaaggcaccccgacctttcagggactgctgtgagcctggagtcttcctgggtgctcccagtccaggctgctcccagctgtcctgtctttcgtgtctggaatcaggtccagagagggaaacctgtgtcctggacaccccgtgtgctgtgtcctggggctgctggaaaaatacccttaactgggggtctttaaacaacagggattcatccccccgaagctctggaggcagagatctgagactgaggtgtccaggggcggtgctgcctcctgaggctctggggagccttcctgcctctcctggctccaggcctccgggcgtccctgggtggtggccgcatcactgcagtctccgcctctatccccacgtggccttctcctctgtgtctgtgtctgctcttctgcctcttgtagggacaattgtcattgaatttagggcccacttgggcaatccaggatgaggccatctcaaagtccttaacttgaggatatctgcagagaacgttttctcagtcaccgtcatggggttggacgtgtctttctggggctgttcaacctgctgcaccctcgtttactctttcaatgcatgctgtcaagggagagcgtgattcttaatttttttatttttctttgagacagggtttctctctgctgcccacgctggagtgcagtggcactatcacggctcactgcaaccttgaatttttgggctcaaatgatcctctcacctcagcctcccaaagcgctaggattacaggctccagccactgggccaggcccctgtgataacctggtcttccttggtgcccaaatcacacacagttgccatgaacgacgtccacaaggtgggtggcaggcgggagccttcgtgatggtccttggttctcccctagaaggctggctgcccacatctaaaggtcaggcctggctgtgaggttgtccggccccgcctgtgccccccacgaccttgcacgctgagagctctgagctggggtggagaagaagatgcagggggacagaggcccacagagtcctggagccccaacaggcctcagctatcacctcaggcctcgagaagtcagcttctcagcaccatgacagacggtgaaggtgacataagcagccccaccacaggctcctgcagggcgtgtgctgcaagccccatcctgccaggacctcccgcatctcccagggaaagcatccgggcacagggttgatggggcagccctggctctgggaccgggtgacgggtgggacctctgccaggcccggggctcgtgggttgccagcaggtctgggaggtggggaggcttgtgctgggccttgacttgcagtgctcatcctcaccggccctgcagaggggacagggcactgaagggcttcccactgggaagagggtctagaaagccttgtccaaagctgatgtctgagataaaccttgaaggatgagtaggagagcttccctttctcaggtgacagaatgcagactgctctcccgccggtccgccccacggcacatgggcaggcgagggcagcaccgatcagcattgctgcacaggcgtcctggactccagccacggggacacttccccagctcaggcagtggccatggcagcctgggggccacatctgtcccacggggttcactgtcgttgccagctctggtatccgattctgggtgattcatgggtgttaatgttgattcaaggacaaaactacatcttttgcttctaaaacagcttttctggtgccaggcatctgattccagcacacgctgtgctccagagttattcccaatgacgtgtgtagctctttgttttttttttaggatgaagtttcaaatgtctaagaagtgatagcttgtccagcacaggaggcctctctgtgtcactttgtgtctgcttgagaggctccagcacaggacatcaggatggtctcagaccactgagtcataacagtgcatgcaaacacagatttcactgtggaaacctagggagtgctctgtccccttagagatgggaagacacacaaacagtgacaacagggactcattctgagcaggcgcggtacctgcccaggaaggtgccaatattatcctttttagctattgaagcaacgcaaccagtcatacagcagggggtggcagagacgggacgtaccccagctgccttgaccttgacccttgcactgaactggtgaccagattgctctgaggaaaagcaggatctgaactcaaggatggctgcaggcttcactgcctctgggtgcaggctggagcagctgcggccgggacacgggtgaaggcggctggcaccccaagaaggcagtggcccttggaggggggcccgtggtggagcctggccacccactctccgcaccctgcaggcctgtacccctgccctaggctcccactatgaaccaagcagcgtgagccctggccgctcccttgtggggtcatttgaggaacagctggggtggaatgaatcacatttggtttgggcctcagcatttccacagatgaaggcctccttgactcactggggagggcttgcatggccagcagatgccaggtggagagtgatgctcagctttcttctagagtgacaagggcccctggctggtagagatggccttgaactgacagagcagaatggagatattgctggccggacagttccacccaccccagctggaggaggtgggaggtgcagctgacagccaggaggccatggcacccaggtgtgcacattcagtcctgcagggcggctccaggcagcagccatggcgccctcaagggcagggcacttcctctccccaggtccacacattcccgactccacagccagtctttctttctttccttcttttctttttttttaatttaagttttagggtacatgtgcacaatgtgcaggttagttacatatgtatacatgtgccatgttggtgtgctgcacacatcaactcatcatttaacattaggtatatctcctaatgctatccctcccccctccccccaccccacaacaggccccggttgtgatgttccccttcctgtgtccatgtgttctcattgttcagttcccacctatgagtgagaacatgcagtgtttggtcttttgactttgcaatagtttgctgagaatgatggtttccagcttcaaccatgtccctacaaaggacacgaactcatcattttttatggctgcatagtattccatggtgtatatgtgccacattttcttaatccagtctatcattgttggacatttggcttggttccaagtcttcgctattgtgaatagtgccgcaataaacatacgtgtgcatgtgtctttatagcagcatgatttataatcctttgggtatatacctggtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtgtctcattgtggctttgatttgcatttctctgatagccagtgatgatgagcattttttcatgtgtcttttggctgcataaatgtcttcttttgagaagtgtctgttcatatccttcgcccactttttgatggggctgtttgttttttttcttgtagatttgtttgagttcattgtagattctggatattagtcctttgtcagatgagtagattgcaaaaattttcttccattttgtagtttgcctgttcactctgatggtagtttcttttgctgtgcagaagctctttagtttaattagatcccatttgtcaattttggctttcgttgctttagacatgaagtccttgcccatattcacccaatacaggagcacccagattcataaagcaagtccttagagacctacgaaaagacttagactcccaaacaataataacgggagactttaacaccccactgtcaacattagacagatcaacgagacataaagttaacaaggatatccaggaattgaactcagctctgcaccaagcagacctaatagacatctacagaactctccaccccaaatcaagagaatatacattcttctcagcaccacaccgcacttattccaaaattgaccacttagttggaagtaaagcactcctcagcaaatgtaaaagaacagaagttataacaaactgtctttcagaccacagtgcaatcaaactggaactcaggattaagaaactcactcaaaactgctcaactacatggaaactgaacaacctgctcctgaatgactactgggtacataatgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatctgaaattgacaccctaacatcacaatgaaaagaactagagacacaagagcaaacacattcaaaagctagcagaaggcaagaaataactaagatcagagcagaactgaaggaaatagagacacaaaaaacccttcaaaaaattaatgaatcctggagctggttttttgaaaggatcaacaaaattgatagaccgctagcaagactaataaagaagaaagagaagaatcaaatagatgcaataaaaaatgataaaggggatatcaccaccagtcccacagaaatacaaactaccattagagaatactataaacacctctacgcaaataaactagaaaatctagaagaaatggataaattcctcgacacatacaccctcccaagactaaaccaggaagaagtggaatctctgaatagaccaaaaacaggctctgaaattgaggcaataattaatagcttaccaaccaaaaaaagtccagaaccagatggattcacagccgaattctaccagaggtagaaggaggagctggtaccattccttctgaaactattccaatcaatagaaaaagagggactcctccctaactcattttatgaggccagcatcatcctgataccaaagcctggcagagacacaacaaaaaaagagaattttagaccaatatccctgatgaacattgatgcagaaatcctcaataaaatactggcaaaccgaatccaccagcacatcaagaagcttatccaccgtgatcaagtgggcttctttctttctgcttccttccttccttccttcccctctttctctctctctttctttttttcctttttgagacagagtctagttctgtcacccaggctggacctcagtggcatgatctcggctcactgcaacctccgcctcccaggttcaagcaattctagtgcctcagcctcccaagtagctgggactacaggcgcgcgccactatgcctggctaattttagtttattttgtactttttagtagagatggagttttgccatgttggtcaggttggtctagcactcctgacctcaggtgatcctcccgccttggcctcccaaaagtgctgggattacaggtgtgagccaccacacccggtcctttttttctttttttttttttaagtttcaacttatattttgggttcagtgggtacatgtgcaggtttgagtgatgctgaagtttggtgtacaagtgacccaggtagtgagcacagtacttggtagttagtttctcaaccccctccctccccaccagtattccccagtgtctgctcttcccatcttgatgtctgtgagtactcttatgtttatcttccactcataagtgagaacatgtggtatttggctttttctgttaattcgtttaggatgacggcctccagctgcatccatgtagctgcaaagaacatgatttcattctttttttttttttatggcatagcctgtttctcaatccattatgtcctgccctgcctcagtctctaaaactccttcctaggcccgaaaggtttcctattcccctgtttggaggtcctctccctcatctgcaatccactgcctttagaactccagcaacattcatgtaggggtcgactcatgttttttcctgcatgattacctagcagttcatgttttatggtgtgactcctatgcagtgctgcatctgtggctgggagcatggcttggatgcgttttgcattttcgtggtcctgccatagcaccatgagtgatcatggctgtcatcaacctctcgaatgaatgactgcgtgtatggataagtgaaactctcaaggatgaattatctaaaaagtaaaatttcagaaaaaagttggttatttttcccaccagttattatcagcatttttttccccaaccttttcacactgtcttcatctgctggggctgccgtaaaagaataccatagactaggcagcttaagcaacggaaattaacgttcttaatggttctgaaagctgaagcccaagatgatggtgtcggccaggtcagtttctttctgaggccttttctcttggcgcgtgggtgctgccatcttgtcatgtgctacatgaactctcctttgtgtatgcatgaagacagagcaggaccagactccatggcatcatttgtttgtttgtttgtctgtttgattttgagacatagtctccctctgttgctcaggctggagcgcagtggcgtgatcatagctcactgcagcctcaacttccagggcccaagtcatcctcttagctcagcctgccaagtagttgggaccgcagacacagggtgccatacctggctaatttttcagtattttgtagaggcagggtctcaatgtgttgctcaggctggtctcaaactcctgggctcaagcagtcctcctgccttggcctcccaaagtgctgggattacaggtgtgagtcaccgttcctggcctgtggggtcatctttaataaggacactaatccactggataagctgcctcaactccatgacctcattttgccgtaagtacttccttagggttttggacttgcttgggccctgccatcctttccttgttgcctctttctctctcttggaaagggacgtctactccatgcttggctcactgttatattttgggaacatggaacttgtttgggttccgtggttcacggctggaggggagagctcagcttcagggtgggcaaattgcaccccgagtcccacccattcctgattcaggtgaagttttgttgaggctcaggacttcacaccttagtgctgatgctggaatgagctaagacttctggggctgttgggatgggatgagtgcatttgccatgcaagaaggatgtgaatttgggggaggtcagggacaggatgttctcaactgaatgtctgtggcagcatcaccttgttggctcagagtgagtgagctcactctccggtgtcacctcttacaagaacactaatcccatcagatcaggaccccactctcatggcctcacttaacctgaactacttccttagaggccccatctccaaatacagccacactgggaattagggcttcaacatatgaatttcgggggacacaaacattagttccatcaaacaaaacatgatgtcacctgagcggctccctttctgaacccatgtcatgtgttagcctggtgggtacaccttaggggcaggcaccacttgctctctgcccctcataggctttatctagaaacatgtggacatgcaggtgtggactatccctccttccttgacacatgacatctccttgcttccagcatctaggagggctgtgtgaccagggctgcctgttgagtgctggagaaaattgtgtttgccatttttaggtgtggatcctgaaattcctaagtgatgctccgtgaaattcctaagtgacgctccgtgaaattcctgagtgatgctccgtgaaattcctgagtgatgctccgtgaaattcctgagtgatgctccgtgatattcctgagtgatgctctatgaaattcctaagtgatgctctgtgatattcctgagtgatgctctatgatattcctaagtgatgctccgtgaaattcctaagtgacgctccgtgaaattcctgagtgatgctccgtgtttgcctcctaggctcttttcctcctctttctcaatcccccgtttctctcttccctccctacaagctggattcagagaaccccaggatggagccacgagagggttggggccagggtgaaggaattagctacaggctgagcacgcacggcttatttatagtgcgccactggctttgggggccgtgggttacggcaacaatgttatttactctgagtcatagaagagagaaatccatgagaaaaagacaaagaaaacgtggcaatcaaattgaagacttatgcaaatagtgcatgaaatcttacaacttataaatagaaaatgtctctgcaccataactcatgattgatttgacatgtgtggtggatccatgatgagttggtctattgctgatgtcacacgtttggtgggtccagatgatgacctcatctccacttaggggctcttcaggcctggaggcaggtcttgagcatgtgctggggggtccccaggcctcaggaactagctcctcctcactgttctgctggccagtagaaaacatttttgttatgaaagtagccattattagggcctcacctatggaatgctagatttctgtgtgttggtggtttgtggattcaggtatgcaataggaggcccaggcaaagcaccatgcgcttatatgctttgtgctggtcgatcctggtccaatggaaagatatggattggatagctccagcacttgtttctgagaatctgtccagctctcgtgcaagtccagccttggtgaaagacaatttgcgtgatttctcagcacggtgccagcagggctcaggagcagcaccgaggggtgcacagagactgtcaccccagagtgccccagcatcctgcccctcagggaccgcagggctgcatggggaggatgtggcactaggttcctgggtgactgctctcgctacactcctaagcccaggaaacttccatgagaacttttttttccgtttaaaaagccaaccccatctcctcctctataatccttttttctttattctttacattttaaattgaggggcgcttgacatttatatgaagcatatttttcaactaacattttataaaggcaaatgtaaaaagagaaaagcaaaaatttaaaaaactttccttactttgggtggtgaactaattaaaatgtagagagatttgtagtaagctggttaaattttctctctttgatatttaaccagcgtgatttcccatgacggcttcagcaagtctcacctcctggctggggtccccacaggttggcacagctcagctccagtgataacctcactgcctgagtaattaatctctttctccaggaagtggagttagaatgggttgtgttggggtcccatttactaactgcagatcttcctcccctccctgtcctttcgagaccaccttggtgtttacgtggtgctcagagacctgaaatatttctgtgcttggccacaaacccgtcttactgataaccaacacagctttcaacacagatcttgcttttttgcactgcgtccttccatttccccagtgaagccctttccgggtctctccacagaactgtgtctactgtgccacaggtattttaagtgattggtttttaattaaatcacatacatgattgcagctctatgtagttttccatagttgaattactgtatgtaaatgatactgccattgatgacatagggtgttagaagctagacagcagcttagaattcagatagggagacatacttctttaacactagggatgtttaatgttttaatcacttgggatataatatatacagtcaactttggttactgcaaacccaactaatcagactttgcaataatgtgattttcttccccacctggcacttggtttacaggagaagcagctaaagtgctcaaaaataagcttgtgcctgattaattttttgcatgcaaattacagaatatgctcatgggcctgcaaggggttcatttcatctcctaggatggataaatgcattcagatttagtgttctgagcacatgggccaagttatattgcatggtccctttctaaaataagggaagacactttcccataacccagagaactgagttatctcattgtgtattatgaccaatccgcaccttcccatcatatctttcaattcggtgcctacgtcagaagctctacagaggctcctagggtgctcaaaaaccatgtgcttactagttccgtccacttgaacttgcatcacagaaggtagacaaacctgtgtttctctatggaggtcaaatgccagctcctttataaaggcttcccagcatgggaacccttggtgtcttacagcactttcaagctgtgtcctttcctggcataatttgtatgcttgtctttctttctcctgtacatgtcatacatgtgtaatataccacagaccttgtggacaagtggttactgtttctactgactttctattggttaataggagttctagctaaggtcattgaaatcgtgctacttgccagacactttctaaatgctttaggtgcatgttttcaattaatcctcataaaccactttataattaaggggctgcaatgatctctatatttgttaacaatcctgtgaattaatggtagtgtgcacagcttaggacacgtgtcctacaagtggctcattggtggggtgttgtccatcatgagaataactggtgtggacagcctatggcacatgccctccatgtggttcatcagaggagtgttgacgatcttgagaatgacttctgtagacagcctatatggcctgtgtccttcatgtggcttattggtggagtgttgatgatcgtgagaataactagtgtagacagcctataacacatgcctgagcagtggagtgttgtccatcatgagaataaccagtgtagacagcctatggcctgtgtccttcatgtggctcactggacttgtacagatacttgcaggaggaagaggccacttctgggtagggactgggagtggggtagtcagggaagcctccctggaagagatagtttatgtgattccttcaaagcccagaaagaatctaaattgtcagggattaaatgatcataaaaacttagtagaagccatagcctgaagcagttcagaggtggaaacatttgtttttgggataagaacaaagagtagatcagtctggcctgagtaagaatttgtgcagagtagttatgagaaattaaactgaaagggccactcactacaggagagtgtagggtctcgattccaggccaaggagttcatctgttaattcatcaaatatttatggaatgcttctcagggtcagacacgattatacctgccagggatacatcagcacagaaacaggcagagatcgctcccacgtgaagctcagacgttacccaggcacatggatgtcctttgagggaccctgaccggcagggtgacagggctgggtctgcagctgtgtgaggggccacatgtcttggtgaggacagtgatccagggcctggcaccgagggcacgtctcagtcatggtaaggtcagcagtttgttgttttgctttgcttcaagcaccctagatgtaaggtgaattatgaggatgctctcagggctaggaaggttaaactgttgcactggacctgcactatagctgttactaccgatggctgcctccacccacagcacgggtagcaccctgcgaggctctcgattgagatccctgctgggaactgttaacacattatttaatccacccaacaactatgtgaagaaccgtcccattttataactgtagcaaaagagttttagggagatttggtagctcggccaaagatctaaagcaagcaagtagttgaggcagaaatggggttgtttcaggtctgaatctgagctgtggcagcctatcttcatggacactacctgatgctcttttgaggtggattcccagaaggtctcggaaaacaaatccaaccatacactgtaaatcctcgagatatagaactcagcacatctgtggggtccaactccagtccttgagtgggagaggaaggtgggccttagagaccctcatggtctggcccaccttcagtccttgaggggtgacttcccctccagacaatatcaggaaggcataggttgccatccagatgccccagctcctgcagaggacaggtgagtggctggggaggggacgagagaggctggactgggggcaggtgagatagtgctttgcaatatagaaagccctgcacagagagactctaaaacctgttcaaaaaagcctgaataatcaacagaaaagtcatctgcagcataaattcttttttatatatgaaaaagagagacatccagctgtccccattattgttggtgatttagccatttagaaaatgcctgctgaagggtctcttggcagcggggcagggttaatgtgtcttgcaccagtctttcatgcctcccaggaaagagctcacaccgtggggaaacgcgccctcctgtgaacccttacaaagcagctcggcttctcgcagggacgatggtggtaggtgggactgggtgggtgggggttctggagaatccttggtgatgccctgaggctttgcctggcaccctcagagcagaggtttaagatacccagccttgaagctatgaatgcacaaatgggcaccggctgcacgttggaccagcaatggtcagaggagagggtgtgtggtttctcgttacacaatagtgataaccaggtgcttccagctccagggttaagtggggagttggccccatatttgatgagctgtgcattcccgtgcttaacggaaaagcaaagcaaaaggctgctctgttagctcccactttttgttgcccacattttgcctattggctccgattaccatggcaaattaccagcattattcacattggaaaatgaactttaaatgggaacattgcaagactcaaactttactcatttccaacactaatattttgaatggcatgaataaataaaatgtgctcaaatttgcagcagtagtcctcagggtaaaattgacattcagccaaagtggtgggatactaaaatccatagattataaaggagaaagcctttagtaaatattttcctgttgaaatcctgtctttgggtttatacggctgaaaaatcagaaaggttagatttgcacgtgggtggggcaatgcggaatccaggaccgttgccccgagtccccaggctcctttcccctttgaactttgtttcacagcgggggcgggtggtggggcagtgggggcgggtggtgcctcactggagagagccaagagggggcttgggagtgcagatggcagagggacgcagggccagagtccacatggaggtgggacacacctcgaagccccctctcaaacaacacaccccgtctagacccgggaagtaggagaaacactgccaggagagtccagccaaacacaaaccgaagcctccgggataatcagagaaaatggaagatgatcttccctgacttccatcttcatatccctttgtgtttctgtggaagaggcagtctctatgtcatgtaatgagccctgttttctgacaattacaataaagcttcattaatttcaaaatcagggactggtaaaaaccgatgtccaaccaaatagttcaaattatctgactatttaattattctaaatctcaaattacctaaaggcggatggcaaatttgagtgaaggcatgaaaaggaaaaatcccttattgtagccattgtatggtgggaaaagccctaaacttgggatcagaagaaccagagttgagttctgccaccaccttcccccagctgcatgaccactacggggcaattggggtctctgagccacgggttcctcttctgcaagaggcatcatcataatcactcctcaaggccaaggctctgcatcttggcacagagatgtacgcctgcagcatcctgcactcgtctcttccgtaggaacagtgctggtgtcataggggtgttaggaggttggatgacagtggatggaggtgcttagcctggtacccggcactgttaagctcagcatccagcactcaaataccagctgctgttgttattgccattatcatccaactgtgtgcaaacataacatttttttagaaaaaatacagaaataactcacccccacgtgcctcatccttcaaattaaagtaacctgtttaaagggtacattttgatacaattaagtatgcaggcaatgcagttttgaggaggcgtatgttggggtgacctttcctgtgactcacttgaagttggcctctgtcttggctaactctctgactttgctgctgctggtgaggcctgtcccccacgactgtgctcacaggatggtccccttaaaagaacctgaataacgagttgaatcataaggaaatcaaagctacatagttagccttttagagttttattcttaattcacaaataataattgtatatatgtattgggtgcaatgtgatgtcttgatacatatacacattgtgggatgatcatatcaggctgacatagccaccacctcaaagacttactgtaatgagagcatttagagtcctttcttttggctgtcctgaaatacatgatacattatcattaactatgatcaccatgctgtgtgacagatccccagaacctgtccctcctgtctacctgaaacctcgcgtgctctgacggacatcctagcccctggtaactgcctttctcctctccatttccgtgagagttctgcagccatgcacatagatgctgggtagattttggacccaaagccaaccttaggaggaaattacacatatatcagctgttccatttagtcacttttagtgaaatcatcagtctatttttggtgaggaaatgctcatcagtgaaactgcctgctcactctttaattacatgtacctttatttctgtttaaattggaagctagagtctgaggcaacagcacattcaaaggttaagttagtgtgctttggagttatgccgtcggctgtgtggccctctaagcattgttttctgatctaagcgttccttcctctctgatttcacagcttgggtgtgttattttgtgactgctgacacaaacattgtcctcgtcagactggatgcccaaggacaaggactcagtgtcactcctcattgcaatcacaacatccactgagtgtgcatggtgggcccccaccccaaagcacgcttgcctctgggtcagctcgtgcactgctgtctctgaagccctaccctaaagggaagcctgaaaggagctgagggggtgtctgtcagagccctgactgcagacaggctcggccatgcccagaacgtcacagacaccagttctcaagcatttctgcttttatttcacccccatccctgtccctcggggaaaagaatcaatcagaatttattgtgcaaggcactgatgaaatacagggcaaaataagacaaggtcctctacataaagcagcctagaatacgaaacaggaaacacaaaataccatgtgataaatggcagctgacatttctcaagggctgactgcatagcaggtgctcttccaagtaacagcgagtgtcatttctgttcatccccgttgtatccctaagaggcagttacgattattgtcctgttttacagatgaacaagccaaggctgaggaaaagaaaactccttgcccagcacacaggcagtaagttgtgggtctggaagtcacactagttccatgaggccccacaatgcgtgctgcctctgagacgctgaggagagagaagagatgccttggtcacagctcccaccctcagatgagatgagcctgcaggtaggaggcctgccatggcaaatgctgcctcttagatgaattggggtaggagaatgacccccaaactcctggagcaggcaggcagccacctgcatcaagaccacggggtacttctgtgggtcttaagccctttccccactccctgaataggggtttctgacagaggatgccgaggcactctgacatgtgacgcggttgtctaaacgctggtgtaagccaaaaataaaattctaaggccccccaaccatccaaatggacccctcttctcagccaagggcattccagagttaacctgaaaaactggttcagacatgatggaagagggggtcggacatgcctcatgatacctccctccattgtggaattcaggaaaagccaaccagccttaacatcaacaaagacctgagtccgatgagaaacagtgaccatctgttccctccaaagcctgctacccagagatctgcatggtcaaaccctggtctccacaccccttatcctaacccagaccttcctttctactgatcataactctttcaaccaattgccaatcagaaaaatgttatgacctggaagccgctgctttgagttgtcccgtctttccagactgaaccaatgtcaatcctacacgtattgaatgatgcctcaattctctctaaaatgtataaaaccaagctgtgctccgaccacactgggcacatggcgtcaggacctcctgaggctgtgtcacaggtgtgtccttaacctcggcaaaataaactttctaaattggttgaggcttgtctcagatacttttgggttcacgttggggacctggaagagggaggaggaggccttcagggggaggcctctgcccacggcaccgtcaggaagcccgagtctgccacggctgctgggtgggacagaccagggtgctcctgacgggcagacccatcccactttctgaggtggaaaaccaggcctgggcctcccactgcccacctcctgcttcctctcactggctccgtggccaggacccgttctctctgcccctcgctttggtctatgcaggcctcataccacgcattgctgctgggtgacaagacagcccacaggatccagcccctggggggaccgcccgaccttcactccacggtgggtgtgccacagccagcacgcaggagcaggcgtgttccacaccagggaggggcaggtaggcgttcgccaaacaatagcctctggcctgcggcaggaaggccctcccacgtgtgcaaggagatgcgttagagcaggcacggcatacataggcacatacacggcatacataggctggtggctgagcacagctgtaacttccagggttacagacattgaggcatttcagtcttgtgttgttagcatgttttaatccgacataattagttacagtaaagaatccatctagggaaaatgaagaaaatacggctttaaaatgaaggatctgtatagagcaaaagcagggactgagtcatacgaggctgagtctctcttggtgcctgaggctttgcaaggtcaggagctgactaccttttcccccatgtctgacaagtggattctgtcctctgcatgttgttgtttattttatgaatcagccccagccattgtccagctcacgggcacctccagcagagagtggaggcctgcagggactcacaggtgacccacgcctgcagcagagtggagaagggcctccctcctggtcggcggaaggacatcgacattgaagccagatgctggggtccccaggaccaggtgtccacacccccactgcacggatgagacaatcagcacagggaggtgggctggctcgctgacacaggctcaggcagttggtgggatgcttggaatgaaatccctatccctatgtttaaattctagctccaaaatctgggctcctgaccacaatgttagaggtgccttccaagggcttttcactaattgaggatttcaaacaagcctgagatgagagatcccacattcagccttgagcaactgagggttgacggttgtgtgtgctgacatctgtctgtctacctgttgattatgtaaagtagtcgtccacagtttcctaaatcgttaaatatccacaaatctgtttacacacattaacggtagttactgctttagcaatcaacttcaaatttgaataccattaaaacacagaaaataaactaaaaaccacattgggaagatgcatatttctgtttttttgtgaaactggtgctttctggtctactcaggaagatattttgagcccgggtttaattaggatctttaaattctcatttgtgtgctgacatgagggtgcaaacagatgaggtcctccgtttggggctgattcatggttatttgcattcatctggatttaaaaagataaaaaccagaagaatcatttcaggccatctagagaaagagattcccttggaaaaagtagttgtttcataaagaaagtaatatttacttcccagcttctgttaaattcaagaaaagcctttaagtgagcatctaaggaacgccaacccctcttctgcaaaatcaccagggaggctgatgttacacaggcctccagtgccacagaggtgggggccctcagacctctttgtcccatgactttgcccctgagtctttccctatcctgaaagcaggatctggagaacagaaatcagtggatgaaaattgccaagttgttcccaatgcacctgggtccctgaggcagcctgggtgccgctgctgagcatcctgcaggctcccagaggagcggggtcggagctccttcacagctcagtgtgtgtagaaaacgcagtcctctggtccatgttccctcctcacagcaaaaccaccagcacctctgtaatgctgtgttccctgcacaatcctgcaatatttttgtttatttacatacccgatgtccctggtggagtgaaagcaactgcatggagtgagcgccccaccaggtcccagagctccaagaaaatcctgcgaaaagtaagcatctcagacgaagccacagatggcccacctcggccgggtgaagttttaaatttggacaaacatgcaaccaagacggctcctgtggtgtcctggaggaagccgagctcagccctgcagaatgcatggtgtgtgggttccattagatttccatctggtgtctggagggcctagagaaagccaggagaggagaaggagcctgtgtttccctagagaggaccccgaggcctggctgggcagaggcttcatgcctggcactgcggcaggtcaggggctgtgtggcggcagaaggcatatcgtggctgtgtccgtggagctgcgccttccaagttaccaattccagtggggctgttcgcgtctgccaccaactttcctaagactgacctcgccagccgctcagaaagcagcgttcaccactatcggcgtgcgtgtgttaagctgacttgaccttgtctgcactgggtgtttccagatagtctgggagtgggtaggggagggcacctcactctgtgacccaggctggtctcgaactccttggcctcaagccatcctcccgcctcagcctcccacagtgctgagattacaggcgtgagccaccgcacctggctagaatcttgtttttcactcccagggagcattgaaacagagtagtcacaaaataaatgtttagaaaaaaatttaaaagttgcatatattactgtcgcaggattagtaattgtcactctactgtgaagcctttttatccccctcacttagacaaaaggcttgtgacctgaggcccttctctactgagtgattttctttcaaatcacagcatgcatagacactcagtatatcttttccgataaaattaggtatgtgttttcttcataccctgttgcaccaggaatcaaaatgtctgtatcactctcaggttccgtcgccctgaaaccttcaagttctgtcgccatgaaatcttgctgggtcttgtcactgctccacgggacaaaatgtgatgaacagaggtggttcgggtgccgcgcttctgagaggagtgacttgggtctcccggctgaggctgcgatgccactgcccgctgacggcccacttgccaggatgtcctggcctgaggacaccccaacggggaacagaggtcgaatgacgtgtggctgctcggagcctgttctccagagaaagctccttgttcgaggaaggtttctgacaccagaaatcattctggtttcttgtcagtaactggaggggaaaatccaaagcctttgttgctaagatacataacatccttccatggagagagggaaggagagagagggagagggagggaaggagagagagagggagagggagggaaggagagagggaggggagagagagggacacaggaagagatgcagagggagggagggaaaggggggagaggagggagagaaagggaggaaaggagggaaggggggagagagaaagagaaagggacatagggaaggaaagagagagggagagggagggtaagaaggggggagagggggagagaaagacaggaatagaaaaaagagggagggagggagagagggacggggagggagagagggacggggggagagggacagagggagggaaggagggagggaaagagcagggagagaagggggaagagagaggggagggaggtgggggaagagggcagagagggagaaagagaagggagggaggaagggaaggagagagagatttcaaagcagttttactcttcatgtggtctgttttagccccgtcctcctctgcctttcttcttgtgtgtgtttaaaagctattaatcagttttagaaagcaaatctctgcctctgttgtgagcatctcgatttttcttttgcattttcagggcattctcgctggaaaggctcagtcatgctggacaaactattataccagtggaagtctgtccagtttctgataaaaccaaaactaatttattttttgtttatcctccactacctttgacaaagcttcctctggagatgtgtatcttcattccccactcctttctatgtcatctctttttgttttgttttgcaactgacaaggggaaataaatctgacaccaacctcggaagatggtaatgcattcaaggcttttcttccctctcagatgtgataaaaatcttgcctaaaaccatgtccaaccttttcagcagaaagtccagatggctttgcagcctgtaaaacagactttactcactgatgcctctcggagtgtcggcagggcaatgtctttctcgcagcagaaatgcaaaacaaaagacagcatctgtggcttgcaggggggcgggggcatgggggagctgttggtcatctggaagtgcaaacaaagaaaaaacttagagcaagctcagaagagaacttcccatgaatgggaattccatcaggtgggctgcagggtgaggaggagatggatgaaaatcagctgcagtgggtacgagaatagatcatttgagatgaggaagaattcaacttttccaccattgaagatgagtgactgccgatagaatcagctctgtggtggccacatctctccatcggggtgtgcttgcagttctgttggagaaattccatttctgatgccagccatgtgcagatggctgaggctcacatgagcagtgtgtgtgcaagaacagaggcccaggaagacttgtgatgcctgggacctggcggggtgacgtggctcctcacttacccatcttcagtgtgaggatgaattcctcatttctgtcagccacagctgcacactctgagtgtgtgctgatgggcccttgactcacctgatggcgtttcaccttacagctggggaaactgattctcgaagaaggcagcagcccctcgcgttgtttgactgataaccaagcagagggttccagtgatgtcgaccctaggacttctccggctctgacatgactgtctcgcttcccccatccagcgatggtaaccgctgggtcacactgccttgcctttctgttatcttgcccccaacgtcaaagctttgctgagctcattattacacctgtgatggaattccagtcaagccatctccttccctgagttgaaaattgcttctcccctgatgccagccctaattagcgctacccaattctgacaacccatgtgcccacagcatggagtggtggctctcagccctgcctgcaaattgtattctcctggggagatttaaaaactgtcccctgccaaggccccgacctagaccaattgtgataggatgcctgggctggggccaggatgtctctgtttgtcaaagcagatttctgtgtgcagctggagtgcggagtcactggcagcaggtaagcagctggcttctgcgggaacggcccacatcctttcctggtgaaacatgttgaatatcttcattacgtgtgttcctctcacttcaggtgtggaaatgccggtgttccaggaaggccaggacaaggcctttctgtttgaggtcatggcgttatgtctggtgcagagctcgacatatgacgtttgtcgctgttggttggctgattgatggggcctggggagtgtgaatgtgacatgggatgtgggagagaaacatcagaggagctaaaagccaagaaatgaccttcaaggtgctgcaaaatcttgggaagagtgtgagagttcggtgcaggaagatatgctggggttacaggtatttacatcccaggcatgtgttgaagtggattgctgtgcacttttgacctctttaagtcatttaggtgataatcagatagaacataacaatttcaccaggaaatgttggggacaacatcagagatgtccgatgcaatttaggagaaagagtacaacggacagggaggacaagaggaccctgagtgccgctctctctggtggtgggagtctgggctctgagctgacgtgtgcgcctctgtttcttcaatgacctctcttgatacgattttggatctgcctctagaatcctgacttatttagagatcagaaatagcagaatgcatgaagggtctcattaagaatttttgctttttagaattacctaagtttaaaatacagaataatgataaatggttttattttattctttcaaaatatttttcagaaaataatctctaatatcattgaatatgggagaagtacagcttctttaagaccctgttgattcacagactgtagtaggaaaaggtggcctatgtgtggtgcagcagtaagctcttgctgtgtaatgaccatccccaagcgcaacggctcagtcagcaagcatttgctcctcactcaggagcctgtggttggactggggtggggtgatattgactggcctgtgcagcttggcttccagctgtgctgtggggtcaggcccgctccatgtgcaactccctttggatcagcccctctggagaccccttcctgtcatggtgctggcagatgtgccagggtccaagtccacctgctcaagtgaacttcaaacctctgcttattgggaccctccagtcccactggcctaagcaggatccacgtgtaagacaaacatgaatgggaggggaaagtatgttccctccacagaggagggagagaaggcgaatatttactgacctgtaatctaacccatctcaacagcttagtgtgtgcagactgtagaaaaatgtgaaggctccaggaagtctgtactaaagctttcattccccactgctggtctctcacagtagagatgctgcttaaccccattatcggaggacaggactgaaatggttattggctactgatgattccataacgtattctatgcttttccagacaactgccacattgagacacctaactggcggcagagaattgagggacaggcctggtgcatgggagtcttcctgtggtgctgtggagtacagaaggccaagtgctccatcacaaacgttgggggagggcagggggaaggggtcaggatggttgtctgcagctttgcctgggactctctgcatttagcatctttctatccacaacatatgtaatgaccccaaaactcctgggacacaatcaagtgtggaaaggaggaggccctgctgtctgtgttctaagctcaacaacataattggaaaatgggagagtagtttttagccaccctcatttctactgcaaaattcctttttcactcatccctttctccttccttactgccagaaaaaatacactccttctctgctcccagcctggctccttgctaagatgctcggtgctgtcctgcccgctgccttcagggcagtaacagtctgtcttttctaactcccatctctccagtattttatttgtgtaatctttcgtgttttccttttcttttcctcctatacaaaatacctatctaaacacaaacaaaaataagtatcctggattcaatagtatcctccaaatttaggtctacccagaacctcagagcataatgttatttggaaatagggtgtttgcagatgtgattagtaaaggatttagaaacgaaattatcctggccttagaggaagccctaaatccagggactggtgtctttatcgcagggaggaagggaggtgtagcccccgtcggccttgggtatggagggaggcgtagcccccgtcagccgtggttatggacccgcaggtgttatgtttcttcactgcaactgagccccattagctcaaagcttgccagagccaaactcaagtttttacacatccagttattttaaaaatagcccaaacaagcagatttttagccgttgaaatggtacctgcttggcattccctgtgaaaccttaccatagagctgttccccactgataaggtggggccttgtggttataagaccactggccgttcagaccccgaagagccctctgacccagagacccccgagggtggctgcgtggcatcgcctggacaaggagccccctctgaacccctcttcccagcagctcccttgccctcctctcctcttggaacagtcttaggccatgacagatgcccctgcatgcaaatctgtccaagcgccagcctcatacagcctgtgtgcgctcctgccaccggggggcacacctttttcctcggtaagccctgaaactcccccagtctagagacgcgggcacagccaggacagcagcagccatggaggcaggggctggagggatgcagccgcagcccggggcagaggatccccagccatggctggaggccaggagagagggtgggacagatgccccttagaatcagaaggaaccagccctgcccacacctggaggtcagctctggttccagagctttgagagaataaacttctgtcatttcagccacctgggtgtgctcacttgctgtagcggctgaggagctctcacaaacacagccttgctttccacttccctccctcctatttgagatagcaaaaaatggaccattctgtcatttattcatttcagaaacacacacattgtctccattgtgcctcccacatgccaggcagcaaacgaaacggacagagatctgtcattccgggagactaaaatgtagggagtagatgctattgaaaaaaataacacaagtttataaagacaaaatgaagtttctcacaatggctttgtaaacacagcttggggaaaacagccggctatgtttttatgtttttttgccaaggaaggttttttggagtggctggacttaagggtttccatggagtctgctctgggtgatcccgggggcacatcccagggctgagcagatgttgtctattgaaagtgaggttttcccttcacctaatttacagcctatatttgagatgctattgcgcttaaaacctaggcaggatggtatgcacaaaattcaccttgagggagcccagagaagacttcatagagacaggcagtagccaaactgaggcaaggaagggcctcttttttggaagaaacaggacacacgtggatggagaagacacatactgggctcaagcaggagctcccctcaagggcacgtgccccactgcagagtgcagtgcaatgctgccgactatcccatgtgcgacgggaattttttttttttttttttttttttttttttttttttttttttttttttttttagatttgcccaggctggagtgcagtggcacactcttggctcactgcagcctccacctctggggctcaagtgatcctctcactttagcctcccgagaagctaggaccactgacgtgcatcaccatgcccggttaagtttttatttttattttttgtagagatggggtttcactatggtgcccaggttggtcttgaacttctgggctcaagtgatccacctgccttggcctcccaaactgctgggatgacaggtgtgagccacagtgcccagccacaatgccatttttatttgatgttggataatgattctcccttatgatgatagtgaagccagctggaagacacatgctcttaaatgtcttgtgtgttaagaaggaaagcgtaagtgactaggagaccagatcacagggaccccagctaatctggggagtcacgaaggggccccagatggggaaacccacaagcagagcccggaaggcatcaggagcctgcctgcaaaagccaggaagtgcagaaccagtgtgcgtagagtgtgaggggcacctgcctcactgggggacgtggacgtggccacagccccagcctggactgcccctcacatgtcagcaggggtgtccttcccctgcccctggtgaagatctagcagactccaggcattagaaaattctagagtcactttaagtcgcaagcagtgactcctttggtgattttaagtgtgcagccccgtatgtcatccactagtttggacggtatgcaaatgagaactctgccctggctgatcgcctgtgtgagattctcagccctgaccacaggaggatgaggctgtgtcctgcagacctcatggggaagctgccctcccatcccacactggtgcacggcttggtgcagcagctttctgtaggacgtggagctaaggacatttcatccatcagactagggactcttctgcccctgggcttcgcctccttctgcttcctgacctcctgggttacgatgcagcagcagcctttggtttgggctcctgggcaaagagagggtcccacagtctggtcccctgtgcttccggaggccatgcggacaccctggcctcttccctgctctgtgtctccaagtgaataaagtgcagttgctacttgaatgtggctcattgtcctaacggccacttcacgcctggccatcaaccacatgctggagttacctacctcaccaggggggcccggtggaggaccctggaggcagaggtccttttccttggttccccaccatcctggccgtacccaccacacttgtctcatctcgcagggatgagattttcccactctgccctccagctgtttaaagatccttccctgttttggtgcttttgggatttttaaaaataaaaactatcatagttgcctcttaagtagtctctctgcttctcatctgtcttccttccaaacccttttagccttgctggtggcttaagttttctcacatgcaggtataatggcatctacagatggatgcccattgaaggctgccctcgcagcagggatggttcttccacatcccctcctgttcctacagtgacggctgctcccagcctctcacaccacaccacacagccaggctgatgccagctccacgccccccacaccacctctccttggggcacccccacgcctctcctcctgacattgctgggctcacacagacacctcctcctccactaatcaattccccccatgtgtgctcctataacacttaaaaatatctttcctatgttactcatgacacggtataatttgttcattcgttcaatgaatatttactgaagacctgttcaaaatgcttctttagctgcctccctgagcatagcaattgtatcttcctcattttaaaattcctcgtgggcttcatagatgctcagtaaatattcactgaaaagggatttggatttaaaatcaaaacatacagatgtgaatctgctgccatgcactgtctggctgtgggcaatcatttaccctgctcttggaggcttgtttttctcatccatgagatattacaaccccacttgttctttcaccttgatgtggtcactatgccaaaagagaggacatgtaggccaaggtgcttagaagataaagcaatatgcaatgtaagatgctgctgtgattgtcagggttgtgacatgcttctgggatcagtgatcaaggagctgaattggccctggtgtccactctattgccggaccgtggtgtcatctcccacttaaaaaccactggttctgagaggaattgaccaaatacagggcacataagcactggtcagaaagctcactcctcttggtaaaatactgaggaattacggaacgctttcttgtctcttcagttatggtactgatgataaaatcgtggcacagggatttaacaggtccacacggttatggactctgtgcgtgctaattttaaagataacaagataaaatgtttacttaattccgttaaaaataaaatacagaagtgacttaactgctgaatgttcatagagatgagaaaaattaagtggccaagcaaaagtcatcaactctggttaccaccaacagagggggatagcagcctttgatatggggataggcttgaacaggtgaattttagaacctaaatagattataaatggaagtgcttacatacattattgaaaatgaaacccatcaaaatattgaatatcaatcaatgcccaatataaaaccgttaagaaaatcaaccttaaacagaaaactttcttttcttgatgcttctctcttctctctctctctctgtccctccattcctccctccttccctccctcttcagggttcattaatttggctgattaaatactagggtgactgcttaggatttagagtaaagaccaggcatccctgagaaatcattatggatttcttgtggtttatttcctgtcattgaattttgtgctaacacctctggtataatcctgccaagtagctaatttttaacaaatagactatattttaaagcagttttaagttcaaagcaaaactgggcagaagctacagagatgttccctgtacctgctgcctccacacatgcacctgctcctctattatcaaagtccccacaattggtgaccttacagtgacacatcactaccacctggagcccacggttcacaggagggctcactctggtgttgtgcactgcatgggtttgacaaatgtataaaatgtatctcccatctagggaggagccaagatggccgaataggaacagctccagtctacagctcccagcctgagcgacgcagaagacgggtgatttctgcatttccatctgaggtaccaggttcatctcactagggagtgccagacagtgggtgcaggtcagtgggtgcgcacaccgtgcgcgagccgaagcagggcgaggcattgcctcacttgggaagcgcaaggggtcagggagttccctttcctaatcaaagaaaggggtgacggacggcacctggaaaatccggtcactcccacctgaatactgcgcttttccgacgggcttaaaaaacggcgcaccacgagattatatcccacacctggctcggagggtcctaccccacggagtctcgctgattgctagcacagcagtctgagatcaaactgcaaggcggcagcgagcctgggggaggggcgcccaccattggccaggcttgcttaggtaaacaaagcagccgggaagctcgaactgggtggagcccaccacagctcaaggaggcctgcgtgcctctgtaggctccacctctgggggcagggcacagacaaacaaaaagacagcagtaacctctgcagacttaaatgtccctgtctgacagctttgaagagagcaggggttctcccagtatgcagctggagatctgagaacgggcagactgcctcctcaagtgggtccctgacccctgacccctgagcagcctaactgggaggcaccctccagcaggggcacactgacacctcacactacagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcgcctctcctcctccaaaggaacacagctcctcaccagcaacggaacaaagctggacggagaatgactttgactagctgagagaagaaggcttcagacgatcaaattactctgagctacgggaggacattcaaaccaaaggcaaagaagttgaaaactttgaaaaaaatttagaagaatttgtaactagaataaccaatacagagaagtgcttaaaggagctgatagagctgaaaaccaaggctcgagaactacgtgaagaatgcagaagcctcaggagccgatgcgatcaactggaagaaagggtatcagcaatggaagatgaaatgaatgaaatgaagcgagaaggaaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaatttccccaatctagcaaggcaggccaacgttcagattcgggaaatacagagaatgccacaaagatactcctcaagaagagcaactccaagacacataattgtcagattcaccaaagttgaaatgaaggaaaaaatgttaagggcagccagagagaagggtcgggttaccctcaaagggaagcccatcagactaacagctgatctctcggcagaaaccctacaagccagaagagagtggggaccaatattcaacattcttaaaagaattttcaacccagaatttcatatccagccaaactaagcttcataagtgaaggagaaataaaatactttacagacaagcaaatgctgagagattttgtcaccaccaggcctgccctaaaagagctcctggaggaagcactaaacatggaaaggaacaaccggtaccagccactgcaaaatcatgccaaaatgtaaagaccattgagactaggaagaaactgcatcaactaatgagcaaaataaccagctaacatcataatgacaggatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaagggttgcaatcctagtctctgataaaacagcctttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaaggagacagaaagtcaacaaggatacccaggaattaaactcagctctgcaacaagcagacctaatagacatctacagaactctccaccccaaatcaacagaatatacattttttttcagcaccacaccacacctattccaaaattgaccacatacttggaagtaaagctctcctcagcaaatgtaaaagaacagacattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacccaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataacaagctagcagaaggcaagaaataactaaaatcagagcagaactgaaggaaagagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaaggggatatcaccactgatcccacagaaatacaaactaccatcagagaataatacaaacacctctacgcaaataaactagaaaatctagaagaaatggataaattcctcgacacatacatcctcccaagactaaaccaggaagaagttgaatctctgaatagaccagtaacaggatctgaaattggggcaataatcaatagtttaccaaccaaaaagagtccaggaccagatggattcacagccgaattctaccagaggtacaaggaggaactggtaccattccttctgaaactattccaatcaatagaaaaagagagaatcctccctaactcattttaggaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgaaaatcaataaatgtaatccagcatataaacagagccaaagacaaacaccacatgattatctcaatagatgcagaaaaggcctttgacaaaattcaacaacccttcatgctaaaaactctcaataaattaggtattgatgggacatatttcaaaataataagagctatctatgacaaacccacagccaatatcctactgaatgggcaaaaactggaagcattccctttgaaaactggcacaagacagtgagagggatgccctatctcaccactcctattcaacatagtgttggaagttctggccagtgcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagacaataaaatacctaggaatccaacttacaagggatgtgaaggacctcttcaaggagaactacaaaccactgctcaaggaaatgaaagaggatacaaacaaatggaagaacattccatgctcatgggtaggaagaatcaatatcgtgaaaatggccatactgcccaaggtaatttgcagattcaatgccatccccatcaagctaccaatgcctgtcttcacagaattggaaaaaactactttaaagttcatatggaaccaaaaaagagcccgcatcgctaagtcaatcctaagccaaaagaacaaagctggaggcatcacactacctgacttcaaactatactacaaagctacagtaaccaaaacagcatggtactggtaccaaaacagcatggtactggtaccaaaacagagatatagatcaatggaacagaacagagccgtcagaaataacgccgcatatctacaactatctgatctttgacaaacctgacaaaaacaggcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctacgcatctgacaaagggctaatatccagaatctacaatgaactcaaacaaatttacaagaaaaaaacaaccccattcaaaaagtgggcgaaggatatgaacaaacacttctcaaaagaagacatttatgcagccaaaaaacacatgaaaaaatgctcaccatcactggctatcagagaaatgcaaatcaaagccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtcattcctcagggatctagaactagaaataccatttgacccagccatcccattactgggtatatacccaaaggactataaatcatgctgctataaagacacctgcacacgtatgtttattgtggcattattcacaatagcaaagacttggaaccaacccaaatgtccaataatgatagactggattaagaaaatgtggcacatatataccatggaatactatgcagccatgaaaaatgacgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgtcgtggggtggggggaggggggagggatagcattgggagatatacctaatgctagatgacaagttagtgggtgcagcacaccagcatggcacatgtatacatatgtaactaacctgcacaatgtgcacatgtaccctaaaacttaaagtataataaaaaaaataaattaaaaaaaaaaagtatctcccactgtagtacacacagagcagtttccctgccctaaaatcccctgtgctccacctactcagccctccttcctccagctcctggtagcccctgatcattccactgtctccatggtcttgccttttccagaatgtcctgtagatggaatcatacaacatgtatgctttctggatggacttatttcactcagcaatatgcatttatgtttcctccctgtcttccttctttgtaatgctgactcatattccattttctggatggatgagagtttgtgtatccactggcttactgaagggcgttttcgttgctttcatgttttggcaactatgataaagctactataaacatccatgtgccttttttctgtgtggacacaaattttcaattcatctgggtaaagaccaaggagtgtgattgctgaaccatatggtcagagtatgtttagtttcataagaaaatgccacgctgtcttccacagtgggtgcaccattttgcactcccaccagcagcgactgaatttcctgttgctccacaccctcactggcatttggtggtgtcagtgttctgggttttggtactggtatcttagcattgctttaatttgcatttccaggtagctaattttccatcatataatttatttttgtgggtgattagcaggtcagggagctctttaacacagactacctctatttctattttttttagaaaggacaggataaatagagcatggaatgcacatttttctctagcactttattttctcagctggaaaagtgttggagaagtggttttctaggataaacagatgcagtttcttataaagttgattttggcaatgatcaaattccatcagattcctaagatttcctacaggggaaaagtccccaaaaaggcaatgatttttttataaaattcagttctttaactgatggatatttagactaaccgaagtccatgcctctgacagcaaaccacacagacatttttgtgtgttgggttgtaggaatttgcacttgaaggaatgatatttgggacatgtctgaggttgcctctagggggttcaagactccatacccagagggtgactgataaacattgcctgtcatgttgggtattgagcaccaaacttcatccagaaagaaatgtgccattgctggacagtgtaagattgcctctcagcggatcctgactctttggtctgaatctcaccccatgcctatagaccaaaatcctccatgccgactgtggccttgtcattgtggaaagtgccttttcagccgggcatgcactggcagcgctccctgggatacacgaggcctgtctagtgggccagggctggctcctaggttggggattctgcaagacctgtgagtggtcctgggaagtccggtggctaccactgggatgtttgtttctggcttaggtttaatatttgaaaagttttgtgaaatgtgccaggacggattattatcattccaacaacagaaatttcagcataattacatgttaacatttcccctaagcacaagcctccctggttcagggcctggcaaggcaggatgagccactaggctctggtcttcagatcctagaatccaggctggtggggctggagaagtcagccctggattttgatgggagggaggggctctctggggtgtggcccatctccctcatgaagcactgcaacctctccacttcccatttgctgctctcccggcccctattttaattcaggacattactgagattcccttcagttcccagcctctgcagctgtgtggactgccacctgcgggcacacctggggccgcatcattccacctggaatctccgtcttcagcgtcttccatccctgagattccagtttcatttcatcctttgtttccatgctctctgggtcttcatgtgtttcctttaacttctatccttcattctccaatttcatctgcttctcagtgcttgatttcaccaaagtctctatgatttcctgctgctttgtttattaagtcactcatcagatgttgaatggggcctattttggaccgagcactgtgccaggtgctgctgtcacactgagtgagcagtctgaaggtgtttgcatttacgcagaggtacaacttctgacttccaccatgcctggcactgagagacactcccagatgttaaaatattcaccagtcctggagaagcagctggcactgaggctcagcactcctgctaacctacgaagatgttggaatcaatgagaaaaacttcattgactctgaataacattccttcattgactctgaataacattccttcattgactctgaataacattccttggatgaaagaaaaacagaggaagaagagataagaatccatctaaacctactttctaagccctggaggccccagaagtgaaagtcctcaaacacaaattattttactaatttactgagcagacatttctggagagcccactcggtgctgggcactgttgcaggcatgggggtagtgatggggtgacagtggaggctgctgcgctccagtcgggactaggtcctcacggtacctctggaggggatctctgtggttgggacggggataagtggagaggggaggaggctctccaggcccctggcgcctcaatctcctgtcccgtttcactctgactctcgtttccccaaggaagaggcagggaaagaggagacaggattgtaaagacaaggagtagttttcagtaacttggattaaaaataagttgaggttaaaggttgaacttagtgacaatattttgacctacaagaatgcaaattacgtatatttcaacttaatagctaaaatgtgtgttttggagtaaatgtggatttcgattattcacatgatgttgccactggtctgccacaatctagatctggctataggcaaatgaagactgagacagcctcagtagctccagagctgggcagcatggagccgtgaagaccaatgctcatgggggtcactcaggagacctgactatagatccaagtgttgcctttaaacagttgtgtgatctcaagcaaacctcatttctccttccatggggaatggtgggcacaccagctccatgctggtgccggtcctgtcccctgccacacatgactgagtgcccacaccaggcacttgtggtgctgctgatggcattacttttgtttctggtgtcagttttgtttaggcttttggggaggaaaaagcctaacaaaaggctttccaggagcagggaatggctggggcccatgtgaagcgtctcctggtttggtaacaggtgcgatccttcagatgctccccaaacatctctaataaatgcttagtgggttcttccgggaaatgaaaaaaaaagacacctgacgttgttgtttaatatctgagtacacctgcatcttccatgttcagatactctgaactcagaggataggtgaagacctggccaaggcgcctagagtgtccccctgcctgctccatagagaccccaccacacagatgaagaccctgagtgaggagaaagcctgcaaagctcctcaaccctcccctcagctctgtcagccctgggttccagcaaagaccttgcttcttctgtctcccactgggacccctgtcactgctacctggatgcttgttcctcaagctggcacccgagctaccatctccgccctatgatgatggaagcttagttaaatgaagctctttctggagccaatgggctggatcttaagcctcccggagaatgtgagtgtaatttaggaaagtggaaggaatgattgagtctgtgtcctaatccctgagagtctgtactcactgaagtgagcagcctaatcctcctggtacctgcggactcaggatggaatctttaattaccagagtctcatttctgcttcacgagcactaccggagtagcatctgtcgctcaaataaactcatgtgaaaataaagtattaaaatcaataattcagcttggaggtgaaatggaacagaaaaataactttctggcttgcagtgtcctggatttgcaggcggcaagtttcactgactcttgcttctccctctccttggagcatgcgaaccttggtgggtgctggctggcctgcaccagagatgcagtgggggatgcagcttccaccagggtgtgggggatgcactttctggaagaaagggcaacagccataccttcttccagcagctcctgtggccacctccaggtcagagtgagcccccggcaggccccaggctggctctgaggctgatgcagcaggttcagttattctgctgtggcctgaatgtgagtttctcttcacttcatcacattttggcttcaacactgaacagatttcaaagaccacctgaagttccctgtctccaggacgtctctcctgatttctcatttctggagtgattgtgaagagagccaagtttaccagttgtttataatttcactccaggtgcggtgataagcatgcacatctccctttggctgtcacagtaaccctttgaggtaggcgctgccacgtttcccatttagaggggaggaaaaagacgcagggaggtgaggcacctgcccaacccgcatgggcaggtgggaaccagggtccaaacctggccttcctttcctgcctatctttcctctgcggaggtgtcactgccatgctgcacacagctgccatgcagtgctctgttccagatgcctgtgcctgtgacccctctgcccatgaggctgggcacagccactgctgcactgagcttttgtgtcttccattttgtgtgtttcgccatctttttatagatggtgggggatggagtggacacaagagggcggcaggagaggggtgggaagatgtgatcttggggttttctcaccatttcacctgaccagaggccagaacgtcatttggaattcttcggcctttacatccaatgatacagttggggccgttcatccattcctcaacaagcatctgctgaaggcctggtgagagccaggaaccagccgtggagtggggtgggagtgcccaggtgagtccagggtctcagggtcttatctgtgtgggggagggcccattgggggacagctttggggagaagggtgaagggggatgggccctgagtgcctctgaagtgactcagagctgtggcctgaacttctgaaagatgccccttccacctgtcccccatcgccactccttgggccttccacagccaggggtgtcctgctgcctgccagggggtccccacagtggatgacagatggcagaatgttcatgaggcctcactgagtgccaggcactgggaactaagtggtggaactgggactgcccattccaaaatgtgtctctgccattcacgagcgactgtccctttcaagtgtgggccaattgtagtgacaagagtccctgctcacagaaagcaccaatgcttccacagcagagccagccactgtgaggcaccacctcctgggataacaggggaaacacaactaaaacagggcacagggttacctctgcccagccaagatggtttcctgcccttggttagagggagggtgggagaacgacagtggccccacacaccacagagatgacacctgcacacccatccgagttaatcgaggggccttgcttgcacagtgcaaacttccattgtgcagaggtttcacagaaacatgcttgcatcaaccttccttctgaggttgtatggactcccaaattcctgtggctgtgggtcctgcctcccagcgtcctcctgcagccagctggcaatgccaaacacccacaccatgtcttttgctaactagtaatatttctgaaactcgctatgtctgaaaaccagtcacttggaacattctgcagggcaatctccagcctccactcttgaggaaggagaggcagttgtggaagccacacagcccgtgccacagctcaggagccctgtggacctgaggctcggagacatcggccctggccttaggacctactcacttaggaatctcacattctggattcttattttgaactctgtcttcccattgctctaggaaccatcataatcattttgaaaaccaccaagaggagagctgccaaccatcaacacctgctccccagcagagctgaggtttctctgcagccgcctccctttcagtaaggacatctcccctcgcaggtcaccagccctgcccacagctggactctacttgccccgtcctcctaggaagtcccttatgagaagcaaagccagacagactatagctgggggccctaagtcagcagacgggccctgccctccctggtctgcccctgcagccagtccttcctcctcctcctcctcctcctcctggtccacctcttccttcccacatcggcccttccacggccagtgcccctccatcctccccactgcccggcctccagggagacctcttcccacacttgccctggccttccggccgcttctgacccacgtgacagacctgagcttagggtttcgcaggagggtctcaaatacggcatgcgaaggtgcagagctgagtctgaggtgcccaagatgtgatgatagtctgccaaccacctgacgggagaggggcccctgagagcatctctgttagacacgacccaaacagaagcaacaaaagtgctcccggatgtctgaaagcttcagcggctctccaggaggaacatggcctcggatgcctgcacctgggctgctctgaacactgtggggttcagagtgaactcaaggccctgtctggccttagatatttcactgttggtgcaaaattccccagaatttattttattatcctaatgggaacagggaagttcacgcagagggtgtcagccgcactctccaccccttcctgatcatcacccttctcacggagagaagccgccccgaggttccaacatgacgaagtagcgtacagttaaggggtcctgggcagggagccctgagttcctctccccaccgagtctctctgggagtttgggaaagtggtcaggaggggaggccagggatgatttgagttggtgcagactcttcttcccctcagcggggtgggggcttgcagggagagatcaggaggcagctccggaagagccgagccaggcaccaggtgctgcaggtgacagggtgagggtctgcaggggctcctgggcctctgcatcagccccagccagcgcacatggcttccaaggtttccgccttcattgattgctgctggggcacccagcacggctgagtgagcgcaaagcgtcctgagcgtggcgtttggcatggctgatgtttccaagcctcccagcaagccatacatcatgaaatattgatatggttccactagactgctgcacctgacatttgatttatagctttaggtgttcttttttaattctaaacagtcaatgagggatcaaaggaaatgtcatatttgtagggctcaagctcagaggggctcctcggaagccaggaagggaggtgccgtggttgctcccacaatgggccctaccctggcctcccagggaggggctttgaggggcccctatgcaggtgaagacgccccttccctatgccccagcatctcaaatatttaccacgttaaatatcagcctccagaatattgccttcatttaagcttttcacgttccaatgattttttattatttccatcgaccaaaataaatgaagaaaatgttttagactacacttgaaagcatgtaaaaatcaataactggattttaaaagatttaaaatgtcttgaatacattcattttcaaacattttcctctgatctttaaatagcttttcttggagcataacagttttttgaaaagtcaaatatggagcattaagggtataattaccattttaattataactcaatcatcctatctgctttgcatagaaattaaggcttttatgtcaggattttgggcactcacaaatgttcaggagcaattaatgttaaaagtttaatttttttaaagactgagtgtgaactttgcagttcttaatttccttcttgctcagatggggcagcagagatgctcccacttgccgtttaatttttgaagcgagttcatttccccttccgagtcagctcccacatccctgtgacaggcggcgtcacacagcagggaagggagtggatggtgccaggctgctgggcttgggccctgctctgccgtggtgatggcggcttccctgagtccaggctcgcctcacccagcttcctcacccataacgtggccttgtcgcagcccttgccttgtggggttgctgcaggactcctgtgagtggcaacgtgcaaggtgctgatggcagtgtcggccacggtgcatgccctgtgctggcctcattattttccagagtcccctttttggtttgatctaaaataatcccagtcattctgggagtcattggttttcctcctacccggaataggattgtttaaaaaatggtacaaccgtaaatcttatgtattcagagcagtacttattagatcacaaaacagcacaaagccctgagaatctcgcagaagcagggccctctattgctgtgccctccccacaccccatgtgcactggcctggctataaagtgacaaggctgctttcaaagtctttattttgcattaatgaaaatgccatttggctaaaacttaactagattttcattgaattttgccctgagaaggaaatactaaaatgatagattttcccattgtttttccgcgaatgagtaatgtgcttagctcctcactccggaggcataaggttgcagttttgtgtgcgtgtgtctgtgcatgcttgtatgcaaaacgcagcctggacatttttctcccagttaaagccccggtctaagatctggtccatttcctcttgagctgccactgctcaggctggaaggaaaaatcatttttatgggcactgccgtggcaaaataaaataattccatttttagaaaggctgtggcgtaggcccctcccttcctgtatgtttttgctgacagccttgctctgcttcacttttagccgatttttatgttttttagttccctcacttgtgcttaaagtcttacttatattagaaaaaaatgaatggaggcaggcagacataatttaaaaataattattatgccgtatcttctataccttgtaccagataatgttccctgagacttaatcactgaatatcacttacataatcaggcataatcccaagtgtaattacaaaacatcccataatctccacgagcctgacaggcatagtcgattgtcttcgtaagttgttgtacggatttttctagaacactgagggtttcacataattttttaatttttggtgaagggaaattattaaacatttaagtgaacatgatttagttttgatggctctgggagagtcttatataaacaagatcacttctgggaagacatccctttcttaggcgctatcttctggtttgggtttggtgcaggagttggcaatgtttttggggtaagtccaattccctgatgttgctggtgcatccatctgcctctctcactccttgggcagtactgagggctccgtgcccctgggtcccccaaaagcccatcagcagggggcacaggcaggggtaggcctgggggggggtgggtcagtttgtgtggctctggtctctgtgggccggccacgcccctccattgggggcccagcttgtaggggtggctggacacatggctgcctctctgcaccccagccttcccgtcttgagcttggtacccatcccgtcacttccctaaagcctgcctactccctaccagtgcccctttactcgaccctccctcaatccccggtgtgagtgccaggtaactgctggaccctgatctataaaaacactaacattaggagaaggccctgtctcctctgactgggtgtgaagtgttggccactcataaacctgcattctgcatagctgggcaatttaagatggtgaagaatatactatacttttgttagacactgtaaaatctatgtcagtttctgctacttattattagtttcacagtaacacaatcaatcaaataaaacagcaaaaaatccacccacagagaagcgtgtagtcacaggtgacggatcctgtaacaggaacgtggtaaagcccatcatggtatgatttggtaccatttgtttatttttgcaacctcttacagcccataagatactagaagctccctttaaattcaaacactgacagctccctgcagaatttgagaaccatgcaggagtgagagagatcatgggctgggccggagggatgtgggaaagccagaccatttgctagaaacaagcagtaccatttgcactcctggtgtggggagtggtttggattcatttacttattattcatccatgcctttgtggatttctcagtgcacacatcatcgcagagtgctggggttcagattccacctgatctctctgggcactgctgtcctcgtgtacaagtggggcaacaatacttgctcattcaactcagcattgatacaaaggctgctcgagactgtgtttgggaatgccttctgtgacctctaaagtgttgtcaaagtataatttgtccctgtcagaaggaatatcggggagtgtgggaatctctcgttactgtgttggccacagttggaataatctagttcccacatctccactggagaaagcatctctcagatcacaccccacaaattcccgtggtgggtaaagggtctgccagcctccagacaggcatctgttccagcagaaaatgacccagggtagatggaccgtgctccaaaggcttatgaatgtggccagcggccttaatttctgtcgtctgcttataactccatccaaaatcctggctggagatgataaaaaaagattcaaggagctcagagtaagtgggacatgtgacctgctcagatgctgacccatgccacattgtgacagtgacgaaaacagagtgaagaataaggccagatctataggatggggctggtgtcttaggaacagacttccttacacacagagatacagcatatagtataagagcagggacaccccaaaacaatgaggaagtaagttcagtaaaggtttctaggccgactgtcacaagaaagcatgatcttgcctgtggatcatacctcaagatgtattatgggtaggtagaataaaacagaaaaatagcacagaagagcaaacatgaatgtttaccaaacttcctgggggtgggtggagaagatctttcaaagcataaaagcagaaggataagtcatacagctgacagatagatcacctggaaattaaaattttctctgtatcaaaaaccctccatcataatcaaaataaaaagcaaaataaaagacatattcagataatagctatggattagcaagatctcaaacaaaatgattataatcacatcttggttgataagaactcattgcacaaattcctcttatatcagaacttgaaaagagtctattccatgacgaatggatagctggcatttttccttctacagagtgttggggactatgcaatgcatgtttccctctttgtcttgaatgccaaggcattctgtgccctgtccgagtacctaccttagcttgtacttacttcctggaacatgacttctgggaattagacagtataaatgtaatgatgtagctgaatgcctggctagttagagagtcgccatgttgtcttttccttatgaatataaatatttcctttgtatggattcccagcagtgggactactggaccaatatgtgtaaacgtttctaaagtttttggtgtgtattgccaaattgttttgtgcaaggtgcagcccaccagcagtgtgtgcacataacactatcctcaccctctacagcattggggctatgctcatgtagaccaggcctcagctcacctcttactactcccttcccattcctcattccagcatcttcacatcttgcctccatcctcagactcacagtggcctccagccgcccaaccactcccattcaaatggaaagcatgcattgaagttgagtccctcccatgaggctggtaggatgcttcttgccattctggtgtcccatgatgtgctatggagaatggagtgagtctcaataaacatcattgtctttaacatagcaaagtagggctccccaaaagtatgtgaattttaaaagggtgaaggcagtgatttgtccaactagatcatccagatttagggtctggtatctagcatctttcaaatcacaccatgtagatgtcactttgattttaggggtgttgggcttactgaggaggccagtatctgagctcaggcaagacctcaatttcacgtcttagggtatctccttggtgaaggcaaagtgccccctctcaggctaagaaaaaccattggaccatggtgtatcagatagttcttagtcataatatatacaaatttaacaactatctgcaaagtgagaatttttccacaatgaattatttggtagctttggtgttgattttatagctgtccttctgccagagaacagcgatgctgagatttgctgtcagtctgttggtcctatttttctataatgagagatgatgtggtgagctacaaaataagagacagatgataaaataattccttaagaaaaaaatattagaatacaatgggccggcaggcaaatgataaaatgcctctttcctgttttttaagcactgtaataaaacattttggaggtggggcattgtggatgtgcagtgccgtattgtaattgtaaacagaaatgaactggcccagattcagagcctgtggcagcacagggtcattgggattcattgttcagtgggaacatattttactgtgaaatgttctgatgacattagaatgtaaagttcctacaacctaaacaacaggtttcattctgacttccatctgtcatactgaggtaccatatgactctgtagttaaaaaccagtataaataatttggaacccaaatccatcccattggctctttatagttctccccatatgatggtgtcatacagatctctcctcctacacactttgcagaagcactgtccaaatcttgcctcatggaaatcacctcttctctcttgcagagagcaagcccatgatgttgtcctcatccggaagatccctgcctatcctgcctgaaaacagcccattgagagcaaaggtgactgcactgcctgccatcctcagatacagaagtatgctactaacttttaattttaattttttagagacagggtcttcctgtctcccaggctggagtgcagtgacacgatcctagctcacagcagctttgaactcctgggctcaagtgatcctcccgcctcagcctcctgactagctgggactaaaagtgctcatcactgcgccctgctaatattttcaaatttttttgtagagatgggggtctcattatgttgcccaggctggtctcaaattccctgccttaaacaatcctctcatctcagcctcccaaagcgctgggattagaggtgtgagccaccgtgctactgatgctactattttaatatcctccttctcttaaacaaatcatcatactctgttccagggagaatttcccagctacgagggcttttgtctaggttgaaaatggcatgggttggtaagccctgtactctaatgtagaaggaaggaggctaagtaggttccatggacatcattcctgcctgtgggcatgtgtgtcccacagctgattgggaaggggaagagagaggaagggagcatgaatgagaaggggaggagagaggctctgggggaggactttgggttctcggtgagggatgagagccacagaagacacagaaatgctccctctgcattgtttccatcctgcctcctcctccctcctctgaccacccagccctggactcaggagacaccagttggtacctggtgatatttctaaataactcagggcagagaaactgcaggattcaacattcctggctgtgtttttaatgaagcccttgaagcttggtgagaggtgatgggagagatggatataatttcggatgggcactttctgttggtagaaaggactcagcccatttgttaagaaccttgtcttgggaactattttgtctttttcaaaaaactcagtataggatggaagaaaaagcccaggcttcagagcaaggtggactctagtttaaattcaaatgctgctctgaccttctgtctctctccttgtacttcttctaattctccaaactgagtatttgagttagatttcttcatgacttactacagaggtctttggtttaggcaatgtggcaattaatctaggtagtttagggagatttaccagattggagaatgatgagaaaagaagagatgatacctatgaggctaatattgaggaaggagaatacaatattaacaaaacaggcaagggaatttaagccatttggtcatttggagccattaagtgaaggaaaaatggaaaattgacagatcataagagccactggcacatcacccactgtaatacaatattatcttctatgtccagaagaatggaaagtctagaaaaaaatgttatactcgatacactctattcaagaagaaaaggtatggcatttataattatttctacccaagttacttaaggaaaaaacatttggcattaagtgtataattttaaattatttcaaaattcaagttaatgtaattgctctctttttcatgatgtacataaataagatggcatcagtagcccatacttggaacagatttgattcaactttctgtaccacatttggcaccaggagaaagctgacactaccctgatacacttactacaatggtgttattagaatcaggaaaacagtacccttctttggttggttagtggaaagtttttaaaaagtatatcagaatttcaaaaagtattgaaggttaataaaggaggaaagccctttttgttttgtgaaatgaattaacacagtaatacattcagaactgcatctgaatctgaggaagtctatctaaattttagttaatattgtcatcatcctctttatcatacttcacagattctatgggatactttgaaattgtaaaaaaaaaaaaaaaaaacactgttaggatatgtatgacgaaaattacaaaatgctgacaaaaaaatcaaagaagacctaaattaatagagagacatgccgtattcacagattggaagactgaaatagaagaaatgtcaattattccaaaattgacctatagtgtggtgcaattcttaacaaaataccagcaaatattttgtagacatagacaagcttattctaaaatatgtatataaatgtttaagtcctagaataactgaaatgccaactttaagaaaaaggagaataaagtggaaggaatcactctactgaatattaaggtttactctatagctatagtaattgatcatgtgatgttggtggatggacggatgcatgggtccatagagcagaatagagaacccagtaaaggtacaaaggtaattcagtggaggaaacacagccttaaaaaaaaaagtaaactgtaaatcccacatctccatgtcttatacaaaatcttacacaaaagtaactcaaagtagaccacagacgtaaactataaaacttttaggaaaaaataaaggagaaaatctttgggatctagagcaagatgaagatatcttagattcaataccaaaagcaccatccataaaaggaaaaatggaagaaatggatttcatcaaaatggaaagctttcattctgtgaaagattgccttaaagggatgaacaacaagccataaactgcgaggaaatatctgcaactcacttgcctgacaaagaactagtgtctagactacacaaagaactctcaaaacttatcagcaaaaacaaacaattaaatcagaaatgggcaaaagacacaaagacttttcagagaagacgatacatggatatatggataggcacatgataagatgctaaactatattagtcattcaggaaatgcaaatgaaaaccacacgaggtaccatatgagtccacacatcacggaatggctgttgtgaaaagcagtggccacaataaaggctgagaagggcccgggtgggtccctcatgccttgtctgagaggtggaacagtgcagccactctggagggatgtttattattaaactaaacgtgattacaatgcaaaccaccaattaaactcttgggcatttaccccagagggcatggaaatttatgttcacacagaaaatttgtagtgatgtttatagcagctgcgttcatatgagccccaaactggaatccgcccagatgttctttcacaggttaatgcttagacgaattgcaatgtggcttattgtggaatactactcagcaatgaaaaggaacgaaatatgaatgaatgcaagacctggatgagtgtgtgaagaattatgctgagtgaaaagacatgattccaaatacatactgcatgattgcatttatataatatttatgaaatatcaacattatagaaatggagaacagaccagtggccaccagatattaaagttatggggagtggggttggaaggtggctgcatggtcatcaaggggccctgtgggatgggtgatctgtgtcctgacagtgcaggtgggcacacaacctacacctgggataaaattacatggagctaaacaaacgcaagtacaattaaaactggggaaacgtgagcgagccaggggattgtcaatgcctgtctgtctgtgaggcgttgtgctccggctcttcaaggtataactactgagggacactgggcacaggtacatgggctctttctgtactatgtcctagaacgctgtgaatctacaattgtcagaactaaaagcttaaacatgcacttacactcacacgaagttctgggcctcacgccaaacctacaaatctgtactcttgggaagggaagctacagtgtctgctccacatgctgctcaggggttctgcaaaggacccagcctgacatgtcacagatagtgtccatgaacctccgtggacacagagtcctctaccggggggtccctcctcatgagaacatcccgaacgctggggccatgacaacttcatgccgcacctctcttcacctcttcatgaggacttccgactgcacgcctaacactttgcttccgctcctgcaccccaagtgtattctatgctctcacctcctatgttttagctgtttggggcgagggttcatatcctcacgttccagcagcactcctgcatgtactggataattctgatgttttcctagggagggactgagtagcactcccgcatgtaactcactgcaaacagtttgggtgaaatgtaaagtggaattggaagctgacttcctccatatttaaatatttctgtcactcaggaaaagaaataagaaaagtattcaaaacgggacaagaccccgggaccccatctgtttttccagctccgccttcctcctccatggagactgttcaccaggcggttgtgagacagcccctgaagtcctcccacatctttcttgtactagagactcaagcttccttctcagtcctgggagaaggaagaccatgtgggacggaggaaagcactgggcacctgcacttctgaaaacagatgcctaagagccatcgactgccattagaatatccgcacctgagaacaagctgttcattctggaggtgaattaatcatcccaaagcccgggacatagtgattctcctgtttaaactcctaacgcctcagaatatagtttctctaagtttacaatacttgctttgctgagatagtttactaatcaactctctcacaggaaaccattcgaatcgaagagagaaggcaataaaaagttaaaacagtagatatgtaaacagtaagatactcttatcttggaaaactgaatgcaagtgaatttgaccattccccccatacttggtaaaacttacccattttggtgtcttgtccacagagtgaaacacacagagaacaggaagtcactatcttcagctttactgtgctgctaggaactttgcagcacacaaggctgagccgattttaactcactaattatgatgctctggggaagtgccttggtaactgactgagtccctcactaggaaaacatcagaactatccaataactccaggtgggcacccatggaggggcaaaagtgtaactgctgaactatctgaaccattctgtgacgtgggcaaactgagaagggtgatctggcaggaaaggcgagaccccacgagggagatgaccctgtgctaattccgtttctgtcactgtctttctatgaactctgaaaagtaaccatttctgtcactgtttttatatgaacttgggaaagtaacttttctctggatcccaacatgaaatttgactatttttataaaagccgaggaagatggaggaggaaatgagcagaagaaaaagaagaaaaacaggaagcacaagaatgttaaacccatagggctccttcccacaacacagtgcctcctcacagctcagcgtctcctcacagcgcctccccatggcacggcgcctcccgacggcacggcgcctctggtagcacagcccctcctcactgcccagcgcctccccacggcccagcgcctccccacggcccagcgcctccccacggcccagcgcctccccactgcccagcgcctccccacggcacagcgcctccccactgcccagcgcctccccactgcccagcgcctccccactgcccagcgcctccccacggcacagcgcctccccacggcccagcgcctccccacggcccagcgcctccccactgcccagcgcctccccacggcacagcgcctccccactgcccagcgcctccccactgcccagcgcctccccactgcacagcgcctcctcactgcacagcgcctccccacggcacagcgcctcactgcacagcgcctcctcactgcacagtgcctcgtcacagtttagtgcctgcccacagttcagcgcctccccaaggcacagcgcctcctcacagttcagcgcctccccacggcacagcacctcctcactgcccagcgcctcctcactgcacagcgcctcctcactgcccagcgcctccccacggcacagcacctcctcactgcacagcgcctcctcactgcacagcgcctcctcacggcccagcgcctccccacggcacagcgcctccccactgcacagcgcctccccactgcccagcgcctccccactgcccagcgcctccccacggcccagcgcctcctcactgcacagcgcctcctcactgcacagcgcctcctcactgcccagcgcctccccatggcacagcgcctcctcactgcccagcgcctcctcacggcccagcgcctcctcactgcacagcgcctcctcactgcacagcgcctcctcactgcccagcgcctccccacggcacagcgcctcctcactgcccagcgcctccgcactgcacagcgcctcctcactgcacagcgcctcgtcacagtttagtgcctacccacagttcagcacctcccacggcacagcgcctcactgcacagcgcctcctcacagctcagcgcctccccacagcacagcgcctcctcacagttcagcatctcctcacagctcagcacctcacagctcagtgcctcctcacagctcagcgcctcctcacagctcagcgcctcctcacagctcagcgcctcctcacagttcagcatctcctcacagcacagcacctcctcacagttcagtgtctcaccagtactcagcgcctcctcacagcgcctccccacagcaaggcgcctccgcattctgggggcacggattgcagggaagttgcactggaggaaatgacatgcgaggaagccttacagtaacccagtcgggaaatggtgggacccacatgaagcagctcagcaggcgtggagaggcagcgcaggctccggaaatgttgaaatagaggagtcagtgtgtgttggaaggacaacacccatgacgtggagatgagcgattgtggcggcacagggacccctctatgggaggcaaggagggattctggaacccctgactgtagtcaacgaagggcagcatccaggaaattggcagttaacagcagtggagggtggaagggataggactgcaaaatggcattggcctcgaagaaaggctcttaagggtggaaaagtgggtttagaagttgtgttagggaattggtagacaccacgccaatgtgatgaaatgagcagacactacctgaaaatcaaccacgtaacgttcagttattccattcaaacccgcgtcctgtttttttttcttgaacagtgcaaacattattacatacttcaattattcttatcatcatattttgcagacattcctggagcgggacagcctcctgggagtgtttacagaacagaggggatgggattatgccagcgtaaaaatccccctccagagcttggcatgtaaaacttcgatttcattttgcttaccaagaagcagtacaaggccaagcgtagtggctcatatctgtaaccccagcactttgagatgtatgaggcaggaggattacttgggcccagggatttgagaccaggctgggcaacatagtgagacacccgactctacaaaaatagaaaaaataactggtcatggtggtgtgtgtctgcagtcccagccacttgggaggctgaggtgggagaatcacctgaacacaggtgggaaagtcaaggctgcagtgagccatgattgcaccactgcactccagctggggtgacagaacaagaccctgtcttaaaaaaaaaaaaaaaaaaaaaaaaagcaggtctgcagaagttagttgctgtgctaatttatgacatatctggttcagacacactgctctgattaaatatgaagttcacaccccagtgtgggcagcctgtggcaggtatgcagataaaggatttaacaaagcactgcgatattacatttcagcacgacagagagcatctcggcagctgtctgcattctgtgcctgctgccagttgagatgtgaaaattgtcagactatttctaaatggaaatctaggcattcacagtaatgaacatgtgaataaaaaaataaaaacctctactgttaaatttgttccagtgattcttaagagtttaaatgattaaatctctaaaaatgtatcccttgtttaagctctttcagaccagaagcaggatgccctgaccttttgaaattctgaacccactgtccatgtgcgaaggctgtggcctgacctggctgggtgcctgagtcacacccagggcgcctgggttctgtagaaaatgtctttaggctgagtgtcttggtctcctgacccttgctgggatccaggtggtggtttctgccccatcagctcccctgcacttggctgctccatctgggtcctctagtgggtgttggtctagagggttcattaatccctccgcctccctgatggctgcttttaagatctgtttattcgatggtgtgggacaaacaacatccctgccaggcactggtccctgattctggagccgcgaaccacctgggggcttggtttgttctgggaaataggactggacagaagcgtttgtaagagtgggcgggaccaggcaggggtggttatcccgatttgctgatgctcctcatgaaggctccggaccaggggctgtgaatcagggcctcagaactactaaagccaggtagaagaagtgcctttttttttttttttttttttttttctcttaaacacatttagataggacgggaatgttttccagggctggatgacctgttcaatgatgcattatctcttcccttgcatggtattttatgattttggatatttctatgacagtagggaatacctggataatcagtgaattttgcccacgttcttttgtgtgtaagggtggtaatagagacttcttcccaaggagggctgagtcagggtcgattcagccatgggccgtcctagggtgttggcaggcatctgagaggcagcaggtagaggatgtgcagctgtgagcctttcccggcttaggctggccatggtcatggcctcagggcaccatgcttggagctggtgaccttcgattgcatgatatgcaccccaagtactttagagcattctctccacatttgcatgctcactcatttatagaggatctataaatcactctattaatttgtaaaacatatacaaaaatataaatttaaaatgatgagatatgctcagacaggaataaagatgaatttcctcaacctgataaacagcatctacaaaactcccacagtcaacaccatgtgaaatggggaaatgctgggcttgtcccctgagagcagaactggggcaaagatgttggctctcaccagtgctgatggttctactcaacgttgcactgaaggttccagatgaaatgcttaaacccttagaagaaagcacagaagtaaatctttgtgctcttgctttaggcaacgattcattagctaggacaccaaaagcacaagtcatgaaaagaaaaaatagataaattgggcttcatcagaataaaaaagtttggtactttaaaggacaccattaagaaaatgaaaagacaacccacagaatgggagaaaatatttgtaagtcatatatctgatgaggcactgataagacattctcctatgtctgataatggtatgatatacccgaatacataataacattttataactcagcaataagtaggcccaaataaaaatagatcaaggattagaatacatatttctccaaagaagacatagaaatggcaaatggtacattaaaagatgctcaatatcattaatacttagagaaattaaaatcaaaactacaatgagacaccatttcacacccactaggatggctacaatcagaaagataataacaagtgttgacaaggatgtggagaaattggaaccctcatacatttctgatgggattcaaaatgatgcaaccagcttggaaatttctcaaaatgttaaatacattttaactcatcaatcctactgccaagtatatacccaagagaaataaaaacatatatctacataaaaccacatattcaagtgttcacagtggcaatattcataatagacaaaaagtagaaatgacccaaatgttggatggatcagctgacaaatggataaatgagattctggacatccatacagtggaatattactcagctataaaaagaaatgaagttctgacgtatgccacaccctaaagacaccaaacttagagaagccagacacaaatgctcacttatgtgtgattctatttacctgaaatgtccagaataggcaaatcatagagacagaaagatcagtggttgctaggggccaggggaggggaaaatgctaacaggtttgttgtgaggtcagaaaaatgttccaaaattcctatccaaagataagaatgatggttgcagaacactgtgaatatagtaaagacctttgaattgtactttaaagggtgatttttatggtatctgatttatagcccaattaagttgttataaaaatgctgagatcaaagtatcagtaaaagttctagatttttttcctttacctcagtgaatcatctacatatcgcacactttgaagactttaacacactacactagtgaattctggacccatgtatttggaattattcagagagcttttagggtttttcagagatttccttccccatggtatggtggtggctatttgaacagtttgggaaattttcagaaaagatactcctgcagttgtcagattggctgcaacacttggctttggttgacagggctcagggtgccatctgccattttcttcagtcatattcatccgaagaagtcgaagtcttaaatctgcaaagcaggcaagaatggacacacttgctgggtgtggtggctcacgcctgtaatcccaacactttgagaagctgaagcaggcagactgcctgagcccaggaattttagagtggcctggacaacataatgagacctcatctccacaaaacaataaaaaattagccaggtgcggtggtggacgtctatagtcccagctacatggggggctgaagtagggacagaagtgggaggtttgcttgagcccgggaggttgaggctgcagtgagctggtgttgcaccactgcattccagtctgggtgatggagtgagaccttgtctcagaaaaaaaaaaaaaataaataaaaaataaaagagtagatagactggctaactagcatcagttttgttttttttttttttgccatcgaacaggtgttaaatatcttttgttgattaaaaatattacagtaaagaatggcatatttttgatattttgagttgagaattcaaaagtcttccagaaagcacaagacgttggccccctgacctcagaggagagacacatcaaagagaattccccatgtgcaggactggagacttccaatgtccctcccactctaagttgtaattctgatctgtgatggcatctgtccaatagagacaccactactggttaatttgattaattcagatgagatatatcaatttatttgaggaaaaaccccaaagcttcatgtgatttgtttgactaaattgtctaattgattaagttgtaagaatttctctgattacattggaagcagagttaccgttttccctctctctagattttgagttgtccatttttccccatccccgcaatcaatgggagagacaacttgtgttgatggtggcagagccagcgatctgacaaccttcctctgttagcccagatttctggtctccagccctctcctgctattgagttttgactccaattgcaagtggccatctcagaacacaaatccctcagctcataagagaaaagtgcttgatccgtttcttattcaattgccaagatcatttcatgtgccccagacttggctgagttaactcgatttctactagcttttctcctggttttgattaactttgatgccataattgcttagtttggagtcatctgatgttacacaatctttaggcacctagtgatgctttgctgggaagaagctgtggtctcaatgtgtgccagaccctctacctttgtctaccatggccctgtgagctgggtgcccttaccatccaaattttctgcagcacagtgggtcacttgctgaaagaaggcctcacagggagagccagggttcagatcctgagttgggctcccaggtccaggacctcaaccaccacatgaaactgcctctctgtgctcagatgggccccacttaattttgagggtattttttagtctctagaggtaattttccttacacctcagcacactgtttttctcatcatattaatacatgatacctgtaataggcaaagtgtgtatgtgtaacagaaaattttgtacagaaaaagcatgcagaaaggaggctggggaaagagacgatgatgatttatcaactgcagacctcaaagtccaataaaatgaaaaggaagcagcagcccgtgagctactatctgtggggccgatggtgagaggagccgtctgaggtgggattgcctgtgccctcggttcatccaacttacctgtaatgccacagggatgctaattcctagggacaaaaaggcagcccaaacctaaaacacaattcctgcttcctttgctacccagactgatgaaatacaaacctctcaaagaaaacagacatcaagcaccccagtggtctttttacaaacgcccgtagccccattatagaaatgcttacacggcaggttactcagacaggccggaacaactagactggacacacaatgaaggttatttctgccaaggtgtgtctttaacttttcaggtaggcagtaggcaggggccatggcaagacgcagactcatgggcagaggccggaggctgttttgtgtttcctggagcagcggtacggcgggaaacatggaagaagcggcggggtggcctaggtgagtgtttagtaatctccagaaagtggaataattaatttgttaactaatgacattcgtatggaagagatcaggccgcggcttttggtcgaatacatttgaaaatattttatcaaacgccctgcttgctgtgactgtcaagtgccatgagcagcgatgtctaaagctgtcattgtgaggctcgtggactcctcactgtgcttcctacagagaaatatgcttccagagagtaggaatatttctccacacgtgggtgcacacacatgtgcaagtgtttgtatataataaatacatttatagtgtattgcatgtttatatgtgtacatatatataaatgcatttattatcattcgtatctgcaaatctggctactcacatgtaggttccttggtcaagatttataactttaatagatgaatctttaagattgcaaggccgattattttctgtgttatttgaagttttccttttacaaataaagtttcttcaagaagtcaacaatatttgtatagagttaaaattagcctcttattttaatgtttgatttttttaaagggtgtgtaacgtctttgtgaagcacctgtgtgtagctgggccattgctgcaaagggtcctcacttctgggactggagctggtcctcattcctcagtgctttgacaaaaccctcagtgcatctccagaatggcaccagaagattaactgtcattatttgtcctcacttcaaactcttcccagagcttaattctaacattttatcatgactaaaaatcatgtggggcccttgttaaaagtgcagcccaagatagtatggtttggtagctctgggttaagtgcccaggagctacattttaaacatgacacccagccaagtcttacgtgtgtgcgttacaattcaaactgtgaggtcttctcaggggcaatgggtttgtcttatttgtctctgtgtgttccagctacctgcgcctggggcagatagtacttattgaggatgtctgtgagatgaatggatggatggagggagggaatgatggaaggagggatggagggtgggagggatggatagaaggatggaggaaagaatggaggaatggatggagggagatatgcagggatggagggagggatgaagggagagatggaagaaaggatgaagggaaggctggaaggagggatgaagggagaaaaggatagaggggtggatgacggaagggatggagggaaggatggagggagaaatagaggaagggatgggtaaacagggaagaagggtggggggtgaaggaatgggggaagggtagaaggacagatggatggatggatggatggagggttggagggaggaaatgatggagagaggggtggaaagatggataagggatggaaacctgtctcctggcaggaaggcttgactgcttgcaagccactggttgggctataacaaacttgggccatcatttatatcttttctaaaacctgaggaacattttgacatgtcttaaataaggataagtgagtcccatcctaaataggaaatactctgtcacttttctctgatttcaaaagccatcaaagcagaatgtgcacatcccgattacctcattgtttctgcaccagctcactgccaggcttatcctgcttggcacatgcaaattagagagatgcctgcgttacagacccgctgcaatccccgtgtcttcacactgaatttggaattgaatagtgctaaatgggtcttcacatttggctttggtggttaatttgaccatgcatagcatgttttcatatttcttcatgacaaatgtaaacataattagctcttattcaaaaataatttggttgtagaatgcagtgatttctaaacatgtcctccattttaagaaactctaatatgcaaacattcgaattcatggagtgcataaattcagcatctattcttctcacagtgattcttggctttgggcttcactgcaggaggcctacaaacaatgggatcctgtaacgcatttaagatgttacccacttggcaataattggatgactctttaaggaatgtagtagcacctccattaaagcaattatcttgttattgtgtggctatttccatatctgtttctctggttcactgtttcttaataaatgttatcctgtttatctttgtttcctcagtgtcttaaatacccggttcctaatcaatgctttaggcatttaagggtattctcacacatctctgtatctctcaacacttctgaagcatcatgggaaacccacccctcatatttaggaaatgaacatccttacagttaggcagatcatcctgtattatgatgtacgagtaccacatagccatgggaggaaaatgaagggtttaaagactccttggatatttcttcatattataaaataagaatgacctttgcaactctacttaggttcagctgcttgtgaattatgaggggttcctcaaggaatagacatttcctagagcctcctcaccctcagaagaccacaaaacttctctgcagaaagtgttacgctttcttagtccactgaggactccctgtgtcaggtgaagttttattattgtccttagcattgaaagaattgcttgcaggatgtttcagctcatttctttccatcgtcgttggtgattctcagtggtggtaacctttacagtgcatgtgtggtctccccctctgctccgattcctgactcttttcttcttttccatctaaacagagtacacagctctgccacagataatgagtccagatagccaaaaatcaacggacaggagattaatggactgggttattttataactaatccaaataaagatttttcccttttttacttaaagatttctgtgtgtgtgtgtgtgtgtgtgtgtgtgtgttttagatataaccaagaatgaacttttccaaaggtcacttaattactaggggaaaatagaaagtggtccagatagtgcatgtttataagcatgtggtgtatgtgtgcacttgcctccatattaaatttttgggccaaataatcaagtattaggaaacacaaaatacccagagtgattctcactcaggatttagactctaacggcaagctctaatggctcacctgcatggactgcaatcagagaaggtgcacactcaccttagatggcaggctgggctcaactacaccaaatgctgggcatcccactgagtagtccagcttttcagagtggttggtgtcagtgatgccattgaaatgctcaagaaatgagctgaaacatcctgcaaacaattcttccatggtaaggactacaataaaacttcagctgacacagggaggcctcagcagaccgagaaagtgtaattttttctggagagaagttttgtggtcttctgagggtaagcaggtgcatgcgccggggttacccatccctcccaccgaggcctcatatcacctcaactttaccctggggctggagtgcagggattagaataaaatttctgatacccattgtttcatttagccactccaattattgatacgattttactatattgattttattgcatttaattcccatttcaaataccaggagaaaaggaattgggtcataaaatctttaagatatttggtcagactataaaagggggtgccattaattcacaaagaggagaagtcataggatttgcttcccaggtcttggcccagcccagccttcttcacctcgtgcacactatacacactggatgctctgctgaagttgtgttgtcacctgggactgacacgtgcttctcatggcatcatttaatactgtcatggtgctttgcaaaatggggtagaatcattggagaaaatcatcatggctgaaaataaaagcatctattttacatgagaaacattcactgaagctagtccatgtggaaggaactttgaggaagaactacattgcccaaactctacagacagttcgttaaaaatagggagtgtcttaaggaatgtggcaggcatttctccttttattcatgctggcagactgataagtgtttaaccgaacatagcttcagagcttcagcccaaatgcttaaattcactcaaccaaaagctcaactgtcttgggccgcacagtttcagtggactgttcccagttcactgagtctggtccataataactacattgcagataaacttcatttttgaaaccatttttccccatttccaatttctcttcttcagatccctatcatataaaattctcagttttaactatttcctcaaaaacaatcctgtagaggcaaaatgctgaaacaagaaaaccaggccacctagtcaagtgaggtgttgtttagaatgacgcagggttttaaaatggcaagaattctctatttaggttggcctcaaacatggaccagctagttctcaattaggcaatttctgtctgtttcataaatgaatctaaaacatgaatggaaatggtggctcctacgtgggccagctcacagccccagccttaggtcaccccccgacattttggcatggtggatagagaggtggaggaaggatttctaggctgaaagaagacaaatctgccccttcttctccatcagccaccaggttccaggttctggaaacagggcggtgggtgggctgtctgcttccttgcatgggctggagggcagggtggctgtgagctcactcaccccaacatttgtctcattcccagcagctccggaccttgagggctgatcttcccaactcttctccacattccaacaccagcagcctcggctgggtctcatactctggattcaaagcatcgcttctcttgagaggctttccttattttggttggataggatgtatctttccaagtttcagacagtgtttcctgtctgttgggtttctcctccctggaccccacactagccgggttgctcggccacgccctgtgctgagccgagatgtcttcctgccacgcctgtagctgagcatggaccccacagcccagcatagcctcttctcaggttaaccctgccccatggaaagggtgggtcaaatctgcagttttcagagctggcaacatggtgaccacgattcacacatggctaagtgcatcctgcaccttgcattgacccgaagtctacgggactaaggagaagccattttgttttgggtcccattcctgccaactgcacttttaggggaggagtcactcagagccttcgtttcattcatgtaataggttgtgaggaggtggagacaaactctggctgtatttttactgttttcactttcatcttgcctctcacatccctacgtttgctctgattacagaagggattaaaaacagataaacaaaatcaaacaacaccaaacacagcataaatatcaacccatccaggctgcagtggattcttgccaaactttgaaaattctccaagtcaatactcccattagaaaagagcttttctggccatgaaaagctgagcagcagcgatctgcagagggagcgggtgtggggctgctctggcccctgctctgaagccccactgggagctcagaggatgaagaaacatccatcgatagcaggtgccagcccacccgtgaccaagtgcagactttcaaaaaggaatgcattcccaacaatatgacacagaaggtttggaataactgcttttgatagaagttttgacggttttgaagctactctcacagcagcactcctgcattctggcttggtgtctccagaggggcaggggtgggctcacagctgggggtgggcagtggagagggaacatgccacacctgtgattatcaactttcctgtatgctgtggccccagacagcctagagccacgtgggtccggaattgaatcagcacccaccagagaaccacgtgccccacagcggcaataaccggcatccaccagagaaccacgcgccccacagtggcaataaccagcatccaccagagaaccacacaccccacagcggcaataaccggcatccaccagagaaccacgcgccccacagcggcaataaccagcatccaccagagaaccacacaccccacagcggcaataaccggcatccaccagagaaccacacaccccacagcggcaataaccggcatccaccagagaaccacgcgccccacagcggcaataaccggcatccaccagagaaccacacgccccacagtggcaataaccggcatccaccagagaaccacgtgccccacagcggcaataaccggcatccaccagagaaccacacgccccacagcggcaataaccggcatccaccagagaaccacgtgccccacagcggcaataaccggcatccaccagagaaccacacgccccacagcggcaataaccggcatccaccagagaaccacgtgccccacagcggcaataaccggcatccaccagagaaccacacaccccacagcggcaataaccggcatccaccagagaaccacgtgccccacagtggcaataaccggcatccaccagagaaccacgcgccccacagcggcaataaccagcatccaccagagaaccacgtgccccacagcggcgataaccagcatccaccagagaaccacgcgccccacagcggcaataaccagcatccaccagagaaccacacaccccacagtggcaataaccagcatccaccagagaaccacgcgccccacagcggcaataaccagcatccaccagagaacaaagtgtcccgcagtggtgataatcagcatcaggcagagaaccacatgccccaaagcagtgataaccagcatccaccagagaaccctgtgccccacatcggcaataaccagcatccaccagagaaccacgtgccccacagcggcgataactggcatccaccacagaacaaagtgtcctacagtggtgataatcatcatcaggcagagaaccacatgccccaaagcagtgataaccagcatccaccagagaaccatgtgccccacagcggcaataaccagcatccaccagagaaccacgtgccccacagtggcaataaccagcatccaccagagaaccacatgccccacagcggcaataaccagcatccaccagagaaccacgtgccccacagtggcaataaccagcatccaccagagaacaacgtgccctgcaacggcgataatcagcatcagccagagaaccacatgccccacagcggcaataaccagcatccaccagagaacgacgcaccccacagcggcaataaccggcatccaccagagaaccacgtgccccacagtggcaataaccagcatccaccagagaaccacatgccccacagcggcaataacaagcatccaccagagaaccacgtgccccacagtggcaataaccagcatccaccagagaaccacgcgccccacagcggcaataaccagcatccaccagagaacaacgtgccctgcaacggcgataatcagcatcagctagagaaccacatgccccacagcggggataaccagcatccaccagggaaccacgtgccccacagcggcgataaccagcatccaccagagaacaaagtgtccctcagtggtgataatcagcatcagccagagaaccacgtgccccaaagcagtgataaccagcatccaccagagaaccaactgccccacagcagcgataaccagcatccaccagagaacaaagtgccccgcagtggcgatttccttcaggcggaatggggctcttttgtgataactttttcctgagccactttcaccctctcactcttctttctgatgtgtgcaccccaggctcattgatcatggtattgctacattttctttcagccaggttttgtctggaatttagtcagaactatgctgcagctgtgcaggaatgtgtggttggctggcagtgcccacatcttggggtgtcccaacctcctgctcactctcaaagatgggcagttacagtgaagacagtgagagtcaaatccagcttttcatgaatttttaaccctctgcctggatgtcccattttatcattaaaaccaccctgtgatagacccccttcctcagcttccccatgccatggagaaggctgaggcaagtccctcaaacacacacatggccccacagaaccaggactgacaccaacagggccttgactctgaggcctctgcccaactaccatgcacgccgcttggttgtctgctcacattaaacattacagcatcgagaaacattcagggaacagtgactcctgactcctgcagtcttcttcaggtggccattcctagggagaaggaggagctttgggaagccagtctttccctctctcctcctcttggagatcgcagacccatgggaggagagtaccctgagatgctctcagacatgggtggggtgggggtggaaagtctcagcctcatccagccctgcctgtgatgggctagcacttgaggacatcagcagcactctggctctgagttaggaaacctaccgccccaatcgttcagccaccttttctgcatctttgtccacctgactgtattgcaatggggtgacaagctgattaggaaaagaggtcttttgctgtgatcagttctcatcttctctcccacatttattactctttttagttagtcctttttttgaacacaagtctcctccctgcatctcaaaaacaagagccttgtttgtgaatcacataagaaagtgatctccaaattggggaatgcacaaaagttggagaaaaatgttggaacttcaacttaagagacttgtatgataaaaaatgcttttgcagacacaagaacagggtgtggtcatgacctgctggttcccaacaacacaaggagaaagaatggagcataaaagacagatctagggtgaagagaaatgagatctatacacaagacatgaagttagtcagggcttttctgacattggaagtcataggaagcctgtacataaaaaccaggttttcaaacaaccccataaaaaagtgggcaaaggacatgcacagacacctctcaaaagaagacatccatgcagtcaataagcatatgaaaaaaagctcaacatcactgatcattagagaaatgcaaatcaaaaccacaatgagataccatctcacagccgtcagaatggctagtactaaaaagtccaaaaataacagatgctggcgagaaaaaagaatggaatgtaaattagctcagtgggaatgagctagtgggaatgtagattagctcggccattgtggaaagcaatttggcaaattctcaaagaacttaaaacagaactaccatctgacccagcaaccccattactgggtatatacccaaaggaatataaattgttctaccatagacacacaggcacgcgcatgtccatcgcagcactattcacaattgcaaagtcatggaatcaacctaaatgcccatccattgtggactggatacagaaaatatgctacatatacaccatggaatactatgcagccataaagaagaaccagatcatgtcttctgcaggaacatggatggagctggaagcccttatcctaagcaaactaatgcaggaaaagaaagccaaatatccatgttctcacttatatgtgggagcgaaacactgggcacctatggccacaaatgggggagcaacagatactgggaactacttgagggtgaagggtgggaggagggtgaggactgaaaatccacctctcgggcactgtgctaatcacatgggtaacaaaacaatctgtacaccaaacccccacaacacacaatttacccatatagcaaacctgcacatgtacccttgaacctaaaataagagttaaaaaaactcaggttgtgcaggaggcatctgtgtgattgagcagggctgggtcctcctaatcatggctctcccacctgtggccgtgagtcctcacccaagccacctgcctcacaggatttgggtcccatttctgtaagataacggacagggtcaatgtttctaaaattctaccggcatccgatttactcatcaaaccatcagaccaagctacaaggcagggaaataggttcctttgttcagcagcgagaggactcagtcaaggtcatgtgtgaactcttggagcctgcgtggccgtcgcggcaatgacctggtgagaaggtgatgcctcagcatgcccaaagctgcatggcaggagaaggaagggctcagaatatttttcctggtgttgtttgggaataaccctgcctttagtaaagaattaaagttacacttacagagggaaggtaaaaggcaagaattgtcacaaagcataaatgggcgctgaacgctgagtataagaggggagacgcctgggcaggtgacctgacccgccaggccgctgcaggaggccgaccccagcacccttctggcagccacagggagtcgcacacggaccccatgcctttcacagactgtttcccaggaggcaaaatgtcagcaactggtgctaggagggtggtcagagtgaaagccgtggacatggctgtgacttctgggacgggcacggcgaggcactctcacacacactgtactgtggggccccaaataaaccaggaggttggcgtcagcacccacattctatgaatgggcaggagaggagccctcagcctggctgtgctgggggttgggccaggcccacacccgtgtgcccgctgtttctccatgtggccttcattgtgtttccgagctccgtgcataatgtcctccccggccaagaaataaaacagactgtgggacttggtggcaccaaagaggcaggtggccccctcagggaacacagctgcccagaagggcacatggaggaaaccgccgcagcctggcaggtgagccaggagggcacgtggagggaaccgccgcagcctcgggtgtgagccaggagggcacgtggaggaaaccgccgcagcctggggggtgaggatgcttcactcttatgccagacccacctgtcacggtggtcccccctcacgaggcctcgtcagacccagaatggtgtcagcatgggctggactgcacagtccagggactctttcatgggccaatgccctctgaccttagaggtgctcagagaagctccctcctttggaaaccctggctgctccgcaggtgaggttgctcagagtctgcatatgttgctccggacacccagctggcaagaggcagagccaggctcaagtccacatcctccagcttcccagaaggctttcctttggttccatcagaatggacacaccaggaccttttcggcaccctgtggacactcctgtgaccacagttgtcagagctcaactgaccccatgtcctcctgcccttgggaactgagccagcccagcctcatgcacacggctctgctggtgacctggattcccatctggggagctggctggacagaagggctgctgctgtgtttccccccgtgactctgatagtgaggacagcaccccttcttttttgagggacaggacaagaattgtagggtcatgtacagaatccacatggacgcatgactctgcccctttcagtctattcttagcatttgaattcctgtttcttggcattgaaatccagaacaactttgcatggatgctgcaggccgacacgtgtgcttgatggaaggatattcacttagatttctcagtttagataactgaataaagcctccacaccaaaccctgcaacctgagagccattttactaaacacttttcattttactaaaatcatcacaaatgaaccgtggttaaggcaaaagagagactgccggcagaggatgccttccaccactgtgtgtattatcatcatgatcagaaggaaaatgccctgtatttttttaaagacccattcacacttagtgtttgtatagtaactgttgttctgttcgcctttaattttgaatacttgagtgaattcacaattccaccgtgtgcattaatttagaaaaatgcattttaaaaacctttaatcgtggtgccgttgttacaaactctcattccactttattactccccatgcaccgacagggtctcagatgtatgggtgagagagtggccagaatgtggcagtgaaggagatggggcttgagattgggaataacgagttcgtctctcaccaaccgcgagaacccctcagcccctcagttcctgcccctcttgtgggtgctgtgaacacaggtgccctccaactctggggacctgaggttgtcaccgcgctttacttaaaaatgcagcatatgagacagttgttgttgacaggggcatgaactggctttcagtgttactgagtcttgctcttcagaatgatctgggagcatttgtggggaggaagacataaaatgcctcgagatgtggcatatttaaacagatttgacccccagccatgctgcaggctccagcctttacagaggcacttggtactagggaactaaaggcaagagcaaggccatcagaggcagagatgccaggggtgccccaccccgtctcctgctccagacactacctggggcagcaggccgggagccaggcccatgtcaggcgagggcacgtgggtccttgccttctcccatctgcccagggtcctctgtttcccattggtttggaaagctagaatttaatggaaaatactacaggagtgagaaaatataagctccagttttgggcaaaatgctgcagattgcatgtcaatggggacgtgtgcctgtttgctgctcttcaaatgttaccaagaaagcagcccccagcatatgtgcccatattggatacatcatgttgacctatggacatcttaacacgggttctattttctcaggatgtgagaactgcatgtgaacattccatcacagatccttattttcaagatgaggaagtgcaggcccagaggggcccaggactggcccattcccttcggttctgctctgacttcccagccccgcacgccagccctcaacgtgttactccagaaatgggattagaggagctcgtctggattttccctgaaatcccttctccctttcccgccttcctgatcataaagttgcagtgagtcgtgtcagaggaccgaggccttgtctccccagccggcgtccctgggacaagaatgagattgccaaatgccactctgagcatggttcatgcatctgcccgtttcattctcccagctgctctgtgagcgactgcttttggtatcatctcatttaggaatgagaagaaaccagggcacgggtacttggcactcaagggcttaggtcccacagctggtaagcagatgcaggagactggctctggagactaagctcaccaccttctccagggctgtggatggcagccgtgtgacctgtcccctgcccaggagaccactgaagagcacacagatcaggagccaggaggcctcagccctcacctcagctcttcacgcccatcggctacgagaccctcagtaagaccacgggtgcctcgacccggctggtgcacaaggagcacagccatcaacgcctcccgacagcgctcacaggtaacgccctcctctggaccccacgtacgcagtgcaccgaaggcacccccagtggacaccaggattgctgagaagggagctgaaataggctcagggtaattgggagatgaatgggaagagagaggcagtaagagatggagggaggtagagagatacaggaacagagagggatacggagacagagacagacacagagacagagatagagagagataggggtggagagagacagacagagacggagacagagagatactgagagagagagacagagacaaacagagacagggaccgagagagacagagacagaagagggagacagagacagagcgaaacagagacagtgggaatgtgaatcccgggcccctgcagggctatctcggtcctgtggtgcagtgatttgctgagcacggggtgtgccctgcattgctgggggctggggtgggagtggctacaaagtcatttctcatgggaggaacatttccctgttgtttctaaactctcaggaaactgtctgatgtctctaaagaaaccactgttgcctgtgctcgtggaaagctgattcaggaaggggtctggggagtctgggatgtgggtttcctgggtgagcggttgaggggcctctgtggtgactctgagcctacaggtcttgctgctgctgccactcctgggctgtcaggcgacgcctgagccctggagcctgtgactcttgccagcctgagcagtgcttgctccctgcggcgttggcccagactctgtctggagtgggtggtctggggcccttggccgggaggtgcctccctcggctgcctccatctgaggccctccctgcagctctgccccctaccccttgtgccctgctctcctcctcccaccccctctgctctgtctgctgtctgtttccaagggaacctgagttgacatggggagaagcagaattaagggctgtgaaggccccgagatggggtccaggtcccgactgctggctttgggctctatctgggcaccctgagactgtgtgaggatggccgggctgctgctgaggccaacgctgggagctgagtgcccatgcaccccagggctgtcccctcagtgagcccagcacccatccacctcagctctggggctcatgggaggcacaggcaggcatgcaagcgacagcggcccaggaagtcaccaggtgctgcgagaacgatggaaagaggcctgtgtgacaatgggggaaggagagagggctcaggggagagggctcaggggatgggactatggactcaggggaggtgtcaggcctctgagcccaagctaagccatcatatcccctgtgacctgcaggtacacatccagatggccagtttctgccttaactgatgacattccaccacaaaagaagtgaaaatggcctgttcctgccttaactgatgatgacattaccttatgaacgtccttctcctggctcatcctggctcaaaagctcccctgctgagcaccttgtgactcccacccctgcctgccagagaacaaccccccttcttcctttacctacccaaatcttataaaacagccccacccctacctcccttcgctgactctctttttggactcagcccgcctgcaaccaggtgaaataaacagccatgttgctcccacaaagcctgtttggtggtcctttcacacgaacgtgcatgaaatttggtgccgtgactcagatcaggggacctcccttaggagatcaatcccctgtcctcctgctctttgctctgtgagaaagatccacctacaacctcgggtcctcagaccgaccagcccaaggaacatctcaccaattttaaatccagtaagtggcctcttttttactctcttctccaacctccctcactatccctcaacctctttctcctttcaatcttggcgccacccttcaatctctcccttctcttaatttcaattcctttcatttcttgtagagacaaaggagacacattttatccattgacccaaaactccggcgctggtcacggacttgggaaggcagccttcccttggtgtttaatcatttatggggacgcctctctgattattcatccatgttccactgatgtctgatctccgtggggaagcctgccttggtcattcacccacgttcccttggtggcaggtcaattgtggggacgcctgccttggctgctccccacaaccaattctccatgcctctacccttccctttaaacttgcctccttcactatgggcaactttccaccctccattcctccttcttctcccttagcctatgttctcaggaacttaaaacctcttcaactctcgcctgacctaaaatctaagcgtcttattttcttctgcaacaccacttggccccagtacaaacttgacaatggctctaaatgaccagaaaacggcactttcgatttctccatcctacaagatctaaataattcttgtcgtaaaataggcaaacggtctgaagtgcctgacgtccaggctttctttcatacatccctagtctgttcccaatgcaactcatcccaaatcttccttctttccctcccctcagtcccaatcccaagcgttgctgagtctttcctctttccaatcttccttttctacagacccatctgacccctccgctcctccccaggctgctcctcgccagaccgagctaggtcccaattcttcatcagcctccgctcctctacccaataatccttttatcacctcccctcctcacacctggtctgacttacagtttcgttccgtgactagctctcccccacctgcccagcaatttcctcttaaaaaggtggctggagctaaaggcatagtcagggttaatgctccttttctttacccgacctctcccaaatcagttagcgtttaggctctttttcatcaaatataaaaatccagcccagttcatggctcgttcggcagcaaccctgagatgctttacagccctagaccctgaaaggtcaaaaggtcatcttattctcaatatacattttattacccaatccgctcccgacattaaataaaactccaaaaattaaattccggccctcaaaccccacagcaggacttaattgtacacctcgccttcaaggtgtacaataataaagtagaggcagccaagtagcaatgtatttctgagttgcaattccttgcatccactgtgagacaaacccccgccatatctccagcacgcaagaactggaacgcctgaaccgcagctgccagggtttcctccaggcccgtttacccgagaagcttgctacaagtgccagaaatctggccaccgggccaaggaatgcccgcaacccaggattcctcctaagccgtgtcccatctgtgcaggaccccactgaaaatcagactgttcaactcacctggctgccactcccagagcccctggaactctggcccaaggctctctgactccttcccaaatcttctcggcttagcgcttgaagactgacgctgcccgatcacctcagaagcctcctggaccatcacggatgctgagcttcgggtaactcacagtggaaggtaagtccgtccccttcttcatcaatacggaggctacccactccacattaccttcttttcaaaggcctgtttcccttgcctccataactgttgtaggtattgacggccaggcttctaaacctcttaaaactccccaactctggtgccaacttagacaatactcttttaagtactccttttagttatccccacctgcccagttcccttattaggccgagacactttaaattatctgcttccctgactattccctgactattcattgccgccttttcccccagttcaaagcctccttcacatcctccccttgtatctccccaccttaacccacaagtataagatacctctactccctccttagtgaccgatcatgcacccctcaccatcccattaaaacctaatcaccgttaccccactcaatgccaatatctcatcccacagcatgctttaaaaggattaaagtctgttatcactcgcctgctacagcatggccttttaaagcctataacctccccttacaattcccccattttacctgtcctaaaaccagacaaggcttacaggttagttcaggatctgtgccttatcaaccaaattgttttgcctatccaccccttggtgccaaacccatatactctcctatcttcaacacctccctccacaacccattattctgttctgtatctcaaacatgctttctttactattcctttgcacccttcatcccagcctctcttcgctttcacttggactgaccctgacacccatcaggctcagcaaattacctgggctgtactgccgcaaagcttcacagacagcccccattacttcagtcaagcccaaatttcttcctcatctgttacctatcttgtcataattctcataaaaacacacgtgctctccctgccaattgtgtccaactgatctctcaaacccaagcaccttctacaaaacaactcctttccttcctaggcatggttagatactttcaactttagatacctggttttgccatcctaacaaaaccgttatataaactcacaaaaggaaacctagctgaccccgtagatcctaaatcctttccccactcctcttccacttccttgaagacagctttagagactgccgccaccctagctctccctgactcatcctgacccttttcattacccacagctgaagtgcagggctgtgcagtcggaattcttacacaagagccaggaccgcgtcctgtagcctttctgtccaaacaacttgaccttactgttttagcccagccctcatgtctgcatgcagcggctgccactgccttaatacttttagaggccctcaaaatcacaaactatgctcaactcattctctgcagttctcataacttccaaaatctactttcttcctcatacctgacgcatatactttctgctccccggcttcttcagctatacttactctttgttgagtctcccacaattaccattgttcctggcctggacttcaatccagcctcccacattattccagataccacacctgaccctcatgactgtatctctctgatccacctgacattcaccccatttccccatatttccttcttccctgttcctcaccttgatcacatttagtttattgatggcagttccaccaggcctaatccccacacaccaggaaaggcaggctatactatagtacaagccaccagccctcctcttagaacctctcatttcctttccgttgtagaaatctatcctcaaggaaatcacctctcagtgttccatctgctattctactactcctcagggattattcaggccccctcccttccctacacatcaagcacggggattggcccccgcctaggactggcaactcttaagtccctcttagagtggatagatgatctttgctggcagaagacccttcaatactttcaccctgatgaagttctattctttcccattcttagggcaccctctacctctccccagctatctccaccacactatcaaccttacccattctctcctagccgcttctaatccctccttagcgaacatccgctggctttgcatttccctttcttccagcgcctacacagctgtacccgcttacatgcagaccgggcaacatctcttgtctccctacacttctgaacttcctttaacagccctcacctttaccctcctgaagaactcatttactttctagacaggtccagcaagacctccccagacatttcacatcagcaagccaccgccctcctccgcacttacttaaaaaacccttctcattatatcaactctactccgcccatatttggacctctcacgacacaaactactattcctgtggccactccgttatgtatctctcagcaaagacccactggaattcccctgggtaacctttcaccttctcgatgttcctttcctcctcatctccaaagcccaactacacacatcacagaaacaattagagccttccagttccgtataacagacaagccctctatcaatactggcacacttaaaaaccagtagttattgctaggaagacaccctgtatttcactccatccttggctaccttccccttgctcatcagactctcctcccatgccctcttcttgtttacttatacacagccccgtaaataacagaggttgctcgtagacactcgaacaaaaccgtatccaggccatcaccaataattctacaggactattccacaatatcaccccttaccacaaaatcatccttcagcttaatctctcccactctaggtttccacgccacccctaatcctgcttgaagcagccctgagaaacatcgcccattatctctccataccacccccaaaaattttcgccgccccaatactttaccactatttcgttctatttttcttattaatataagaagacaggaatgtcaggcctctgagcccaagctaagccatcatattcgctgtgacctgcaggtacacatccatctggccggtttctgccttaactgatgacattactttgtgaaattccttctcctggctcatcctggctcaaaagctcccctgctgagcaccttgtgacccccacccctgcccaccagagaacagcccccctttttcctttacctacccaaatcctataaaacggccccacccccatctcccttcgctgattctctttttggactcagcccacctgcacccaggtgaaataaacggccttgttgctcacacaaagcctgtttggtgtcccttcacaggtacgtgcatgaaaagaggagcctcaggggatgtgacaatgggcgaaggagagggggctcaggggagagggatcggggagcagggccctcctgggcatccttgggatggggaaggtggcaccccatgtgctctcccacatcccctctcctctctcggatgcacctctttcctttctctggttcatttaaacgttggcttttcccagttgccatctcctttagctgaccctgtcctttttggtgtaatgatgagtcccaaaggaagggggctcagccatcctaatggagccattgtctaccccagggaggctgtaggctctctgcttacagagccaccttcccatggggagcaagaccctctagcctctgagctccatggaggtacccaaggcggcaccagcccaggagggcagtggagcccctgcaggcaggtgacccgatcctctccagcttgcacctccctgagggctcccacgaggctcccatgtgttcaggagtctccaaccaccaggacatgatgcccaggtatgtgtccctcccctggctgcccacctcctcccacacagtcgggctctgcagtctttcaatcaactcttccctgccagtcagcccaccgtggtttctccctgtttggaactaataacaaacactcttgtcactcttgctgtgctaaatcatagacctctattttaatgaacagtgttctgtgtcctccatcagcctaaagcccttgggggctgggaggatggagcaggctggagtcttgaggatgagccccagccccacagaagctgagctctgctgtctgtaactgtcctccctgctccacccctcagtgactagactttggacgtgggactcaggtctccggaaactcaacgtccttctctgtaaaacagacctcaaaaattttaaatgagcgttactgtgcatgtaaagcacgtagaataatgtgtgacccagattaagtgcctgggaaatattagctgctaatggcactgttgttatcatcagtaatcatggctgtggaatagagacaagtggtgaagcttggctcacaggccctgcttaactaatggacagtcatattaaccatatttgaaaattccaaacatggtattgggaacctataggcttaaatacttatcagttacatattacaatttcacctaacatgttttagtaggaagtagggtggcagaagctattatataaatgtatatcgtacattgcatacattgtataaacatacattgtgattgcatgtacattgcataatgtatgctgtacattgtatatatgttgtgtaaacatatcacaattgtatatacattttatacatatgttatagaaatatatagcatacattgtatatacattgtatacatgtatagtgtataaatgtatatcatacattgtatttacattgtataaatgcataaatgtattgttaagcatctacaaagcctctagtgcctcattaaggaaggattttctgaaagtttttttttccatgtgtaatgacaatgagtgacctctcgctctttttctggccgtcagcacctctttcacagacccaggacacgaagaaagccagaaggtttggggatggctggatctgcaggactgtttttccttccctaaaagagcaccttgccttcctgcatggaccacaggatggtgtgtgtggccacaaaacccagaaggtgaggtgctgaaagaaagcaagctgctgggatcattcctgcttcaaagcaggtgatgtggccacaggcgcatgggaagaatggtcccagagacacaggcagccagctggggtggaagggcgtcctggggacccaccccctggagggcttcacagagaacagaaccgcctggggtgagctggtggaaaacaacagaacttcacacagccccaacgatccattaccaggacccagaacctcagcttcaacgaggctctgcttgtccccagtgactgaagcctcccagggcacttagctgacctggggatgatggaggggagttggggctttcatgctggccttccagggaagccttagggctggcccaagtctggaggaaaagctgcatgtaggagtgacaccatcttaaagcccattctttggaagccatcatgatgaaaaatggcacacactgttcttcaatctcacctccctccagccttctcaagcaaagcaacaacaacacactcatcaccacttctaagacacgagaactaacttcaaacaagccaattgtgaaatcctgatttttctccttaagtaagttatggaattattgaaaaccattaggaaggaagggctgattcctacctaactggtctctcttcagtcttctccctgagttacacactgagacctttgccacgacagaaatgacgttcgttttaaccccggattcctgggctttatggtcaggagggttcttctagggcccccactcacagcaagccctttgtaattttacacgtaagtgaaatcaacagtgactgtctgcacagggggttaaaagagttcctgtcagcaaaagggcagagacgtgaaaccgaactcaggacactgcaaagatgcttggctcctggcccacttgtgattatccctcctccattcgatttattcacaaagtgagtgagactgaatggctggtttctagccagaggggacttcaatatttgagtgagggagacaggaaaagacccaaaaatcgttagtgtccccaccctaggacactggcatatccgtgacctctctgagtgctctgagaaaaatgagggaggttggtgggcacagtggcagacaggtggctgctggagtctccctcttcccacgggaccctcctgtccctggcaccacaatctcacctcctttctcacttttcagttgcaaggagggatgcatggtttttttagcaaataaaatataagacatctggttaaatttgaatttcagataaataattacaatttttaaatgtaagcttgtcactgtattttatctggtaaccccttgcaaggagcctgcagaccccaagcaaatgtcttcccttaatctagaaaacaccttcacccaggatgggagcgacatgagccatcaggccttttatttgcttttaatatactttggtgtgggcataagtatcttaaataattgaacctgtaattgcaccataaaaacaatgatgctaatacaaataacagccaacaagcatggagcgcgtactctattgttgtagacacacgagccccagaaaaactctgtgcagaggagaaaactgagccacagacatgttagcaacttgctgaattaaagaccttttggtaggtctctgaaacgctcacacaggacaagcaggtttttcctacgtttgcacaaagctctgctgactgtaagtctttctctctggtgtagatctatatacacacatatgtgcatgtgcatcctgcacaaatagtgtgtgtgagagaggaagtaacagagagagagacagacagagagagaaggagaaaaaaatcaccctggacttagctctgggcatcaaagaagtggcttcatcttgacttgctgcctcaactgattgaagcaatcccaataattggtcatgatttttctgcaaggattcagctgcgtatttcttggtgtggggacagaggatgaacccctcaggctttcctctcactatggtgtctctggtgggaacagctggggatgcaaagccattatgatgtcggataggagagaaacctgctgtgccctcagcccttgaggattgcttggtgagaatgcggagccaggtccatcccaggaggaaaaggcccaaactctaggcagcttctcccagggacttcacagacactttttatgtcttgaatacctgcattcccagacccaaacccacagttcccagttcaaacacctggttctagtgccttttccgctgcccagggatgccccaggtgccaccgctcccagtctctccaagtctttacgcaaatataaagaacttctcactggcagggaataattcttacaaggctgtgtggcaaatggaaagtttttttttttcagcaaaacaaagattcttttaacatttgtagaaagtcattcaaggaactgtttctgaaggcactactttggagtttggactgagtgtgggagagtgcggggtgagggtgtgtggacaacagggtgtctttgcctgacatgaaaatttaaaaaacaaagaaataaagggggtacttgagggtgaaagataaactcacaaacaagtcaataaacttccttttcagagttactgagcacacaggtgacttttactgatttatttatttttactggcattatagtttactttattctcctttctaaatagttttcacagaaagaaaatgctgaaaagcattcctttatggttgcgtttttgcttaggaattcttttgatgctaggggtggggagcaaactgaagagagatgtaggttttgtgattttatcattttttatgatgatgcctccaggtagcacatatttatatcctgacacagtcttgttcttacttctgagtacccagttaacctagaggagtcttgagtggactgcagatgaggagagcatgaggggtttgcaatgagccaggcaggtgcacctgagcaggcactgcccctatcagctgatactcatggagaggagactggcctgcaaaccctctgccagtactgtaaaccctacatgtttaggtctggtgtgagttctaaggaatctgataaatgcctgcctttgtcactctggctgactcggatcccatgaagctgatgggttagatgagtctgatcctgagaaacacccccgggtgcaggaaatagtgaaaatcagatacgaagaagccacacctgtgattttaatctttatgaaaatatcatgcttctgaacttcctctttcaaaattcggatgacacacaagtctatcgtacgtcatctttaccactggagggtggcttcacgtgtttataaggaagctgatattgtgaatcccaacctccaccacaacgctcacccttacagacacactattgcaggtctccgagggcctttgggaggccctgcttcctgcgagctgtcccggcaggacagagactcttcccgccgcggccctgccattccaggctgaggctgtgagcagcaccatgacaagctccagccgcagtggctctcaacagtgtgggtctctgaccacccgacgagctggaagtgcagaccgctgacctcccttgagaacctactgggttcttgcagtaggctcctcagcggtgtctaaacacgccactcagatgattctatgcaccatcacattggaaacttttttcattgactgttacttaatgagaagacttccctccgggatggttctgaagcttccttcataggagcaagcctttggcggagagcactgagcagacgtgcagcatctttgctggcttctaccgaaacaccatggatccagacgtggttttgtggtcctgcacgtggaagccagccctgcgtggggtgagcctgggactgtgggcagagaacctcaagcaccgggccggcacccaagtgcagagactgcatcgtcccagcaggaggcgctgcttccaggctccctggacggactccgggagggcggcctttccccccagccccagaggtgggcctgcccttttccgagcgtgggacacagcccaggaaaacgcatggcttgtcctccagacacaggtgctaacagggccgtcagacaagggccagggactcaggcttttaggaatttcagctccagagccaccatgcagtgggaccaggggtctgcgtggacaggaagcaagctgtgtagacgggggtccatgaagtagagacagggttttggggaaggttggggcagggcaaggaggaaaagccacatttacagcaatttctgaagtcttttcattttttccccctgaatcacatccataataggatttgaatttaataaactgctgaaggttcctggccctgagtcccagtgtcctcccagcccccgcccagctgtgggtgtgcatggggagcggtacgagggagggtaaaatgggccccttggacgccgcgtgcagagcagagatgaatggcccgaaaccctcgcgctgctctgcgcccttcgtcatccagtcggggtggttagggactgtcagagaaaaataatttagcggccatggctctaactgatgtgctgcattctggggtcaaatgacttttacaaagtagtagtgctgcctggtttctccatcgtgagagctcagggctgacaacatgaaagaaaaaggcactgcagccagaattcactgacattcttcacatttcacatgagtgggacgcaggaggggggctggggagggtggagggatgtttcctgcttaacagattcaacagaagagtggcaggctcagctgggtgagcaaggtatcccagcgacgggggacacgccccagaccatgggtggtggggcttctcagaggaggtggcaggagacccgagcctgccaaggttgcacctaaggtcacgggcagcattaggagggctctctcccagtctccccacccccccatcccccctcccccaggctgcaggggtgaagtggcttccaggacggtcactggcaagtttaagctacagagagtgtagaaacagggtgaaaaaggaagagagaagggagtaaataagaaggaggtgtaagaaaagaccaagccaggccccagcgcccttgtgaggaagtgcccagggacttatgtggaagccatccttgctgtctgccaccttgtttttacttacattgtgtttttatttgagggcgagtttggacggcaagactgatggagattgtggtctaaatgcctctaacccactccttaaaatgaccaccggatgttccacaagtacttgaaaatgaatgaatggcttcccgagaggcagaaggcaggggtgtgccctaccccacgccggccaagagttcaacaagcattggttgacaagtgaatagtgagcacttgaacccagtcacaattcaagatgagggctctgccatgacgcatgtggtctgtgtcaccctgcagtctccctgagcagtgtctgaggttcgagtgggaccctacattcgtgaagagatttatcatctccccaggcaaaataacagattctgtcctaggtgttgtgatgtaacaatggtagcgatcacagccataacttacaattattgcatacttacgacgagtcccgcactgggctaagtgctttttaactatgtgaaatgtttctttccttgattgatgccaaaatgaataaagataattttctgtatctgctacattagtgatgcccacagataattctgaacatgataagagaaaagataatttgcataaatcagccattgcaagacttggcaggataagattgttttaaaatggtatcagaatagtttctgacagataggaggcaggaaaatagggtctggaggcaggaacataaggccggtgcacactgacttcctagagctgaatcaaatggaaatacttcagcgatgacaggaaatgtcctctccatttacacagggcctacgccgagtaaccaatggaaatctctagagggtatttaaaccccagaaacttcagtaacgggctcttgggcccctgtgctcaggtgctcccaccccgtggagtgtgctttcatttcccagaaatatctgcttttgttgcttcgttctttccttgctgtgtgggttttgtccagttctttgctcaaggcgccaagaacctggacacctccaaccggtaacgcccagacagttgagaacatgtctggagtgagtgaaggtaatcgcaggttagaaggcggacccacagctgcgcaggaaggaaccggaggggtcctgccgggcagagtgaggcccagctccccactctcgctccggcctcctcggcctcccagcgcgattctcccttggaccagggaccccgtctggatcctgccgggctggcggcctctccggctgctcccaggcacagggcgcctccctggtggaaaacttgaccccaattttacccggcacgaccatccgaccctacgcgtggagacccagtcacggacgaaacctggcacgggggacccgtccctccccctgcagacagaggcgccctggccgctccccacccggcctcgctgtctcctcccgggcagccgcattgtcaccctcaaaaccgccggcagcacctgttctcccatcaatcacctcaccaggccgggagacattctttcccctcccgctccacgcggcctctccttctccgagaagcctggacgccactcccaacagggaaaggtcggggtctcccccgcgcccccagcgccgcccgttccccctgcacccgccgcgcccctcacctgcggcattggcgtcctcctggccctgccgggcgcgtggccgggcatctggatgtcgaacagctcctgcagtgcggcctgcgcggcctgaccccgggccagcttcttgctgcgccccgagccctcgaacgtcctgccgtccacgctcacggccatcacgaagctccgcgcgcgccgctcggccggttctgccagacacacgtagcgcagcccggcgcgcaggcggttcagcagcaccacggggttgcgctcgcccggggccgcgggggtggcgggggtcgggcccaccaggtccagcgcgcggcacagcagccgccgtcgcccgtaggccgcggacagaagcgcggcgtccccggggcggcctcccgcgagtccggggcgcggcgccgggggctcgaactcctggaagagcgtgtcggggaaatcggcctggtcggaggtgaagtccgtgccggggcccgggcccccgcccatggccaggtgcgcctggcaggcgttggggaactgcacgaaggacctgagtgccagctccgccgcgcgcatcttggccttcttcttggtggggcctgtgccctcgaacgtgagcccgttcacctccaccgctaccgcgaagaccggggcatgcaccgggcccgtctgcgacactgtccggtactgcaggcccggcctcagctcgtgcagctgcaccagcgcgttcttgggcgccaccgaccacgacagcttcttccagaccagctgcagtttgcacaagtggcccccattcccctcctccagcggccgcttcctcttcgcgccgggcgcgccgccccgggcccggtccccggagggcggtggccgcgcggccaggttgcccacgttgcggttctccttcacctccgcgctgctggtacctggaggggagaacagaccagtcaggagcctgggcgggcgccggcaggtcgatgggcacagcaggcactccctgagggtccccgtcccagcgacctcgccgcccgcgcccccaggtcaggcctgagaaatgactgtggccgccagagagagggagcccctgggagcctatggcccatgcggggaagtagcgtccttggtcccttgctgagggcctgtggctaggagctgtcgtcttctgggctggctcctgttttaagtgaggctgtgtctcacaaacagacaagcgcccctgactttgtacaagttttgggcaatgtcaaaggtcagagaggcctttcccggggtggtgtggtctagtgtcccccttcccacctgctacagggacctccaggcccggtgcccaatgcccccccaatactgagggtcagggggtccggcccccaaactctacttcctcactcacagctagaggcagacaggtggtgtctcctgagaactccctggaggaaaccctaggagctggcccaggtgaggcactgcggccttggggtgagtccctggcctttctcctggagaaggggcacacctattcagtaaatacggttggtcctctgtattcctgagttccccatctagggattcaactaactgtggagagaaagtattcgggaaaaaatggatgaatcactacggaacgtgtacagacatttttcttgttattagtccctaaacaatacagtataacaatgatttgcatagcgtttacactgtattaggcagtatgcgtcatccagagatgatttaaagtacaggcatgcctccttgttcggcttcccaggtatcgtgttattcactaatccaaggtttgtggcaaccctgagttgagcaactctatcagcccactgatcccacaccatgcgctcaccttatgcctctgtgtcacattttggtaatttttttttttttttttttgcgacggaatctcactctgttgcccaggctggagggcagtggcgcgatcttggcccactgcaacctccgcctcccagattcaagcgattcttctgcctcagcctcctgagtagctgggattacaggcacccaccaccacgcctggctaatttttgtatttttttagagatgggatttcaccgtgttggctaggctggtctcgaactcctgacctcaggtgatctgcctgcctccgtctcccaaagtgctgggattacggatgagagccaccgcgcctggccacattttggtaattctcaaaatatttcaaactttcccattattatatctgttatggtgccctctgatgcctgatctttgatgttactatggtgattgtcttggagtgtcatggatcgcacccacttaagacggcaaacttaggaactgttgtgagtgttcccaccgctccacggaccggccgttccctcatctctctccctctgctcaggcctccctgagaagccccaatattgaaattaggccactgaataaccctgcagttgcccctaagtgtttagtgaaaggaagagtcactcctctctcactttaaatcaaatgtagggagaaggcatgatgatggccaagatgggtcaaaatctggtcccttgcaggaacccaggccacttgcttggtttctgcccctgggagtcttaccaccttcatcagactggcaagcactttaaaaagacctgtaatgtcgcagtgttttcaggtaggtaccataggtcggtggtcaggagcacaagcacagctcctttggaaagcattttgggagcttcgggcaagaataaagaaacacacaccttactcagcaattctgccactggagatgcatcctagagaaaccttcatacacagaggcagaactgaacaaaggtgtgcactgcagcatgctttcacaaaactgaaaactttgaaaatgcccaagtttctatggttagaggaatgatgagtcatcagtgaaataatcacactacagaatactatatagcagttgcatgtaatggactatgtctgtatgcttcaatgtagatgaatctcaagaaataggatgccagataataaaattgacttgcaaagtaacccataggataggatattattataagaacaccgacgttctatattcttcatgcagccatgcgtctgtgacaaggctgctgatgcgtgggtaataaagatccagtccagtctcccctggagagtgtaggagggaagtgcaatgaggggctggggggtgacttcacgtgtgacttcagtgctttatttcttttgcagaaaatgctctgaagtccatttagcaaaatcatcatttgccagctggggtgatgaatgcatttgatgatgatttaatttttctggactgaccatcctggaccactgttttctggcaaagctgttccattagggaatctcagccatggatggccccacgacctgctgggtccatactaccctcgctggtgaatgtgcttctggaaggctccatgagggtttactacaaaatactctgagaattatggtagtgagctgtgcccttgccccaccctgaggcttggctcatgcagaacctggactttgctgcttcccattgccccagtcagccctggggagggtattaatgtccgattttctcagtggggaagttcctttactgaggttgcagagtttattagttggtcgcagtgcagttcagtcctaggcatcggatcaccctcgtctgtgttgttgctgtaaaggtgattttatggaaactgattacttccatcattgtcttggcctatgtacagtaacacccttttctgggccctctggaagaggaagatgaagctgagcccacaggctgccccacgtgtgaccggatggtgagctgtcccaggcaagaacacacaggcttcccttcactcattggctttgtccgtggggacaggctcttctgccaggtgtggatgagttttttctcattaagcaagtggaaacttgaggcaatttttacagctaacccacaacttagaaatagaggttgagtgcggctggatgttgacacgtgcatctgctggccatgtggcccgaaagtcaagcaggaatgaggcctggctggcccagccccacgctccccgcccctcagcttatgacatcgttgttggagaataataaaaacatacatttcataggcacaaaagatgcccttgaaaatcaggcacctttgcgaggtatcctgacattggagaatgttcttctcacgttgcgcgctgcctgcccgttcagctcggggtgaaaacatccggctcttggcctcagctatcaccaccacctgggttctcctgccgaaggctctgggctctgctttgaaagtgctctctgtttgctaaaatctctatttctcatttgaattttttgaattgtgaggtggctctgttgttttctctggcaattatgtctaaaaaagtattaggtttggggaggtaattttgttcaaaatgtggatctgagagcttgattagttataggtgcacaacattcatttacagttgatggcggcagaaaccgttaccttctgaggagaaagggctgagtgcaaatgcttttgttaatcattatgcactttgggtatacatatagcactgctctactgttgagtgtgtttcaggccaagggtaagcagatgagattaaccatgggattttccaaattgaacttaaagatggagcaaaaaacccaacaagatcaaccccccaaccccataccagattgcatagagatttgcctggtactctgtaatttcttattgatttctcgcaaggtggggatggacgagactgtcagtgtgattacagtggctggcgttattgcatgacctttgctggatctcagatcagaactcacagcaacgctttgccgctagctgcgctgaatgcctcttcctgactcaatgtcctacgactctcagaattaaagttttccatggtataaaccatgaatgtcagattgtggtataagagcctctttcataataatcaataattgataataagagcatacttcaggggcctgtcctggacacaccagctgggccctctggggggtgatatcacctgattagggtttggaatcctctgcacaggccccgattcccatttccctgacgtgggagcccagcacagaggccacagcccagcggtggcctctgcatggagctgtggggaacgggggcgcaggggacactcgggctctgctccatcgtccaggggtacgtgaccctgggcaagtcactcagtctggccaactgattttttaaggcagaaaatgaagatttaaaaaatatttgccttacaagtttcttacagggacaaacggaggcagcacatcaatgggctgagtgagagtcggccgtgagggaacatgggacgcattttgaaaacacagcagggaaatggtggggcagacacttctcatcctcctctcagccgcatctcgcccaccttgcttctctctgtccgggccctacttctctccctgctcatctttttccctgagcttctccgtgcactttgcaggaattccagggaacctgaaagaagggtttccagggcctcatgtctgcgagtcgcgagctgtggctggggttgcgtctccctccttgagaggagtttttgagggagttttgctccctcagaagggccgagagcagcattagcttttccacacacaacaaagcctcctctctctctctggttggcaaggcaagaattcgttctcacaaaaccttccagaacctactgagtcaggtaacagtgcaggtgcctgaggcatacgaagggaaaaacaggctttgcctctttggtccctcaggcccaagtgggagaagccttgacactatgaccctgtgacagtcctggggccgggctgggtgagggtgggagccgagctcgccctgtggcagtcgtggggccgggctgggtgagggtgggggccgagcttgccctgtggtcctgtggcagtcgtggggctgggctgggtgagggtgggagctggtcctaggggagtggcgctctgggctctgaggctgttggaaaatggaggagctcacgtccaggtgccgcccctggcggcctcttgctgtagtgactgcatgtgaaccactcacagctttaacgccgactttacaaattaactttttttccttccacacggaaggtattaaatgtgttagactcccctccccgacccaggaaattggtctcatttttttctccatataatcaacaggtttctcacactcagtcatcgtatataaaaacctagagataaaacatcaggagaccaggaaaacacctgcctctaagtagaaagctattgatggaaagctattgttgacgcacctgcttggtgggtcttagatccgaattcctgcactcaccagggtctctactcaataggccacaccctgggggtgaggggacctgggggactatcggcctcccctcttcatgctgccctgtggaagttaccccctggattgtgtcccaaacccctcactctttctctgtgcgccccaagtctgggtgttcccgctggccagcagggaagatgatagcggctgttacccacacaaaaggcagtggaaggtgcaggtgatcatttgcttgactgtggtaactacttcactaagtgtaagtgtaacgaaacatcatgatgtacgcctgaaatatacacaataaaatacattttaaaaagtcagcctgacttaggctcacaaagcctgattagcccaccaatggcagctctgccctttttccgagagggtgggcatggccacgcccctcctgagtcatcccctctgtctctgatccctagagcaggcacactgagcttttccctggctcccactttttgtactttgtccctgtcttctctcaggaagctgtctccaaagctcgaggcacagattggtgaatggactcgttgtctctggggcacagaggtggattccagtggctgggtgctggcagtgtgacctggcccatcacgcggttcacaaatggaacctaccacatgggccttgttagatcaatggagacagtgcgtgtaacagttttagcattctctgtcaaatgttgcagacactcagaatgcgtgatttcagcaacacatcaaaaagataattcatcatgatcaagggggttttattctagagatgcaaggatgaatccgcatctacaaatccataaatgtgatttaccacacaaacagaactaaaaacaaaaaacatagggtcatctcgacagatgtataaaaggcatttgataaaatccaacatcccttcatgataaaaactgtcaacaaactaggcattgtagacacatacctcaaaataataaaagccatctatgacaaacccacagccaacgtcacacttaatggggaaaagttgaaagcatttccctaaggactggaacaagatgatgtccactctcactacttctacttaaaatagtactggaagtcctaaccagagaaatcaggcaagagaaagaaataaaagacatccaaattggaaaagaggaagtgaaactatctctgttccctgatgacataaatgtgtgtatacctaggaaaccctaaagactcctctaaaagactcctagacttgataaatggcttcagtaaagtttcaggatacaaaatcaatgtataaaaattagtagcatttctatacatcaataatgtttaagctgagaaacaaatcaagaactcaatcccatttacaatagccacacacacaaaataaaatacctaggaatacatttaaccaaggagatggaagatagctacaaggagagctacaaaacactgatgaaagaaattgtagacacaaaccaatggaaaaccatcccatgctcatggattggaagaatcagtgttgttaaaatgtccacattgcctaaagcagtcggcagattcaatgcaatctctatcaaattccaacattatttttcacagaattagaaaaaacaatcctaaagttcatataaaaccaaaaacagaccctgaatagctaaagcagtcctgagaaaaagaacagatccagatgtatcacattgcctgactttaaattatactacaagtctatagtaagaacaggatggtattggtacgaagatagacacatagacccacggaacagagaacccggaaagaaagtggtccgtctccagccatctggtcctcaacaaagctgacaaaaataaacaatggggaaaggacatcctagtcagtaaatggtgctgggaaattggctatccatatgcagaagaatgaaactggacccctatctctcaccatatacaaaaattaattcgacgatggattaaagacttaaacataggacctgaaactataaaaatcctacaagaaaacctaggaaaaacttctggacattggcctaggcaaaagatttatgatgaaggccccaaaaggaaatgcacaaatccagaaacagacaaagtggacttaattaaactaacaagcttctgcacagcaaaaaataaaataaagtaaaataaaaaagtaaacagacaacctacaaaatgggatgaaatatttgcaaattatgcctctgacaaacggctaatatccggaatctgcatggaattcaaataacttagcaagaaaaaaccaaacaactccacaaaaaattgggcaaagggcatgaacagacatttctcaaaagaaaaaatataagcagccaacaaacatatgataaaatgctcaacgtcacaggggaaatgcaaattaaaatcacactgagatgtcatcttaccccagtcagaatggctattattaaaaagtaaaaaaaaaaaaaaaaaaaaaaatccaacatgtttgtgtggatgcagagaaaaggggatgcttgtgcactgttggtggaaatgtaaactaattccacttctatggaaaacggtacagagatttcttaaggaactaagaatagaaccaccatttgacccagcaattttactgctgggcatctacccaaaggaaaagaaaatcattacataaaaaagacgcctgtacgtgtatgttcacctcagcactattgacaatagcaaagacatgtaaccaacctaaatatccatcaacagtggatgaataaagaaaatgtagtacatatacaccatggaataccatgtatccataaaaaagggtaaaattatgtcctttgcagcaacatgaatggagctggaggccattatcctaaatgaactaactcagaaacagaaaagcaaatactgcatgttctcacttatgagtgggggctaaacgatgggtacacatggacataaagaagaaaacaacagacactgaggacttgagaagggggagggaggaatgggtaagattcgaacaatcagctatcagtacaatgttcactatttgggtaatgggtacactagcagcccaatccccaccagggtgcagtatacccacgggacaaacacgcacatgtatccctaagcctaaaataaaattaaattaaattaaaaaaaagttttgaaatgacctatcaaatgttgcaggccctcagaacacattaattgtgaccatgaaagacactgtaagctgccaacaccttttgagggcatgaagagggaggtgtggggcccatctcacagggtggtgccagggatttgggatcaagaggtttgaagggcctgcattataaaaatgatgtgatttggaaaatgcatttatttgcacttggaacaattcaaatagacagttcaaaatagagtataagaattggtgattcctttagtccactccgaaatttattatcccaaataattattattcttgccggtcataattgcatactcatagtatattagagctgggagtaggtctgcaagaaactcatatgcttacaccagggcagacggggaacacttgctatgttagctgcacgtcaggattcttagaaaggtttagcatctaaccaaggagatgaaagatagctacaaggagagctacaaaacactgagaaaagaaattgagacacaaacaaatggaaaaccatcccatgctcatggaatagaagaatcaatattactaaaatgtccatattgccccaaacactcagcagattcaatgccatccctctgtcaaattgccagttatttttcacagttagaaaaaacaatcctaaagttcatatggaatcaaaacagatcccgacttgacaaagcagtcttgagaaaaagaacagaggaggagagtaccactctctgtctgtctccgtgtctctctctgtctctgtgtctctctcggtctttgtctcactgtgtctctctgtctctacccctgtttctgtctctgacacacacacacacacccacccacacacacacacacgcgcgtcttgttggtaaaggctcctcagagtcactcactcagactggaaactgattcttaccaacccctggagggctccagctggtaaacagtgcctgagtgtgtaacataaccagtgcgtgtacgagtgtgtgcccgagcatgtgcctgtgtgtgcacatgtaattgtgcatgtgtgactgtgtgactgtgtgcatgcgtgtgtgtgtgcattatgtatactttgtgtggatgtgtgtgtgtgcatttgtgtgtacacctacatcagctgggtgggaaatggcaggggaactgagcagaaagcaggatggcatggtggccctgggagacagcacagctcccctgccctcttgccctcactggggctcacaccacacttcttctccctggaaaattcctgatgtggactccatgcacctttcctaatgagaccacgtggactccgcgcacctttcctagtgagaccgcgtggactccgcgcacccttcctagtgaaaccgcgtgggctccgcgcacccttcctagtgaaaccgcgtgggctccgcgcacccttcctagtgaaaccgcgtgggctccgcgcacccttcctagtgaaaccgcgtgggctccgcgcacctttcctagtgaaaccgcgtggactccgtgcacctttcctagtgaaacccgcttccagtgagactccgtgggtggcatcccggccacccacgccctggcatgtcctcctgcctctgcaccccagccaagcacctcattctggagacctcttagaatgaggcatctgtgaactgtggcttctctgaggtctttgtgggcggcaccaggttttcagagagctgcacgtatccttccactgtagaaattagagaaaagcaggcaaataatttggaactattgataaataccacaagccagggtcataggacgatcatgagcaatttgaaaactcagggaggcatctgcatgggaaaatgcaaaatgaaatgatttccatccacttctcccacgggcaccctccagagcctcatacgcacgtgaccttgtttgatacggtgtccggaatgtggtgctaagtctaaagttttaacgcattaaaggacagcatctgggggagaaaggccaacgctttatattgtcatgactgtggtgaaacttttgctttccaagtggaagctgttccggttgtgcaaagccggatggcctaggctgctgtctttcaaaggtggagagcatgtgcgggtggggccaggccgggtgggtctgccctccctctgcccgccgtatgcagcgctgcgcttgctccagagctcaggcatcctctcctctggctcccgccgtccgtcctctgctgggccgtttgcacgcccggcttcccctgtgcggtatcattgggaccgcatgcatcactaatgacgctgcgtgcctgcgggtcagacgggctcccgggagttagtcaggcagcgcgccacgctacattggaagagataatgttgcttctggtgaaggttattctgcggccgagcagccctttccctccatgaagccccacttagggaggggaaggcaggtgcctgggttctccagggcaaggcagagggtctggaagcgacaggaggcaggctggggccgggggtgggaggcagtggctcctggcatttgtggagtggacactggcaggctgggcagctgcagaagggcctccttcaaagactcgtcacgcaggaccccatggggctgggcctgtggtgcatgggactcaggaaggagcaggtgcggctgtcaggaaacctcttttcagcacaactccagggcccagggccgcctttgtgccgggcagccttgggctcagctggtcctcgcagaactgggtcggatcccaacctctgggcggtggtcagcagagaggttacagtggccagatggcagggactcatggctgctcagtgttggaagagaaaactcctcagaattaactgccccagggcagacacgccttacaaacgtggagttgttcggtccactcagcccagaccagcctgtgggtgatgggcttccagatgcggctcccaggcccacttcccgcaggtataggcatggtgtgtgccctgtgagcctgttccccgctctgcacccttagatgaagggcactcagtcccagacaaaagccatgaccctgtgaggttgtgggcatccagcatccacagggaagcacatggtattccccaaaggtgcaatacacgccaggtgggatgagaactgtcctcgtattggagcccttagacacacagactcacagggtgtgaaacacgggagaccggaggaggcagggcaaggtcatgtgtgctcctaccacccacccttgctcctgacatatgtgcgtgcacacatgtgcacagattcacacgccacacacatgcacacacgcacacatgtgcacacacatgcacacacgcacacacacaccacacacatgcacacacacacgtgcacacaccgcacacatgcacacacatgcacatgacacacatgcatgtgaactcccacaccacacacgtgcacataccacacttgccacacatgcacacacgtgcacagacacacaccacacacatgcacacacacacatgtgcacacacacgcacacacacgcacatgacacatatacacgtgaactcacacaccccacacacgtgcacgtaccacacaccacacataccacatgcatgaacacacatcacgacacacacacacacacgcacatctttttctaccttcccgtgcatctggattacaaatggataaggccgcgctggcaatgccacagggatctaggaagggagggctgattcatttgccggtttgtctttgaacaatctatgaaaataaagtaaataaacagcatctacacaaaggggagcaactagtacattggttgaaaatgagactcctcaagcatttcaagagcattttaactaccataaataacttaaagttattgttacctctaagtttctacccattagcatggaggctctgagagttacataatgttcacagcccaaggcagcttggctgccaggacagagcctgaaaggcttccagaaagtccagaaagtcttggcctcatcaggccctctcctctcctcactgcccagtgtgggggttcttatgggagggcagggggaaggagaagctcctacgtggggtgggcacgtccctctctcaggaatctcacgggcagagcagtaactttcccatgtagtcaggtggtttatttctccaggtcttggcctctagttgctacagaaaggcggctgctgcacctctgtaagtttgaaaccattcgctccgcaccccaaatgtcctctggcccttgctgaagcttcatttctttttctcctgagggagaccagctccagccgggatcccagcagctccaggtgtggaagaggaggaaacagtgaacttccccttcccacgtgtttccaggtccacacgtcaggctcagctttggtggggcaggggggtgggtggggggggttgtgtgctcctggggtgtgtgtgtgcgcatgtgcttgtgtgctcctggggtgtgtgtgcgctcctggggtgtgtttgtgtgcacccctggggtgtgtgtgtgtggtgcgtccctggggtgtgtgtgtttgtgtgtgctcctggggtgtgtgtgtgcgcatgtgcttgtgtgctcctggggtgtgtgtgcgctcctggggtgtgtgtgtttgtgtgcacccctgggatgtgtgtgtgcggtgcgtccctggggtgtgtgtgtttgtgtgtgctcctggggtgtgtgtgtgcgcctctggggtgtgtgctcctggggtgtgtgcgtttgtgtgcgcccctggggtgtgtttgtgtgcgcccctggggtgtgtgtgtttgtgtgtgcccctggggtgtgtgtatgtgcgtgtgctcctggggtgtgtgtgcacacatgcacatgcctggtgtgtgctcctggggtgtgtgtgtttgtgctcctggggtgtgtgtgcacatgtgcatgtgcgctcctgggttgtgtgtgcacacatgcacatgcctggtgtatgctcctggggtgtgcatatgtgtgtgtgtgctcctggggtgtgtgtgcgcatgtgtgtgtgcgctcctggggtgtgtgtttgtgtgtgctcctggggtgtgtgtgcacacgtgcacatgtctggtgtgtgcttttcactttctctatcccagatttcagaagtagtgatcaataaatggactcatctggaaattttccagtttgggtcaccagagaacagaagcaacctgtgtcaaagcttagcttgaatctcaagctgtgctagagagggagcacagagtctgggcccagccctctctagtgccggcacaccctcctcctaaccccctccttccacgtctagaagagaaggggtccaaaagagggcattgaccttcgctctggtcctgacactcaaaggctgtgatgctacttttgcagaacaacctccatttccagtatagttaattattatgctgtctgggaagggctgtgtttcccacgctgatggcaaagtacacggctccccttgcagacccctcccactgcctcttgttggtctgaccagcaatcccagggtcacctcgcctcctccccatcccgtgacaacaggcgtgtgctgacctcttcctggttgaaaaaggagccatttgccaggtggtgttaaaatttgaggagctgttcacatggtgtggaatgtctcgtcttctttgttaaatgcctgacaatttgctgtgaaccagaggccagctcctgcagccacacactcctggatcctcacccctgcagtctgctcccgagatgccgctcagatccctttcctaaaccagcctggtgccatcctgaggacactgcttggcccctttccagtttcatgtgccagaaatatttgcacggtgtaggggggctcctacccagccctttccttgttaaatacttgtacaaaccgcgctctaagacaccgtgaccatttttctttctggtctgatggaaaaacaaaggaaggagaggagagaatagtccaagaaaactggttaatttcttggaataatttctcagtcccagagacattactgacactttcctgccctttaggtaaggaagggatgccaggtgaggatgggactgcaggtgcgggtaaggttccaggtgaggataagattccaggttaggatggaactgcaggtgaggatgggactgaagatgagaatgggaccacaggtgaggatgagactgcaggtgtgggtaagactccaggtgcgggtgggaccacaggtgaggatgacactgaaagtgaggatgggaccacaggtgaggatgagactgcaggcaagggtgggactgcaggttacagtaggactccaggtaaggataggacctcagatgaagacaggattgtaggtggagataggattctgggtgaggacaggacctcaaataagaaaaggattccagctgaggacagaattgcaggtgtgggtggggttgcatggaagatggggattctgtggaggaatgagagcagatactgtctctccaggtaagaccaaacagaccctcccagatgaccccaggtatctcaggttttggggactgcaggggacccctgcacaaaggatacaggggcctttgtgtacttcggggaagggaagttgcttactgagggtgtcgtcatcctccgtgtttgtgatgccaggactcaggtgcttgaaaggagcgaggaaggttgacaatatgcttactttatctggaaagaaaagaacaggaaatgcacttttgacatggagttgcggaaaaactcaatgcttttataagttcttattactgaatgttggacaagggaggtggagaggtcactttggtttcagccatttcattctggttcagtcttttattgaatatctgacagcattttatcaaattcctctctccactcaatttaaaactctacgatttccttctttctccttctcttattttggcatcccccttcatcttgcccatgtcccttaaaacttgctatctccagggcgacaaccttgcatctgtttacaaaatcctgggtagggcagagccttctgtcgagatcatttcacagagatgggctaaaacaagtaaaacaatctcacaattaaaagagaatggtgccaataaagccaagactatcttttcctattagtgcagaatttgctttctgggcttgacatgcattaaaaataaaggacctgtcacttagcgggtgtttggcagaagtagaggaggggaggagggagctagcggtgtggggcagagcatgcacagtcctcccggaaacggccaagcgtcctcaacgcggtggctggaattccagggactgcctctgcctgaagcctgtggccaggtaagcaaaggccaagcaggtcctgcctcctgggtccctaccacagtgagtgcagcacagctgtggaaatagatccaaccaggagatgccgctcttcaccaataaagtatgcttttttactcccatggtctcagcaatttatttcatcaatagcgagattaaggaatggtgggtttgaggtatgattgagagaaataaaaatgactaataaagggatccaaaagaaaagctccttaatttggagatttccaccacctaaatgaagccaccgcacttgggagtattggttcacacggcagaactcactgcactgcagaggagacgccaacagagacacagcacagggatcccctggctcccagacatcctccagcccgcacggttcacatgtgccattatgaacctggaccacactgattaagacgccccaggtggaaatgtcagcgttgctcatccaacacggtgcagagcgcgacagaagcatgtcctagcatccctgctaagttccagggcactggctgtggtattggctactttgctaagtgggattcttccctctgttttggaagctgtggatatccgcggacgggatttcccaggaggtcactgagtttacatcaccctgtaacaaggacggctgtccacaggtgccccaccgtggcactgtatacctccttcagtgtgatttctcaagaaaacatgaactgctggtttcatctgcccttggccttcaggcgtccagactcagcctgaaactggctctttttcttttgaggctgagcctgttttctccttagccaagatttccagagtccaggagagttcccattgaaattcattcgggagcctgttaacagctgttgtttccagtagggacgggcaacagagagaacaataaataactcaaatataaaatgcctttaccttctttgttctaccgaacaagaataaaccagggaagggtttgctctcctaaacccttgcagccgaagctaatttactaccagagaatgaaatatcttgcttgaattataatttcattaagggagtccaataatgttacactaagagtgtgaagctcaaatgattcagtctggaggatctcaagatgaaattacatttttaataaagtagggctaccagccaaacactcacaaaaatgcactaaactatttcagactttactttagcaaaattgtaagatatttaaggattgttttagatccatcaaagttgttactttctgatgttgttagatttatcaaataaaaattcaggacatccagttaaaattgagttttagataaacaatagacaattttttcatatatagtcatttctaatattgtgtgggacacacacatatatatttgtgcatatacacacacacacacacacacacatatatacttaaaaaccttattcatggtttgtctgaaattcagtggaaggcaaaggacttcaatagacatttctccaaggaagatgtactaatgtcaataagcacatggaaatgtaatcaacatcactaatcattagggaagtgcaaatccaaaccacaatgaaatacctcctcacacccattaggatgtttattagaaaaacaaagcaaagccagaagataatgtgttggtgaggacatggggaaatgagagccctccgggaatgtaaaatgggggaactggcagttctgcctgctggcgggtcaatgcccaaataatggaaactcaaggagagatctgcatcctcatatcctcggcagcatcgtgcaccagagcccagaggtggaagcaactcaagtgtccttcagtggatgagtggataagtgaaatgcggtacagccaagcaacagattaggcagccttaaaaaaagggaaatcctgccatttgcaaccagtgtgcatgaaactggaggacctcatcctaagtgaaatgtcaggcatagaaagacaaatactagtgcatggtctcactcacacgtggaatctaaaaaagttgaattcaccgaagcagagagcagcatggtgctgccagggtccatggggtgaggggagaaaggagagagtgaggaggtgttggtctagggtacaaacttccagtgataggatgaatgagttttggagtcttaatgtgcagcatggggactctggctaataacatgtattgcccacttgaaatgggataaaagagtggattttaagcatcctcatcccccacaatggtaactatggctggtgacagatgtgttaattaatttttggtgatcgttacccaatgtatatatcaattcatcgcattgtacaccttgaatatattcaacttttatttgtcaaataaacattttaaaattaaaataaatatggaaaaaacaatggcaaaacaaaatcaaatgtaactgggcatcctgtattttctctgacactcctagttatgcctaaccaacttctctttccacgagtgcagtggacttcagatttcatgggacagcttgagcaaccaaactgaagcaaaggaaacagaaggccagcagaattgctaacacttatttattgctaacaagtacacctgaaattccaactatgatctgcaatcaccgtgaaggcacataagctctgggagagaagcaattatttccaagaaagggcagaccgcatctttagagtgttcttagaaaagaggtgaagaattacatttttaatatagaaaaagtacaacagaagttctttggcatcagggcctctctttgtggtttcctcggaactcattgtccatttgggatctgatgtatattctgttagttcaatacgagtggaactctgatattcagctaattcgattttttgcatgtttctcattgtcatcttttggaaatctggttttactcaagcttctgatgaaaaaaggatgccatactttttttttttttttgcctcagttctggaccttcggagtgtgccaggagaagctgcatcacagggctccccacgctaccgccgcctccccaccctctgggtaatgcctagaagaggcggctgggctggccaggtgttactctagaaacgtcaggggtcggctgggcactccccactcctcagctgctcacatcctgggttcttgagctcgggctcccatcatcgaatatggaccagctggaaactgacctgggggacgcagtggcctggggccggccctggtctaagagtcaagagtctttttcaggaaaggtctgatggccgtttttaatgtacgacttgtaagttccaggacacttgctttataaaccttgttactcactgtggaataaatggcatttacctgaagcaattttatgtattttagggggcatctgggtgcacatctggagggcacagcagcccttgcctggaaccacgtgcagccatgaagtgcagttggcatctgcaacactgaggttctgaggttattgtcggtttttcatattacgaccgtttgggagaattactacactgtcagggctgagggaaagagatactcactggaataatttttaggtattttcagatttcctaatcatcttgtttagaaacaaaatgtcctgagttaatagtttacttattgtttcttgttaacatcttggggtgaggattttccttgagtatgattaaaaaaaaaaaagcgatggcttattttccctgaaaggcacatgtggatatgccagcagtttttcatgcaatatcaggaattcatgagtcccctgaattcatcgccttccccagaatgcttgatatgaattatcaggctttaagaacatgtggttgaagtattaggtgttagtgtactttgaaaatcaaaataactgcacatactgaggatacctggttacttggttattagtcacactgcatagtcactgggacacgtcttagctttcttgatgtatttattctgcaaagaatctgagacattgagaagttagcggatgtgcccaggactatctataaggtcctcagcacgtcccaggcttccagcctacagttgccttccacactgagcaaaggctgcttaaggagatcctcattttcctatctttttctgcccgagtaaagtttatccttgtagtggctgctgaattttctggatttttcttccttgcctttgcctttgttaaattttattgaaccttctatgtttcatttatcctatctttaagatcagaacagcatctttgtttctcgggccacaaaaggaagaatagtgcaataaatagtttttaattcaagtatgaaaagcatttaaatttagggtctggttaatattttgtagaaaaatcagatggactctcctctctgcagaagtaatcacatacgatgtgttcataaacaagttactggggttggctaaaagccccagggatagacggtgcagaggaacattccctcattgtgaagaaggagagccagttctctacgcttcccggtccaaggaccgtgactcaacaccattagcagagtggggcacagtgagttttcagttctgtcttaccaaattctttctgatctattgaaaccaaaaagggaaatggtaagtgcattatagcctcctccaaagtgagtctggagaagacaggagtgtgtgaagtgatcttgagcccacatcacagtcctagaaagggcaggaaggaaggctttgctggccgtgaatggacaagcctctggccaggatgagggagttgcagctcaccagctgtctcattgtaaacaacagcaaaactggacaaagtctatgaaacaaccgttttcagagtttggatgccaggcagtgcgtgaccattgttcctgagaaaaggaaagcatgagagtgcaccccacagctccacaacttcccacctggaagctcttttcagcagtagaaaagtggacctggagaagaacacagcagcactgataagttgagaaggcaaaaaccaaagtttgcactgctgagacaactagaatttgagggcagaaggaagctgcttcagagatctggtggggccactgctggatttggttgagactcagccccacatgagaaggagagactcagatttcacagagagcagtggctggggacctgcgagctgaatgaaaattcaaatgatggcacaatgctgaaagtctggcattctgatcaggcggagtcatagatcactgaagagctaggattcagctgggattgtaaaaaggtcatgttttaggactaggaatactctagtcctagattaagaactgccgtgaacatgcgctaacaaagacttaaaacaagctttgaaatcatctagttgatcatttcaactagaaactggtcagtaataaactacccttggtcagtaataatctacctgctagaagaaaactcaaggaacaccgtgaaatccatattctgaacaacatggtatccacaaagcccagcaaataatgatagagtaatagtaatgacattgctagaagtgagaagcagcaggagaatatgaccaatcatcagaaaaaaatatagtcgaagtaaaaagatctaatgatgctgaaattagcagataaggacattaaatagatgttagaaatatttttaagaatttaaaaataaaggggatatgataagtaaatagatggggaatcttggtagagaaatggaaactatataaataaaacaaaaattctcaagctcaaaaacataacatttgaaatgaaaaaatttactggatgggtttcacattggatatgtcactttgcaaaacatatcagtaaatttgaaggcagatcaatagaaacaatcaaaactaagcacagggagaaatagaaaaggtgaaaaaagtgacagactcaacgatctgttggacaatataaagcagtctaacttatgtataattggaattcaagaaaaaaatggaaaaactgttaaggtagaaaatatactttaaataatagtttaaaagttttcaattcttttagacacatcaaatcacagatccaagtatctcaatcaaacttacatagaataaatctgaagaagactgtaccaatcagcacagccagattcctgaaaacaaaagatagggaaagtattttcaaagtagccagagaaacaggacatcttacatacagagcaactgcaatgagaatgacagaatacaaatcaaaaatttgctaaaagactattaactctttaaatacaagataatgacagtgtactgtaatgtttattgtatatttagaaaatatataaaaagagcagcacacaccttgggatggggtaaatataattattctgttgcaagtttcttcctttgatcatgaggtagttggctatgataagttaaacatgcatgctttaatctctagatcagtcactaaaaataatacaaagaggtatagctaaaaagtcaacagagaagataaaatagaatactaaaaaagattgatttgttgaaaaaggcaaagaaagagaaacaaaaaaattgaataaacagaaaaaaattagcaatatggtacacttaaatccaaatatatcagtaattacattaaatgtaaatggactgagtactccaattaaaatgcagagatattcaaattgtatttaaaaaacaaaacttatattttttattgctacaaaaacttacttcaagtataaaaatatagacaggttaaaagtcaaatgactgaaaaagatacatcatgtaaatgcttattttaagaaagatggaatggctatgttaacaatagacacagtagttttcaaaatatgaaatattgccagggattaagaaagacatatcacaatgatcaagtcatcaagataatataatacttgttggtgtttatgcactcaacagagttttaaacaacatgaataaaaaactagcaaaatgaaggagggtagaaacatacataatgctagtttgagattttaacattcctcccctagttactgatagaacaagtagtgagaaaaaggtggtatagaacaaaaaattagaagaactctaacagctaacttgacctaagttacatttatagaacactgtatagagtatttgctgagatggactgtacactacaaaataaaaaaggtctcaataaattttataggtttgagatcataaaagtatattttctggccacaatatagttatgttaaatatatgtaacaaaaagatatatggaaaatctgtatatactcagaaattaagtatcaccattgtaagtgacccaagagttaaaagagaaatcacaggaaaattaaagcctctttattctcagtgataatgaaagtataacataacacaatttgtgaaacatagttaaagcaatgctgagagacatattttagctctaagtttatgcttatattagaaacaaagaaacgtccaacattatctaagcttccactgtcagaagctaaaaaaagagagtacatcaaaccaaagttgttagaggaagaaactactaaaattaatagtaggagtcaaaataggaagtggaaaaaaatagggaaaaaaccctaatgaagcaaaaaaattggctccttgaataggtttgataaatctcaagttagattaatcatgaaaaaggagaaaaaaacttccatgttttctaattagaaataaatgaggggatcttactatagttcctgcagtcattaaataagaatatgggaataatgtaaactattgtatgctagtcagtgaaaaacatatttgcaatgggaacattctttgaaaggcaaaaactgtcaaagttcactgatggagaagcagaaaaccagaagagtgcaatatatattaagtaaatttaattcatagtaaaaacaacctcacatgtaaactaggctcagagagctccctctggtgaactgcaagaaatatttaaagaagaaattataccaattctgtgcaaaattttctagaaaaatggaagggggtggactatcaaaattatttgatgaggccaatgttaatctaaagccaaaaccaatcaatgatgttataagaaaaaaaacctacagacccatggtcctcacgagcagatgagtttttaacaagatattagcaaatcaagttcatccctatataaaaatgttaatgtatcatgaaccagtgtggttcatcctggaatgcaagattggtttacagtttgaaaatcaatcaatgtaattcacaaccttaacataataaagggggaaaaataatagtatcttaaaagatgcagaaaaaacatttgagaaagacatgccaaacctccacactcatatttacaagctattgctaaaataagttaaagataaataaatagaaagatacaccattttcacagaattcaagattcaatattgttgtaatatcaattgtctcctaatttatctatagatacaaaacccattcttcatgaaaattctcaccacacaaaggactagaagaaaatttcctcaaattgatacaggacatatccaaaagttataactagtattatatttaatgacgaaagagtgaatgatttccttgtggtactgggaacaaggcagggatgtctgccttcaccacttctattcaacattggacagaggtcttagttagtgtcataaggccagaaaataaaagtcatagagattggaaaggaagtagaactgactttatcctcatggcatgatcatatatgtagaaattcctaaggaaagatgaaaacaactaccagaaataataagtgaattcagcaaggtcacaggacagaactccaatacacaaaagtctacatgcttctatgtaccagtaatgaaaaagtggaaaattaaattaataaacaatactgtttggacaaaaaggtataaaatacttaggtataatctgaagaaaaaaaaagacatgccaaacctctacactcacatttacaaacaattgctaaaataagtttaaaaagacctcaataaatagaaatgtatgccattttcatagaatctaaggttccatattgttacaatatcaactgtcccctaatttttctatagatatgattcgatctcaatcagtactcttgttgaaattgaaagataattttgaagtttatatggaaatgcaaaagacccagaatagtcgaaacaatattgatactgcagaacaaatacaatgtagtaatggcgtaaggctagataaataccagtggaacaaaaggggaagtctaggaatagaatcaagtctgtatgatcaactgattttcaacaaaggtaccaaagcaagttgatgaagaaagtctttttaataaatagttctaagaaactagacaacatattgaaaaaaatgattctgagccctacctcacatcatatgtgaaaatgatcacaagatggatcacagacctaaatgaaaaagctaaaactataaatttttaagaagaaaattgaggagattactttcatggttttcatttaggcaaggatttcttagctaggagatagaaagcactaactacaaaagaaaaaaatgacaaattagttttcatcaaattggaaaaattcagcttgttgaaatacactgttgattaagctaaaaggaatggatagattgggatgatatatttacaatcaagatgactgttttgtatccagaatataaaaactcttgcaacttaataataaaggataacaaatctccacttataaaaagtgggcaacatacttgaacagaaacttcactgtggaagacactacaaagacatacaaatagccaataagcacttccaaaagaccagcctgggccacatggtaaaaccccatctctacaaaaaatacaaaaattagctgggtgtggtggtgggtacctataatccctgctacttgggaggctaaggttcaagaatcgattgaaccggggaggcagaggttgcagtgagctgagatcgtgccaccgcactccagcctgggtgacaggcagagtgagactctgactcaaaaataaataaataaataaataaataaataaataaataataaataaaaaataaaggctgacggcgctacatgtttacatgtcagtaaccatgtggaaaatcagagctcatcccctggtatagtaacttcaagaaactttggaaaatgtcttggttgttaaacatacacctttcctacgaattaccacctccacttctagatatttaaccaagataaatgaaatgtatatgttcacaaaaagactcacatagggatatttattcaaactattcgtcacagcttaaaatgggagatattccaaatgcccatcaagagaagaatggatacattaattgtggtgcatttatacaatgaattactcttcagtaaaacaaaacaaaatgagtgaaatattaaaattttacattatgatatagatggatttcaaaagcattatgctgagcaaaaaagtctgggcacaaaaaggaatatgcagtgtggttccatttacataaagttccaggaggctttcagcactccgtggagaaagcagagcatgggcatctctgaagggtgcttgtagattgtggggaagaggcggaagtgggcttctgctgctgaaatgaaaagatgctgtatttagatggggcatgtgctacatgtgtgtctgcatttgtcattggactgtaacatgtgcggtttgtacattttgctgtatgtaaattatacttccattattaaaaacaattaaaaaccaaaaatcatgactggacaagaaaataaatgatgtaaagcaagcctcaaagaattgttgaatctataaagaagaaaattgaggatgatagatattaaatgaagatctctgctaggaaagcatatctgcttatgcctctacttatcggactttgggtttccgttttcttttttattccccctattttatagatgtgaaagctcaaatatattaaaaagccttagacattgcaataagaaaaattacagtctcaaagacaaagtccttcagagccaactttggatttgcagatcctctgcatctacataaagtgaagggggagtaaccagtgaggggcaaacaagagctccagaaagctgcaagctgggatcagaactgtgagcctcaggcctgaaggaaataatgtatacagtggtccatttccaagacaacgtgccttaaatcggcttaggtcagcaaactacagaaaaaacaggatatactaggcccttgcttggatagccaacacctgctttttggctcaccccctgcccccttagttgccctcacctgaaccaaagaagtttagtctaagatgaaagtttactagcctgcgaaatagctcattttgtctgttcttttcagcctgcccagctacttaggtcacaagtcaaatacctgaagagcccctgagctgactgggattgcaatgcattgtgggttgcaataaaatgcagtaagacaaccctaaagaaaacacctaaagctcctgcccaacaaccaataggcgatgtctgggaagactgtgacccccccatagtgctcagcctatgagggactgggggagggacctgtgcactaggggataaattgcttgttgaaactgtgctaggtgtgcctgcccatcagacacctgatcttgcaagcccatcattaaaagactcactatcgctgttctccgggtctctaagtccattctttgggtttggacaagtgagtttgtttctcacaggcccaaccacacatgccttggtggtctctgaggcctcagtttacccacgatgatttgagggactgtgaaaagatcaatgtttttggagtccactttgtggattgaaactctgtttcatttacaaacagtttatcaaacaatttttagcaagtatgatgaaaacttaaaaacatcttttggtgcgtgatgttatgtcagttatctggaaacttattcatgtgaaataacacattggctggaagtttcaataaaaatgataataaaatgataactgccaggatgtctaagaattggattttttttttttttttttttttttgtgagacacagtttcactctgtcacccaggctggagtgcagtggtgtgatcttggttcactgcagcctcaacctcctgggctcaagcgatcatcccacctcagcctcctgaatagctggtgcccaccaccatgcctggttaatttttatattttttgtagagatgaggttttgacatgttgcccaagctggtctcaaactcctgagctcaagcaatctgcctgcctcaccctcccaaagtgctgggattacaggtgtgagcccccgtgcctggtcagaatttgatctaatactctacctcctaaaaagcactaaatatttcataggataggctattaaaaatacataaatcgagcactttgagtctgtccttatttcaaaaattgaaagtgaggtttgcacttctgcctttcccttttgtgggccatgtccattccacatcttgcaaagctctgcactcctgaacagttacataaccgggattggggctgacagttggagtccacagaactctcttggtgccctcaggctacaatacttcagcctctgttacaagtttccttctcatgttttccttttgccaaaacacgctctgacagatggcctccctcaggcttgacccactttctccatagctgtatattcgaacagaatacaggtatgtcttcaaatggatgcacttctatctaaacacaaaagcaaatcagtgtggacaggtggaatgccctgagaagcaaggggatgattaacctccacgcaggcaggaggaggagtaacattgcagacgaaaggcaaggagttcgtctcacaggtttttaggaggaacatgggttttacaacgccatctccaagctcccgtcctatgaacaacacagggagctcaggcaacttttaaagagattctgggtctgcactgtgttttgtaaaacacgagaaggtttgattcttttggtgaatgtttcctggcaatttcagagatggattcataggtttggtcctgaaagcgtccagttaaaacggaggtggcctgcggtgtcagccacatgttcactgtcatgggctgaatgatatcctacaagaattcatgctgaagtctaaccccccagtccctcagaatgtgaccgtatttggagagagtttctttaaagaggtaattgtgttcaaaaaaaaacatacaactcctaatttccttctcaaagtccccacatttgtaggaagtagtctctctgtgaaagtggcagtgagcctctggcagtgacaggagctcctagtagctgtgcatgtagaaacatcacttccaactcatagggctcaaagcagggctagcaactagtcgcacagccaaatttgagctattggtggaatgtgtccatttttcatggtttaatttcttcttctctctgttggttaaaatgtttctagtattttttagttttaatttttgtgggtacatagtaggtgcatctatttatgggacacatgagatgttttgatacaggcgtgcaatgcataacaatcatatcatggaaaacgtggtatccatcccctcaagcatttatcctttgtgttacaaataatccgattatactcagttattttaaaatgcacaattacattattattggctctattcatcctgttgtgctatcaaaaactaggtctttttcattcttcccagttattttttgtgggtacgcattagccatcaccaccttccccatctcatggtttaatttctaaggcattttgttctcttaccaggtagctttcctcaaagccagggcactgggacattcctgtgtcaacactgggacctgtgacagggcacggttttcacagcgactatggtactgtgcacagtctcaaagaccacccaggccacgcgttatgcaccacgctccagctaaccttggaaaaagctgaaacgccaacacagacacacaccagattgttctgtgtgcccttccagatgtgagcggtgggcacagatacaggtggtccttcaaatgattgatgggaaaaggtgactccttgcaagaaagtatatttaaattaggaaaatagtctaaaggtgtgtgttcacacttcacaaggagaaactcacagctttccaaaggattagccaaggctcagccaaatttgcaaagttctagacatgagtgcttctcctgggggtggaggctgcagaagttgcctgacatcatcctcgtcctttcagggtggtgtcctccgtgaactctgccttagggtgtaatcattaatagcacttgctccactcactcgtcccaggtttagaagagaaagcgcagagccatcccacgtatgaaagaagctcctttgggaggcaggtggcctgaaggcaaccacactctaatccccaatcagcttctgattccaaggccaaattcctcacgtcctactggaagcttatctgattgttctgtaagatttctgagtccatctactcaaaactggacaagtatgtcctgtgaagatgcagtgtgtccttgttcctctgatccacttaacgccatccacccggggcccagcctcaaggcccgcgggtcacctctgcctacctgttgccctcactgcacctgttaagtgcctcagcttctctagagggtccctcctggtgtttctctgctccacagcctgctcctgctgcttcggttctcatctgggctttgcaataatctcctattcatcatgttcaccaatctatttgttaactggttgccaaagtcatttttcttgagtggatgttgtgcaaaggcccaggaggggagagggagtgacctcgtggaatttcacggaggttcgtgtgaccagtgctggggggtcaaaggtgggtcacgagccacagaggagcaagtcaggcccactgggctccctgcactgcatgaagtcactgacaacctgcctggggcctgaggaacgtcaaagggtctgaagccagggcctgagatgagacttgcattctgcaaagacctggtaggagcgtctaaggggaggagctgcttcccctccctgctaaggaagagggtcaccccatataccaggactcgctgtgcacaggtcattttttcttttcttttcttttcttcctccctcctcctccttcttcttcctctctctctttctttctttcgacaagatcttgctctgtccccaggctggagtgcagtggcacaatcacagctccctgcagcctcgaactcctgggctcagttgatcctgcctcggcctcccaagtagctgggactacagatgcgtgccaccataactggctattgttttatattcactagagctgagggcttgctatattgcctgggacctcggcctcccaaagtgttgggattacagatgtgagccaccgtgcctggccaagattttttattctccaagcctaatctgttctttctgaattcactgctcagagctccggcccgacagctgatgacaccgtcttgaatcgaagcctaatgcacaagtcaggctttaagccccatggtgagtgggtgagccagggaccttggccacctccctcctgtctccaacctgggactctccgacggtcctgggaggagctcgctgaaggcctcagcttcacagaggtcctgacagttccttgataagagaatggcaaggtccttcctgccctcctctaactcctccagccctgatgaccgcagcctcatacttgctgttactgcccagcccagggggcagtgatgggccgccaggcacttctccccagcggggcgtctgctccctgagggcccaggctgcctcctcggcgcctccaggttccagtgcaggggctgtgagactcttctgagtgctggacctccctatagctgttgtcctcatccctgcgacgcagaccatcccggcgtcgcagaccatccctatctgcgtcctgggcagctgcgggaatccaatgagacaaggaccgggagtgcagcagggtggggggctgccctcctgtgatggccaggctcggctcactgtgtctcatagcggctgccttcagcgcccccggcttccccaggccttgctgacgcttgcccttctgaagccagtcatgaccagcactttgctttattttctactgagcttctttgaatctggaagtgcggcatcgtgaaccctcctagcagggtgccctgtcctccgctgaccggactgagccacattgtctgctctgagtccatgtttcttcagcactggtccaaatgcgggccatttctcaccttttctacgcattagacattctagttaactggaaagcgagcaatgatcgcgtaagtaatttgtttagagagcaggtcaaagagttaatagctgagcttgcaagtctaaatctaattatttcctcagcactgagctcctggctggtacacgggatgggttttattattttgagcctcccgactcttctcctcgtgcgactctctccagccttgagagtgctgccggactgaacttcccatccctgtccccaccccctcggtgacccatcgcagctgcacgggtgggcgcccacgcctcggccgacgcagccttcacgcccgtctctggtgagtttgggctatttgaacaaaggatagaaaagcctgtcattcattacttccatcattcatttgttcaacaaaaagttgccaggcacgtgctgtgtcccaggatcgaagaatccggccctgagctcctgtcctgctccatttcctccctgccatccccgcctgcagtgtccctgtgacgcctactaaccgcccgcctctcccctcccgagtgcaggcttcctgggtcaccgtcctcctctcccctcccgagtgcaggcttcctgggtcactgtcctcctctcccctcccgagtgcaggcttcctgggtcaccgtccgtctctcccctcccgagcggaggcttcctgggtcaccgtcctcctctcccctcccgagtgcaggcttcctgggtcactgtcctcctctcccctcccgagtggaggcttcctgggtcaccgtcctcctctcccctcccgagtggaggcttcctgggtcaccatcagcctctcccctcccgagtgcaggcttcctgggtcaccgtccgtctctcccctcccgagtgcaggcttcctgggtcaccgtccgtctctcccctcccgagtggaggcttcctgggtcaccatcagcctctcccctcccgagtggaggcttcctgggtcaccatcagcctctcccctcccgagtggaggcttcctgggtcaccgtccgtctctcccctcccgagcgcaggcttcctgggtcaccatcagcctctcccctcccgagtggaggcttcctgggtcaccgtccgtctctcccctcccgagcgcaggcttcctgggtcaccatcagtctctcccctcccgagtggaggcttcctgggtcaccgtccgtctctcccctcccgagcgcaggcttcctgggtcaccatcagcctctcccctcccgagtgcaggcttcctgggtcaccatcagtctctcccctcccgagtggaggcttcctgggtcaccatcagcctctcccctcccgagtggaggcttcctgggtcaccatcagcctctcccctcccgagtggaggcttcctgggtcaccgtccgtctctcccctcccgagcgcaggcttcctgggtcaccatcagcctctcccctcccgagtggaggcttcctgggtcaccgtcctcctctcccctcccgagtggaggcttcctgggtcaccgtccgtctctcccctcccgagcgcaggcttcctgggtcaccatcagcctctcccctcccgagtggaggcttcctgggtcaccgtccgtctcttccctcccgagcgcaggcttcctgggtcaccatcagcctctcccctcccgagtggaggcttcctgggtcaccgtcctcctctcccctcccgagtggaggcttcctgggtcaccgtccgtctctcccctcccgagtggaggcttcctgggtcaccgtccgtctctcccctcccgagcgcaggcttcctgggtcaccatcagcctctcccctcccgagtggaggcttcctgggtcaccgtcctcctctcccctcccgagtggaggcttcctgggtcaccgtcctcctctcccctcccgagtgcaggcttcctgggtcaccgtccgtctctcccctcccgagtgcaggcttcctgggtcaccgtcctcctctcccctcccgagtgcaggcttcctgggtcaccgtcctcctctcccctcccgagtgcaggcttcctgggtcaccgccctcctctcccctcccgagtgcaggcttcctgggtcaccatcagtctctcccctcccgagtgcaggcttcctgggtcaccgtcctcctctcccgtcccgagtgcaggcttcctgggtcaccatcagtctctcccctcccgagtgcaggcttcctgggtcaccgtccgtctctcccctcccgagtgcaggcttcctggggcagggcttcgcctgcttcctgcaattgtgtccagggcgcaggaagctgcccagcacaggcagtggcactgacacggggtgaaagaccatgagcgctcctcgggacatctggcctttcacctgtgcatggttgggagggagacgggtttcttccttggtcctcccactcgctcctgtttttcagggcccctcctctccctgtggagctccagtgaagacccctctccaggagcccctaaccccagttccagataaaccttctgtttttcctaaaactgtcagaacccagttctggtgcggaggtaagacaactcaaaaacgtgtatttgccgtttctttctttgagaaatctgtaataggctaaggaacaattgatcaatataaataaagttttaacggtggaatttcaggtatcagcatagatggagaagagactttcgtgcctctgaccctcaaattacccagctctcggctctgcgtggattggcgtgcccgtttacctgagaggccaggttcacatttgggaagaagagattttctccctccgcagcagcagcgcagcctgcacgaggttgctgggggaaacagaccgctctgtctttggggtcttgatgggtagagtggtttgccagagaaccaccgaagagccttccagggacttctaagagtgggcacttacttcagccctgggaaatctctcctcagagcctggcacaggttttggtatcagcggggccacgacaaatgttcactgaatgagtaaatgaatgacatggaatgtaggaaacacgaaataaaatgaactgagaagatttgcagggactggttattttgtccatctccaaacacagaggaaacaccctgactccccctggccgcctacaggggccaatggcagtcagtcccctgtgctgaagtgccggctgttttctaagaggctgaaggagggtatttatagttcatgggtaacaaggagaaaccacctctggagatctcctcctctctcagaaatctttgcgatgatatgaagagggatggtgttttgggcccgtgatgggtgacgccaccccagatttgcagatgagacccttttatgggacaggtgggcactggtcaaatgacatttataaagaatctggccaatcatatctttttttttttggctcctggttttcattaccactcagcatttcccacctttccgactgaagctcagtcaattagcagggtctagcagggtccccggcctggtgcctggggtccctctgcctctcagcttcccgggaagtggctaatgagtgctgagatacaagagggggagtgtgacagatgctctgtgggggtcgtcctgctgtgtgatgatcacgccctgagacgcattcgtaaatgtggtctttcctacgttcagggtttttgtaatattatttgaaggatgtaccagcttgtcactgagtgtgccagggaaccactgaccagggaagtttatttgtgctgtgtcactaggactatgagtaataataacaacaataataatgaaacaaagggaagaaaacccagcagggggctgcccttgagagtgccctgagggacacacaggaggccctggtgggaggctgccccaaggaagccttgcattctaggatgtcacagcctgcatctggcctgtgcttgggaggtgccagtgcagccacactttccatttctgtctcttattttggaggttggctttgagggatgaggacaaacgtgaggagcgagaattagcaggttcagatcaggggaaaagcatgaaccgcagatggaatggggtgtgtggtgggcagggttggaggcaccgctgagcgtgggcagagaggggacaggctccagggctctgcctgccacgtggagccagcacctgcagctgtcctgcgtctgtctctcctgcgtgggtcggcagagcagcgtgggctcccccaggccaattccaccgcagggctgagccctgggcctccctgagtccgagtccgggcagcagttttaccataaaaggcgcatttagcaaacacacctcagggcctggactctgtgtcacaacttcctgaagtgcacagagtgagacacatcgtggtgaatcgctggcctctcactgctcccagcaaccagcaaagcaagtcacggcagcacatggagatggattttctgggagaaaggcagccgcagtgctctctactagatgccctgaaaatcaatctgcagcccactccagcctggtaaaattagatctaaaactggttaatttagtttcaggagtgttttcccacctgatgccaggcctgaagacaccatgcagtaaagcaccctgagctactgccagcccgtgctcctcctctgggtggggacaacgcagtgctccatggcactgaggggctggtgcccgggacgagatggcactgctcccctccccacctggtcactgagagcctccttttcatgctgttcttctgcgttccacacggtttgtaaaaaggcgtggcatgtggatggttttaatttgcttgagtgggagggcttatggctttggagttggagccctgggacagctgaatgttctagaaagcagctgttttgcagctaaggcctcagcgacggctgagtcagggagggccgggaacgacctcaaggcaggagggaagaaggcctgagaatcatcactgtctccaccggaaccttaaccgctggggcccctgaccacgattggaaaactggaaagagcaagcgcagtatcagagagtcccaggacccctcgccagggccccagcctggcatgaaatgggattacatgcctcccattgtgtgtcccggcagccacaaacaccgtcaggcccagcgtcaccctccccacctcccggatgagaaggagcctccggagcagctgagggacccactgtggaggcagccgggtgggggacggcccggtgtgtgtggtctggtcgtgactttcccacaaggcatcacccatgggaaggaggcgtgatgatggtaagcagcacagagccctgcggggaccagggttttggaacaccccggccttcggtcatgctgcgggaagcctgggtcctctccctgtcagagaagacagctgggttctggggtttcacagcacacgggtacccccggttccaggactgaccatggagggcaggtgccagcgctgttcggggcctccggtgatggtcccagctcccttcccacaaaggccaggtgcagccttggaatcctctgacacttggatccccatggattcaatgggagctcgcatgctgtgaagaccgcggtgcattttaaacggcaccagcaaggaggctacactgtgtatcccgtgtccccatttctaccgaagagcggcggcttcacggcggtttgggagtggggtccaggctctgttctgcagagtccctgtttttctgtgagcctcacgctctctagaggagaatgagccactgagcaagcagtttcttgcttgtctttagaaaactgcagcgaggcctggggagcggttcccaaagtgtgttctgccaaacacaaacaggtgctagtgcccagagcatttccacgagcgtgtacttgtggagggctgagttctacagaattaagcagatttctttatggaagggcttcccggggcttgtaatgcacattgtgctgatacaatttgaaaatctccaaaatggagtaaacacacagcctctctcatgaccttggaactcgattttcatgagcatctcacggaacttctgttccacgagacagactggagaagtgctgacatctggggtgtcatgaggcctggctaatgtcttgggaactgccctgcagacatttcctaagtgaagcagcagacagacctcatttagcctgtgctgagccccaggatgaggggtagggaaggaaggctgtctcattctgctctggtccaaagtcagtgtttacgcgtgcgcgcgccggtctggccaggggtagggcgccttctaaaatctacttctgagcgatttgctcatcaaccgctattctgcacacacacgtggggagcctgccacgtgcccactctgctttgcctggtggggtcgggggagaatagaacagagggagtttcactgagaaaaaatgctgtgtggaattggtgcgtggttagcataaaggaagccacttagctcacacaggcctggaaatgcgggctggtgcagtatgtcatttacatcaaactgtgaattctcaaatatgtgaatcaatcaaagacggctgatggaggggctcagccaatggcgcacactgtcatcgagtcggaggcggccccacttcagtggagagtcatcctgccttcctcgccatcagctcccatctccttctggtcagaggaagcctcctccctggggccacccctcctgccccgcagcttcctgagtggatgaggctgacccctcagctccaacgggggctctgattaacctgatcagcataaacctactctcctggcaaaaagggactccacaatttgcagtgtccagtgtaaaacagaaatgttcgaaaatcactaagaatttcaagatggcgccagcagagcatgaagctgaggccgggaccttccaagtggaactgggccggctcctgccccacgcccagatgccaccctcctccctggtgtttgttccgtgaggggcacaggactcagctcagggcggcggaagtccgtcttcctgctggggcaggtgcgctcgtgcgcctggagctctgctgggtcctgcaggcaccgtgtgcggctctcgtggaagcagccggaggtggggatggagaaaggccggctgctgcctccactggaccctgaccccagccgctgctcaactcgttttttcttttctgagccagccgctgctcaacttttcagttccaagagccaagattgtgccttctaacacttgcaaccaaagaggtcctgattcgtacaacccttgtgaccaaatatctcaagcgtcttctctgggcttggagtcccccatgtgtaaaggggcaatcacgatgtctctttcagtcattgcgggggccctatctgggtcgtcactcacaccccgatgcaggagcaaggctaagcttggtcctggtcaggtgtggactgtgctccttgaaattatatatacgttttttaagggcttttgctacttttgtcagtgagagccattctcatttattcctgccttattcatgccagaatgaaccaacttaggcagcagctctgggtgagctaacggggaagccacttcgacaagctcagagcttgcactccacgtgaggggcccggcagctgcccactctgagggagggcaccgtggccccgggcgtagctgatctgcagaccccctagctgtcattctcagagctgcagcctgggacccactcggcctgcagcaaggacaagttcctctgtaacccacaggctttctcatgcaatgcagtattggaggcacgtccctcccagtctcctgttgcccctaaatctgctttcattcatcattgtagtgctcctacagtccccacgtcctagcctcccctgctcctgcctccccgattggaggcagttagagcacacctgtgtcatctgggtgtgtctgcagggcactgtcctgtgaatatcaaccaggccagtagttgtggggagcgacattgcaccccagggtcaccagccaccccccatccactctcagcaagccagggtcaggggcttcctgtggtgcaggggcttctgtgtccccacagctggaaagctctaggccaacaaagatgaaacagctcccagcgcagggcccctgccacctaggtgctttcctaaagatgagctctagaggccaagctgcttacttagttaaaacaagcgttttggctcagaaggagcaggagaagctgctgccaggagctctatgcttggccatgagagcaggacacagggaagggcatggaacggctcacgggggacctcgggagatgcccaggctggtctcgcaggccctaccactggggacctgatggggctaagcatctccccttggcaggtgctgagatgcccctcagtgcccagcacaaataattctgcagagatgctgcccatttgccggctgccatccagcagacgccagggagacgctgcgtggtgatgagtgcgcaagaaccagcgtgggctccactcctcccgcctgtgccctgaaaaaagtgtgtcattgtgtcacttgattttctcagtgacaaccatgtggggctctgcaggtagaaaagtgaccacttgtgtcaggcactgagctgagctgaatccaaattcagcaaaacctctcctctctggtgcctggcgagtctcttaaagctgctcagagacctgtaagctcgccggcttcggggcaagttccttccgtttgaccggccaacagtgacattcgtggacccaaaggaccctggacagacccctgagggaaagtgatgggcaattgttttgaactctccaaaagggagctggaacagaatatattaggagcaactttcccatcccagcgagacttgggtgaattccccgggagctcacgctttctacattggtccttttcgttagattgtttaaggacacgcagcttgttaaagcagcaggaccctgtgtccctttatgtgcaaattaaatctcaggtcgatgcctcctacatacaattcccggcgcctgcgtggaggatcgttgcgtcttcagaaactgctcccagctccgagggctcccagagcctgtggggtcatgcgggggcccagctgacaaaccacagaggtaacggggcagaggtaacgctgcccaggccccattatgcatgttgatcctgtgccagatgcagtaagaggctcagtgctaaggagaattcacatttaccacaccttgactgtgttccaaaaactcatgaagcattcattgatttagacatgttccctcaaccactgctcgtggggtcttctgagctacctacaattactctccttccaatcttgagcttcaatttgctgaaactcaggctggctctagcgcctccacaaaatgagagatctccagaaataagggttcaagattcaatgtggtcaggagttcgggaccagcctggccaacgtggcaaaaccctgtctctactaaaaatacaaaaattagccagaggtgatggtaggggcctgtaatcccagctactcaggaggctgaggcaggagaaacacttgaacctgggaggcagagaggttgcagtgagcagagatcgcaccactgcactccagcctggaagagtgtgagattcagtctcaaaaaaaaaaaaaaaaaaaaaaaatttaagatgtttcttgggaaatgtaccagaatccacccacatctttacaatgtatgttgaagcctctaagaagctgtgcaccaagatacacccatttattaaaccccctagatacacctgtttattaaacccttcgccaagatgcacccatttattaaatccttctccaagatacacctgtttattaaaccttccgccaagatacacccatttatgaaacccttcgccatgatgcacctgtttattaaacccttcccctagatacacccgtttattaaacccttcgccaagatacacctgtttattaaacccttctccaaggtacacccatttcttaaatccttcccctggatacacccatttattaaacccttcgccaagatacacccatttattaaaccatttgcctagatacacctgtttattacacccttcacctgtagacttgggctatgtgttattctttttaaaatctccagccatggtggaggtgtggattttcactgcgatgagcttgctgaaggatctgtggattgcaatgtcaccctggccctcacccagctgctctccttgcaggtctggttagcccagggcctgcttccttctgtgtgtgggccctccccaggggctcaggcagggagctgaaggacacacctcactctcaggacacttgctgtctgtgatcaccttgccaaggtacctgctttccatccagctctaaagccgtgtgggctcggtacccgggaaggagagagtggcctgggggacctcgtggaaggctggaggggtcactgaagcccacagaggatcacctcctaaagtgtctcctttcttcttcatctctgtggcttccctacctggggaccactggtcgctagaaataaacttggccttgactttccctcctatgggttgatgggtctttcaaactttggtggaactcccagacaatttaattttgggctgtgttggctagggatgttcccttttcccaggttgtctgaaataaagaaggctttggcgggggagccctggcaccccttgtgactgctgtgaaggtgagtgccagggtggatctggggctgcccacgggttcgatgacaccaacgccctttcccccattgtcaaccccctggccctgcagttggggccctgattcctgcacgtcccaggactggacgaggattgccggctttcctacttcacagatgatgaatggggggagtggccacagcttgcaggaaaagaggaggagcttatgcccccctcgccagaagcagcccatccccatcctccccagaagcagccttccttgggatggccagggacgctggtgatctgggccctgggggatgcgtctcctcctttggctgtgcggctgcataaagcaggcatccataaagcccacttatttttacgaccttgcattaaattaaatgtgttattttatgcaggtgcttacaaagtccactgagtagcctctgatggctccctggttccctgacacagtggcaggactggcacagaccgagcggaccccatactgatttgctgttctcgggacagcacaggaacagccgggcagcaccactgactcctgggaagcaggacgatgacctgcagtcacctgcagctcctgtgctgtcctctgtcttctacaagtgccattggaaggggtcccgggtccgacgtctccggcgtccttctgagccactgctactcctgaagagggtacaacggccggggtggggtctctggcttaacccctggcggtggtcccattggtgacccactggcctttttctctgcagggctaggctgcccttaaaaaatggtttcaggttgagagagactcagaggcttggggaagttgacggtagggggcagggagtcattgcttcctggggcctcagcctgcattctgttggattatgcctcagcccaggagtcccggctgcccttcctcggggcatagtcctagcccagcactggcagagacgatcttcctggggcttctgagaattcaagatcctggcatcagatgagtgacggtgttctgagagagctcaacctgcttcccaaggtggtgccctcccccacctccaggatggaagattctcccgagcatgtcctgggggttgctctcgcccggcctccatccccaggccctccttcccctctgcatgactgttctgtggggggaactgggcagacagacccaaagcctcccagcagaagagagaagtgaggaggctggaggccaatgctttctttgactctaaaatgaattatctcagtattatagaaaatataaaaatatacaataatatttaaaaaggaaattgcattgtcacacaccccaccttccaagggctcacactgttaattattttgcagaatattttatactgtcttagcttgagaggcaagatattagacgaatagaaattggatttaatttgtaaatatgggtgcatgcatccttcttaatgaagctgagatcatgctttacatggtttggcaatcccctttcccatttaatattacattgtgaacatttttcattatctaaaatattctttaaaacacgagttaaaatgtctacataacacattccaatgaaaatatatcccacagcatggtcgaccattcccagattgctggatatacagggagcatcagtgtttttagatattgtgtagatacgtgctcacatgtgatatgcatattattaaggatgctgcactgaacatctttacacatgagtcttgaaccacatctatgatgatctttcagttcacactcttagaaatgcaatagctgagcgaaagggagtcaagaatgtcagggctctcgatttccaaaatcaaattagttttacagtcacaccgagtcccagggccacccgtccagcatgaatatgcccatctcactcaacccttgccagccgtgagtgcaattttaaaagcttgctgcccgtcggaaaccagaaagtcaccctatggctttgacctgtccttgttggtaaccagggaggctcggctgttgtgtgtcttggtgagcctgtgtgaatcctttgttcactgggctctggatttcacttgcctcccagcctctgtggactgagagagaccacggccacacactggtagctgggaattgtgtctgcaccagcacacagggagtggcctgggtcttgctctgtctgcctgggacccaacgcctgctgcaggctcagaggatgagggtggccgcggctcctcacccactgtggctgcagctgggctggccgggttgtgttccagagctgctggctccgtggtggtggcgtcagtgattgcagaggaggctgggccggctgtgctgctctctggggagacctaatgagctcctgctcactcctcaggctgatgcccatgtctcagtctaccctggacccttggacatgctctgttcacaccacatacccctgaagcacgcttggcccacggagcccccgcatccagcccggggcaggtatctctgccttcctcgacccgccctgcctgacagcgggctcccaccttcgtcgccccgccctgcctgacagcgggctcccaccttcgtcgccccgccctgcctgacggcgggctcccacttcgtcagtgcattctgcaaacttgacttgacctgcagccaaacagagaatttttctcttttcagatgtttcatctctgtggccacctgaaccccatctgcgtggggcgtgtggcttggccatcgctgtggcaacggattctcagtggtgctgaggcctggtcgtggtcatggtgctaaggcctggccgtggtcatggggaaggattctcagtggtgccgaggcctggccgtggtcatgaggaaggattctcagtggtgccgaggcctggccgtggtcatagggaaggattctcagtgtgccgaggcctggctgtggtcatagggaatgattgtcagtggtgccgaggcctggctgtggtcatggtgccgaggcctggccacggtcatggggaaggattctcagtggtgctgaggcgtggctgtggtcatgaggaaggattctcagtggtgccgaggcctggtcgtggtcatagggaatgactgacagtggtgctgaggcctggccgtggtcatagggaaggattctcagtggtgctgaggcctggccgtggtcacagggaatgatcctcattggtgctgaggcctggctgtggtcatagggaaggattctcagtggtgccgaggcctggctgtggtcatagggaaggattctcagtggtgccgaggcctggctgtggtcatagggaaggattctcagtggtgctgaggcctggctgtggtcatagggaaggattctcagtggtgccgaggcctggctgtggtcatagggaaggattctcagtggtgctgaggcctggctgtggtcatggtgctgaggcctggccgtggtcatagggaatgattgtcagtggtgccaaggcctggctgtggtcatggtgccgaggcctggtcgtggtcatggggaaggattcccagtggtgccggggcctggccgtggtcatggggaaggattgtcagtggtgccgaggcctggccgtggtcatggggaaggattctcagtggtgctgaggcctggccgtggtcatagggaaggattgtcagtggtgctgaggcctggctgtggtcatggggaaggattctcctcgctgctgccacgagcacagtatcagggatggaaaggtttgggccagaggacttctcaggctgagataatgtaatctcatttcctgagagcaaaataacaaaacaaggagtgatgtattcccttctccaggcgggcagacaacagagatgtcaattaaatctaaaggcctgctcctattcagcagaaaatggctgctgctctagaaatattacgacgttaaaaggagatcactggagtctacataactgttgatggtgtagcatctgctccaactgcctctcctcggtgtctgccacagcggctgcggtggttttcctgtttgaagaccccctgtcctccttcactttcagggtcagccagtctgtgctttgattcaccacggggatgagcaggaatcgtcggtgcaattttacctgcgtaaacaagcgaaccttcttccactgagcttctgccttgagacgtctgtgagtgccgcctgatcacttggtgagcagctgtttcagctgcccggatggagggcagtccagtcagttacggcctctccctctcccgagctgcgccctgtcctcctggaggcgaagggctgagtctcagatcccggactttggtgcagagcaggaagacctgtccttggtctgctccatgctgtgctggtgtctgcgctcctccctcagggcgcctgcagggaaactgcatcctgctctcctctctgcagcctttgggaccagggcacggccatccagacacggccttagcttccttgtctctcctgggccaggtgggcaggtgagatgcctccccagcctccgtgggcctagagaatctcaggggcctggttcaggccttctgcacctgtctgctccaggctgcatggtggctgaggcacaggtgcgtccgtgaggctgcggggcaaccctggcttcgggggaacacagtgctgctccttcaagtgcaccggaggctccgtcgttagcccacccgtccccaccagcccagggcgggaccagcccacagcaccacgtcctctccaggccaccagtgggaggttcaggagaaaccagggcttccagaagcaatgttctcctaactcttacccaagttactgctggacccaagattctgtgaacccaaagcgggaatttgaagctttttcctcctcaggtgactttctgactgtatccctgggccaggttagcttcactaaagcgacaggcaccacagatgtggtcctgggtgggtggtggggacgggcggtccgtgctgagtggacacgttgcagcaacaccacagagaccccacagtgtgtcgggtgtgagctccgccggcaagaagcggatcgaaccatccgtgcaaggccactgtaggtgcttcctgaaacgccatttacgaaggtcgtagacgcaagtgcctgacctacagcaagtgcccctcagcgcttgataaatacacacagttctgcagcaaaagctattttgtttctctgcattttcaaccaaaatttgaaagacattgctttcagctagcagtatagatttctatacataaagacctgaaaactgctatttaaaacagcctttactcagagtggacttagaaacgacgcatcaggctgagaggagcagagaggcctgatgtgttcattcccttcttgccccggtcaagttatcaggaatttgaggagagtgcttgtcttccgagaaattctcagacttcagggcatgcgttggggaaggatgtggtcaagatgtctgtgccttgtcaagggcccttttctccgctgagctgaggctcgggacgatgctggacgggttcggagcgtgctgcatcctgcgagcccggagacctcggggctggttagaggatggctcagttcccaggaaaccctcgggtctttaaaaggaagtcgcaaaccctgttaaagagctggacttcttttgtctgtttactgtatcgccttgaagtctttactgaacagttgattaaaagatgtgttttttttttgaacaaataatttaaaaaatttataaatccatgtttaaatgaaacctgggctttagctatgtgaggttgtgactttattattattattatttttgcttttaaaatagttctctattttattttaaagcaattatatccatacattcaaaaaagtccaaaacagcagaaaatatttcctttgagccaacgcataaagcacaaaataatcctcatatctgccagaggatgggccggaccgcgtttcaggtaatcaactcaggagcaactgaaggcttccgagggtaatggaccacgtaatgagtcaatttgtggttgccaggtgcatccctgctcagacctgggcggggcaggtgggtgtgggggcacggctttcggggctcatcctcccgcaccacctgtgggaagctacgttgcttctctacgtctcaattttctcctctttactataaaaatagcagctacctcatagaattgtcttgaatatcaaataaggaaatccacccgcagtgtttttgtgactttaacgtaggttccttttccttggttcatttccctgctggtccccagccgcccaccctaatggagaggggtcttgcccactgcctcagggctggcgggagggtggatgggccctcgggctgtgggctccatggggatttgggcatggctgcttctcagcagaggagccacaggagcttggcagagcccagccatgcatactctagaatggtctagaacggtctgcaggcaggagacgggtgttagaatccacccaggtggctgacagcctaggaaccacttgagcagttgttgtatggtgagggcgcagggcccagccagggcagcaggggtcccagtgagaacatgagtgggagatggtgcaggaagggggtccccagccaatgtcccagccccaatcccgacactgacacagcactggggaagggggtgctctgtggttagaaacggcgtcgggtctcgcagaatggaggcagagttccagagcaggaaagtctatttcatcatgcccaagctctcggtcttgaattcacacaaaaaacatgtgggtcctaacagtgacccagccaatgtcagcaatggcttgtgtaactggaataccataaattacagctgaagtgcacacagcctgtgtcgtgcacctgctcgggtctaaccatcttatgaaagggtcctcctatcggccctgttttgcagagaagaaacctggacacaggaagcgcagccgtgaaccctagggcagggaagccaagattctcactcaggccctgcccctggggccgggccttctgttctgcccagcgacctctcagcctcaccttgagaatcttacagactgagcgctgatgatgctcccgggcacaatgacaaattcatcgttttaattttttggtcaaaacccaaataatctttagtaaaaaccgatttgtaaattatgcatccattctgccatgatggatagaaaagttttgcgatacccagtgaacactggggatgagttcagttaagcaggtaaagaaatccttgtcttgcaattgcaggtctcacggtgatgtcctctcagtgaagcccaaaaaacaatgtgtgctcgctgggtgccagacccacatcaggggctctattcgttcttcagacgctgttcaggtcccactccctggaagcctccctgatactcctttcctcaccagctcggctcagggggctgccctgcacagccatggcctccagccagttatcctcactgtcctggaattgctcaacctacccccaacccaggcttcgtttccttgatggggggaatacagtaagcacttagctgatgggcagattattgggaaaagctgagtgtcgggagaagctgaggcagtgcttgcatgtctgacataatgtaaaagagtcttagaacatgtctggtggccagggtctaaaaccccttgtggtctttggaacaccaagctctgtgctaaagggtggaaggctaccctgacgtaccgtaatctaagcccagggcataaaatccctcgtggcttggatagaatccagggctcgtggctctggaatgtgtctagacttgctgactccttgctccttgctctcccaggatcgattatatcttgagtgaaaagaacctgctctccattatctcaggtagcagagcaaatgctaaactgtcacagctgtaaatcacgtgcttaatgcaacatgccctttcaacctccacattctcatcacctgtttctttgttggattaccaataaatagcatgtgctcccagagcttggggcctttgcagcctccatgatcacgatggcccctggtcccacctttacttctcaaactgtctttttctcaatcctttgactccactggactttgtcacccccatgacctggtgttgggtctgatcaccccaacacagatggacagaaggatggatagagagacagctggctaggtggatgatgggggctggatgagtggctcatggatggttagatagatggataaaggaatggtgaatgaatggatagataggtggatggatggatggtggatgggtgggtggctatatggtgaatggataggatgatagaaggtggatggatggatggatggatggatagatggatgatagatggatggatggattggggaatgtttgggtggatcatgggtgggtggatggatggtggaccaatggatggatggtgaatggatgggcagagggatgatgggtagatgggtggatgtatggtggatggatataaggatgggtatatgtatagatgggtgggtgaacagatggtggatggatgggtggatgggtggatggatgggaagatagatgggtacaagggtacatgagtggttagatgctggatggctgggtgggtatatgacgatagaatgggcagataaatggtgaaatggatggatggatggatggtgggatggatgggtggatcatggatagatgggtggatataagaaagggtatatggagagatgcatagatgagtggatgaatagatggtggatgaatggatgacagatgagttgatgagtggatggatgaatggatgattgatacatgagttggccagataaacacgacacctcttccgcatggtaagaaatatttgggaatagggtgactctctctaattaagacttcaattacttttttgtttgagtatgtgtcatgaaatgataatttgattggctatttcttagtcatttcatcaagtcaattctatgcaaataagaaaactgccataatgaagcagattagctatttattaaaattaaaaataatttaatttacattaaggctaaaactaaattagaaaagttatttgtttgattctattgatcatagagtcaaaataaaattatcatcttatgtgaaaaattatcactttctcaattgccacctcttccatgcagccctatttattgcccctaaagcagtagtgtctctcttctctgagcattgatggaactcctagggtagtcatattatagagcctggatatgaggctgattctaccactcaccagccgtgtgatcacagcctactgggtgaatatctctagaccactccataaatgggaaataacaataggaccaaactcaagacccgccatggggcttaacaagcagtacacatgacatcactgtgccatccgtgaagatctaagtagacattacttcttgtgattgcctgtcttatttccctcctgcaggttcttagatggactggtctgtgaatcacatgaacatatgcggttcatattcataaacacttattcacacacacacagatatgtacacacatgtacatttgcatgtaagacaggatttggcaaatagaagatatttttgaataaatgaattattgggcaactcatgctgccaaaagttgagagatgaaactaaatgaaggcccaactggggtgagtgtgcctgtgggtgtttgttaaggggacgccaatcattctattgcacttcagttatagctggttcctcctctaacctactctggggtccaaagtcagcacaggaggcccagaggagtgagcgcctggccattggcaggcccctgtgggtctctctccctctgttgattcacagcctccctgtggatgggccgtggggagagctagagcaggtaactggctgggatccaggaaaggcccttgtgaggctgcacaggcaggggccctggagtttctcacccaggctgccctgatgcacacaggtccgtaccatgcacctggctccatcaccacccttgtggggtctgggatgatggcagtcaaccaggtgctccactccagagaatggggcccatgaactcactcagtctccatgagagccagatccctgccagtaagtcacgtggtgaaaccccattaggtcagccaaccttttcacattggcagcgcccagcttgctgatgtgggagagagaaggtgtcggcctggggcatgaccatccacagctgagaagggaggtgggtgcagcacgggtccccctgaaacattccatgtggagacatcagaccccccggcttaggagttgttactgcaggagtgtttgagaaactgtgtggatggtggcctgcagtgtagaccagatagtcaggaagcatagatcagatggccagaaagtgtgggatataatagatgggcaggaagtatagaccagatggccaggaagtgtagatcagatggtgtggaagtatagaccagatggccaggaagtgttgactagatgggcaggaagtgtagattaagacagtcaagaagtgtagaccaagacagtcaagaagtgtagaccaagacagtcaagaagtatagactagatggtcaggatatgcaaactagataggaagtgcagaacagacagtcagaaagtatagaacagtcggtcaggaagtatagactagatggtcaggaagtcggtcagggtagatgaccagggagtgcagcccagagggtcgggaagagatctgatgagcgatttctaaggcactctgctaattgccctgcattaattatcttactgactcaaaagaaggatgaagggttgtggaaggatggattttattatcattcctattttacacgtgaacgaacacagtggagtaagtgatattcctaaaatcacatcaaaacaggcaggtgtggagtttgcaccgtttgcctgacacatggacaggagtctgtgctctcttttgtctgggttctgtattggtggctgggtggtttttgcctccccactcttcactcctgtgctatgggccggcgttgcacctcctggggtgggcctcactcctctggactcagcgccctgcctggcctgggctctgcgtgcttcttagggtgtgccatggctgcccctccagggctcacagtagatgcctgcatggcaagtggcagccatgtgcgttgaggccacgcgctgtgggccccaaggcacctcaaagtttaggcaggaagagcagacgccagggtgcatggggaaaatggcggacagagatctgcatatttgtttacagatcacaatgtttagaagttttaaagaataagccccttgcagtacatttaaaagccgatgaaggtcactccacatcctttgctgagatgtctggggagacttgactttggagcagacggcccaggcaaggaggttcacaattgcacctcctctgtcggtggagggacgtttccgtaaaccaaagggagtcgcccatctaggatcaacttcatcgtgttagttatggtgttttgttaaagtgtccacagaaaccaagcagcctagtcctggtgtggggaagtgtctccttagaatttcaagtcggctatgagcacccctggagttcccgggaaagacggtgggctcagggtcaggcctcgagctttaagatgcagcggggacctgccctgtggctttgctctgtcccgggcagtcccatctcctttctccagggctgctctggcagatcccctgccgagacgccacgggggagccttgttgtatgtgggttctggctagaggcagacgaggcccaaggtaccaaggagaagctctgatactcaaatgtcacttaactaatttccttccacgcaccaacaaaataattggaatggcattgacaaggggaaaaacagcccgcagtaaaaagcagttgtccgaagcttctggtgtcttgaggaaattatttccgctattatctttcacacagggctctagactggccagagtagtccgtattattatgtgactatccagactatttcctcctcagtgccctagctagttttgggccgagcaacactgatacaatagtgattttaaactcagtgagcattccaaagttcagcaaatacatcaagcctttcaaagtttctgcaggataactgagaaaaaaaaaaatctatgtcttgatttttgtcagttgtcttggaaaatttcccttttctgttttgtgcgtgctgtcggaaaccagccaagtgtgtcctgcgcccctttggtatgtaggctgcatggtcgaggaaagaaaagggttcacttggaaccctggatcttggttgcatagtgtggctaagaaaagggatgtttagacaacactggttttcagaaaaatgaaactaaagcaggagcctaaatatacacaaaaatgtacagtgatgtgtcttttttttctttttgagacagagttttgttcttgttgcccaggctggagcacaatggcatgatcttggctcactgcaacctccacctcccaggttcaagtgattctcctgcctcagcctcccaagtagctgggattacaggcacccgccaccacgcccgtctaatttttgtatttttttagtagagatggggtttcaccatgttgatcaggctggtctcgaactcctgacctcattttattgatcattttatctttttggtgtctaagaatctactcccaatttaatatataattttagcttagaatttaatgtatggacagtggaaacttactatcaaacactttaaaaaaatccagcagaatccatatgagaagtttatcttggctcatgcatatgctcccctatgtaaaccgagttatagcaaaaccacgggccactttatggagggcacagcctcactgggcggaaccggtacccagagggacggtaagcccagatggttggtgctgcagtaaattaagcctgatatagagatgtttgtgggttttattaaagtctcatgatgtctctaagcagttcttgttatataacagaatgaattatatcgtccaaggttattgctcagataacctactggaaatgatagttttcctccttcatcacatgaatctaaatgttaactaagcgcttgttagcttttcacatcacatcggagggattcgttagctctcacatctctgcatatgtgttttaagagtctttagataaaagatgaatcaaagtgattcagttctgtaagttttggactagaaatcagagtctctctggacatcatccgagtgtaaaatgtagcacaaattgcctttaaaaattaataatttaccaaatctatcagctatgcccagtctggcttgagaagataagtaaaataaatattgtaaagtcaatttttaataatctgtggcatgaaatttaagcacaagagaaaacatttagcaattaagcaggaacattcggtgcatgattaaatgtgaataataatacatatttaaaggcctcataacttacctgctagcaggaaatatttaaagttctaatctactacacagcacagctcatgccgtttctttgtttaatgagctcttgccttgtgattttcatgtttgagcagttactttgtaagtatttttacatggacagctacgtgtaaggctgacaaagagtagcacagacagatatgtggtgggggattgtcaggccagcgcagccacggaaaataatatgatcagatccttcatcatgctggtaaccagtggttggctgtattcatctaattattgagacagcacattcacatccgagggattttattataagaggtttataaaatttagagttgaagctgatctgtctctatctaccaaatagaagctggactcaggaccatggtttttcatgatgaagaatcaaatccttgataaatgatggcaggtcctcatcttccagaaagagggaaaaaaaaaaaaaaaaaaggcagaggaaaggaaatagctcggctgagaaacagagagcgagtgagcacagcgctgacagagagggagccgctgcctgccgctgagaacacaggctctgcacccagggcacagaagcaggagaagatgtaattctcgaggaccacattgattaacgcccgcccagggctagccacaaattagagccccgtcctgaaagaagcagtgctatgtcttgtaaggcatgcttccaaaggagcttgcattgcacacaccccggagcaaaccggcaagtagagaagacggacacttcccaatgaaagcgaaatgttcctgcctgccctgcgccgctcggttctccttcctctctctgctctcacagggtggtgttacacctccactgctctccatctagtgtgtttgtgcaacactcgcctccagggggagctcgaagctctcccgcccttcacctctgatcagagcactgatgtgagtcaggtccccaggatggtgggggcaccggctggaggagggcgggggctccttcagacctgccttgattaacccggaccaaaggggccctctgcactggagcgttacagtcaaagcacagcctgtgcacctgcccgtcggttccatagtgtttgtctgctgcttggtttgtgggacaggtggctggtcaggatctgcaggacctaaccccacccacgctcagctgtgaggagattaaagggtctcagtgtctcagggtcaggttccaggctggcttcttgcgatttcacagaagtcactaaatctttttgggtaacaatgggcttactcctaaaagcagtgggaggttgggggtcagggagcaatttgaacttattcttctctagattctctttcattacagagtcttattcacattgaataaatgtttattcatacctactgtgggccagacactatcctgggccctgggactatagcagtgaacaaagtggacaaaaatcctgcctttataaaatgcacatgctgagagttaagactcacgatgctcagatggggctgctgttgtggaagtcaggagagtccacgctgttagtgttgactgtttgttttgtcctttccattgtaagattcaccccattgcctcctaaagtgaaccccagggcagggaacatgttgacagggaggtggtctaatctaaatccagttagaacactcggagagctcctagactgaaacagggagaaggaagcacattttggatgattgtatttgttccttgatgggtctgctgaggaagagctatgtacccattgcatgtgctatttccatctcaggttatttgaagagaatacagaggagaagcagccccaggtacctactctagtggcagagtggcaggcttgaggtgcctgcatctgaaagctgctgtgagttagggaagcccccaccaaaaggcccaacaatgggcaacatcccccatcaaagccatggacatatccctggcaacagacttggctcttaacttccacgagtttttaagccaaggttggcaagaggaatagaacggggacgtcaaggtacatcaaaggaaagattcaaaatatatggaatccatgaggccacataggatatttcacagctttatgcttttctgataaatcctggaagacttaatataaggtcaggagttttcagtgctctgattcggtaaatttatttacagagacagctgtccgagggtggaataaggactcgggagtgagagggaggcactgtcaacactttcaggccagaccagcggctcacgctttggagaccggggctgcaggtgagggcacaggtggacctcaacccacctggacactccaccagaggggaaggcacagtgagaggcagtgccctgtggctgagctgacggcactggtcttggggcagggagaggagcccgtaggtcacaatggccttggtgaccccagcctgcaggtcacatgtcccttacctgggagccatctactctggaaaccatggatacctacacatctgtgcaaaattgacacagtgcctcagttatttgggtaaggctgaccagtgaattctgataaattgctgtaacaatgaccacccatctgtcaatgtgtcaccaagcataggctgtatacactgtgcagactgtaaggatccactgggctttcggcctgcggcacccaggtatgaagggcattagcgtacctcctatggccacacgcaaactccgcctggggtctaccccatcactctccactccattttgcagatggagcccaccgagtctccctagaaacaatggcttggatcctgggagcagtggcacccacctgtctggttcttatggccgagagccctgcagctagatgttctgtgagcctgtgttcccattttatggagactcagagaggtatttgccttgtgcatttctcctggagcttacatcactgaaggggacccttggccagcagtctctctgctccgagtccccgagtctccacaggtggccatggccattgggttccagctcagctcccacctttgccaccgccttcccagccctcgctaagctggagtcctggcccgggcccttgtcccagcttcacgccattgcttacacccttggccccctcccttcctgaaatcactgtccttcttttcccctctaatctgagtcctgtttattccttaaaactcagctcaactcccctgttctcactgagggattctgcaagcctcctagaaacccctccggcctcctggctcctgagcacccggccttgagcctgcagccaccttgcccagcactgcttggtcctggcagtgtggctgctgcgtgttcatggtgctagggggactcaaaggttctaggggaggcagggactactcttcctaggcctagttgtctttgctaccttcctagggcctagtgagttccatgccactgtgtatgcagtaggtccactatgtatgcagtaagatcactgtgtatgcagtaggtccactatgtatgcagtaagatcactgtgtatgcagtaggtccactatgtatgcagtaagaccactgtgtatgcagtaggtccactatgtatgcagtaagatcactgtgtatgcagtaggtccactatgtatgcagtaagaccactgtgtatgcagtaggtccactatgcatgcagtaagatcactatgtatacagtaaatccactacgtatgcagcaggaccactatgtatgcagtaagaccactatgtatgcagtaggtccactatgtatgcagtaagatcactgtgtatgcagtaggtccaccatgtatgcagtagatccactatgtatgcagtaggaccactatgtatgcagtatgaccattatgtatgcagtaggtctactatgtatgcagtaggtccaacacatatgcagtaggtctactatgtatgcagtgggaccactatgtatgcagtaggtccactgtgtatgcagaaggtccaacacatatgcagtgggtctactacgtatacagtgggaccactatgtatgcagtaggtccactatgtatgcagtaggtccattatgtatgtagtaggtctgcaaagactttgctgattgatctgaggaaggataagaggatatgaatgtttttcctgtggctctgggagtaagaagcgtttagggctacacacctaactacctcctggcctaatggatgctctgtgggcctgtgtgagagcaagaagaaaggctgaacacccctgtgagaaccatgtcagagccgtggctccaaaaaccacgcgagatggcatgctctgaggcctcttcctcgtgtttaatgactcgtggcaaagtgtggattctcgcggatatttacaaatgacttccgtttaccaccggacagttctattgctgagtggtctgatttcctggattatgtcctaagaaagtttaggacaatgcccctaaagtggtcatttagtgcccacggaagcttggtgctttgtgtgtcatgatggtgcatcaggagtttgcaaaaaaaaaagagagagataaataaaaagtaaaaggcacagatggggcatggacagcttctcattgcttgttccatgtgatggaactcaacacatctgctctgctgcggaaagcatctttgcactaatttgtttgtcagtgtccattgagaggacgatctgtcatcctgtcgcattttggttgccccgagatgtttgaagacaaggctagccacaaattggaactgtggccactggggagtaagtggtggaaaccaccagctgttctaagtaacatcaattgtgatttttttgtaaagatgaaatttcaacctaaggtctccaaaagcatttatcagctgcatgaaaaaaagctaatcaccgtaacagaagagtgagtctcttctaacgcacgtcctggggtgcgtgcgtggaagccttgttacagctggaaaagcaagagaagggggtggtcagaattcaatgagcctggagcctctgttttgctccatggtattttaagtctttctggtcaaaggtaacaagcattatcctgtaattggactacggtttcaggaacaagaattgagatttcattgtgctactgcatttgatttcctgatcaaatgctgtgatctggtcatggttctcctgccctatataccacctgtttctcaggatactttacgctgaatggcattcatttatttgggtttttgtttccctgaatccattttaatcttcccggagcatagagactatgctttgtcctagaacacaatagatgctcaacaaatgttgctttgattgaatcaattcaagtttgtatccttcaagcaatacctgaagtatctaatcttttatactgaatgtgttgctgtccaggattccagggatttgcttgcatactcccagtcctctgtcactgggcaggtctctgtggagcaccgcggtgtgggagcctgggctcgctcactccgcttagatcttgtagaagatggttggatctaagcagaaccttccatctacagcctctcaagttgccaacccataaaaaccagctgtgctcctggctcagtaacccttcagtccttgcctttctctgacttctcttccttgtcagcaggttagtttgtagcctgaactgcatgatggagattgagctggatctattttaattgccatgaagacatcatgggcaggaagcatgcatgctggaatagattagcaaacattgactcctcacgaaagccacagccttccaactgcaactcagtggtcagaggaggatgagcaaaagtggaggacagagaatgacccgacgtggagctgagcgggtgagggctaatctcacagaggcatgttactcaaaaatgcggaaacaggttctttcaggaggttagagtttccttcctcgactcaagcagtcattctgagcatgtggcatttgtcagaaggttgtgtttatgttttatgcttgatctataatgacacaacaaaactcatatagagaaggggaatcaagatctgatgtgtaaaagagcctgtggtttaaaatatggaggtattttgggctccctggtgagaggtgaggccaagcaatgcagcacacagatgagctctgcagtgccagcctcattaggtcggcctgcgtggtcctctgaaatgtacagttctgttgtcgtcactgtgtataaacagaacaaggagagaactgccttattcctgggcactggcctttttaaatcctttctttttctctttaaatttcatgttcccttgtcattgttgctgtaaaaccgaagccctcttctgcgtggcgatttggagaacacagtcagcatgcacacacatcattcttcaggtgcagttatgacagaaggatggtcctgtctcatccctacacctgtgaggcctcagttctgcctctctcccctgttgtggccttggaaggaaaagcctccagctctgagtctgctgccaggtggaggttcttccatttgataaggtgaggagcgtgaatggatggagctgagcttctgagactcggagaccagtgaacctgcttgccaccctgggcaagagagcccaggggctggcccaggagaggcggcaaggctgtgtgcagacactttgcccctggttgactcctgacggcgcttactccaccactgcatcccttctataccctgcttctcccttcagacaaggggcagactcctaagaaggcagctttgtgttggacaaaacacagtggggacaggaacctaaagcagttgtgaaagagccggaggacccctgtccccaaaccctgcccatcgggaagaggccacagagctatgtgtcggccccacgcttgggcagaccactgcaggcacgtgtgtactccgctgggctccaggggcctgattttttaacttatccctgagattgagttataaaatttagatcctccataagtagactcacatggagtcccagctgatttctgataagggtggaaaaggaattcagtggaggacaggtcacctttttagaacatggtgtgggagttctcagatgtgatgctgagtacaattcataaaagagaaaatgcagacatcagacctcatcagaattaaaagctgttctgttctgcagaagactctgttaagagggtatgagaagctcaagattaagataaagtatttgcaaaccacatgtctggcaaaggacttatgtctaaaaaaatataaagaactctcaaaacttagtaacaaagtcggcaataccattagaaacgggcaaaagacaagaaaagatgtttcactgaagatgatatacagttggcaaataggcatatgaaaagatgttcaatgtcattagccattaaggagatgcaaattaaaactacagtgagatgttaccatatacctggcagaatggcttgattgaaaagtggtgaccacaccaaatgctggtgaagatgtagggaaactggatcattcatacgttgctggtgggaaagtaaaatgttacagccactctggaaaacagtttggcagtttcttataaaactaaacatgcaactaccacatgacccagaggtcacatttttgggcattaatcctggaggaatggaaatttatgtttgcataaaaaactgtacatggatgtttatagcagctttatttataatagctccacactggaattagtccagaccaggtgttcatcagtggtgaatggttaaacacaccatggtcatacacactgctcaacaataagaggaaatgaactatctgtatacacaacttagataaatctcctgggaatcatgctgaatgaaaaaagccagtcccattttttttttttttttgagacagagtctcattctgtcacccaggctggagtgcagtgatgcaatcttgatctcggctcactgcaacctctgcctcccaggttcaagtgattcttgtgcctcagcctccagagtagctaggattacaggcatgcaccaccacacccgactaatttttttgtatttttagtagatatgaggtttcaccatattggccaggctggtctcgaactcctaacctcaagaaatctacctgcctcagcctcccaaagtgctgggattataggagtgagccaccacacctgcctccaaaatgtttttatgcctattttttttttttttgacagagtcttgttttgtcacccaggctggagtgcagtggtgctatctcggctcactgcaagctccgcctcccaggttcacgccattctcttgcctcagcctccagagtagctgggactacaggcacccatcaccacgcccagctaatttttttgtatttttagtagagatggagtttcaccatgttagccaggatggtctcgatctcctgacctcgtgatccgcccgcctctgcctcctaaagtgctgggattacaggcatgaaccaccacgcccagccttttattccttttatatgacatttttgaaatgactaaactatggaaatggagaacagattagtggttgtcatgggttagagattgggggctggggatgggagggaggggggtgtgcttatgaaagggacaacatggggaccttgtggtgaccggatgttctgtgttcttcacagtgatggtggacgtacaagcctccacctgtgataaaattacacagatttaaacacatgcacttacacacacacacacgcaatcccacacacacatacacacacggacacacacacacacacggacacacacacacacacggacaaggaaacaagtcaaacaggaaatctgaataaggtgggtggagggcaccagtgtctatattctggtctgaatcaggtgggtggagggcaccagtgtctatattctggtctgaatcaggtgggtgggggcaccagtgtctatattctggtctgaataaggtgggtggagggcaccagtgtctatattctggttgtgatggtgtgctctagttttgctagttgttatcatggagggaagccgggtatgaggtatgtgggcacttctgtaatgcctcttacaatggcatgtgcgtccataaacttaaaagtctaattaaaaattgttaaatgcttacagggttatatgagttttatgtttgcacaaatctcataatcaaaatcttaaatcatgatcatgaactgcagtggtgctcctggtgctgttttagctgatgaaattacattaacttgccttccgtaggataaaacgctcatcactcaaaagtgtacctaacagcctgcaaacaacataaactgaaacctttagtatgcagatggaaattctcattctcaataagaagactccgtaaagagaatatggtaaaatattagcctatagatttgggcccaacccacatggatgctgcagacgtgaatgcaggacaaaggttattgctctctctggtacacacatgaagcctgtctttccatgagaagcagtctctgtgagctctaggccttgcaagaagcatcattcagcttctatattctgctgatatgtttgcttaaatgaagatgcattagatatgaatcctgctgggctggtctgcaccatacttattaagacagtcactttgaatacctgattttaggaatcctgctaaagattagatacaatctttctcttccttatctaactgcttttttctataactgctatttttgcttttcctcttctctttccctcctctctcctttttcctcccctgtcttactcctctctcctcccctcatctcctttccttgttgctagcaaaaccactcttaaataacagctaagggaatttctctaaacagaaatgaaataataacagaagaaggcttagggcttcaaaatggaaagaacaacattgaaatgagtaaaaatcgtgctaagtatccttttcctcatgtggcgctctctatatatagaggatacttacgacaattggatttagaaagtatggagtgtaagagaactaagtgaaagtgaactttctatgctttactcgaagtggcaaggcactgatgtcagtagaccatggtgcagtgtagttgcatactgagatacaaagagcaactgataagaaaactgtaaaaggcaaatactaaaaaattgtgaataaatcaaggtagaatccttaagaatattcaagtaagccacagtaatgcaaaaaggaaataagcagaatgagaggcagaggaacaaacaaaacaaataataaaatggaagatttaagccttgatatgtcaataattatgctaattgtaaatggcttataacactaattaaagacagagattggctgagtggatttttaaaaaacccacaaaaacatgattcaacaatatgctgtctatgtaaaactcacttaaattacaatgacatatatggattgaaattaaaaggatgggaaaagatatactgtataagtagtaattaaaaaatcagtagccaggtgtggcggcatgcatctgtaatagcagctacttgggaggctgaggcaggagaatcacttgaatctgggaggcggaggttgcagtgagctgagatcatgcctctgcactccaacctgggtgacagagtgagactccgtctcaaaaaaaaaaaatcaggagtgtctatatgaaattatataaagtagactcatagccaagaaaatcactgaaggccaagagggaaattatataatgataaaaggatcaatccactgggaagacataactatcctaaatttagtgcatgttccaaacaacaaaacatcaaaatatataaagcaaaaagtgacagacctgaaatgagaagtaggcaaatcaatagttaccttggggtctgtcaacaccctactgtcagtaattgatagaactcctagactaaaagtcagcaaggatatagaagacttgaacaacaccatcaactaacaggatctaattgacattttagaatattgtcacaggatatgtcacagaattgccatcagcaacatagaatacacatatttttcaatttcttctgaaacactcatcaatatataccatatactgagctactaaacaaatctcaacaaatttaaaataataaaaatcatatagtgtgttccttgaccataaaggaattaaaccagaaatcaataatagaaagacaacagaaaagtcttcaaacatttggaaattaaacaacacacttctaaataacccatgtatcagagaaaaaatctcaaaggtaatacaaatgcattgaaccaaatgaaaatgaaaatacaaaagccacagtgttaagacgcagctaaagcagtactgagagggaaattcatagcacatttagcacttatacatatttataattgatctagactgcttacattagaaatgaagaaaggtctcaaatcaatggtgcaagtttctattttataaaactataaaaaacaagaaaaataaacccaaagcaagcagaattaaagaataaagatgagagaagaaatcaatcaaattgaaaacaagaaaatagaaaatcagtgaaatgaaactagttcttccaaaaaatctataaaactaaaaaatgtcttgcaagactgagaaagatacacaaagagagaaatacaaatctctggtattaggaatgaaataggtgctattactacagaacgtgtagtttttaaaagaataagggaaaactatgaacaattttaagttcacaaattccatacttagaagaaatggcttgtagaaaaccataaactgcaaaaactcaaccaagatggaatagctaacctgaatagtcttataaccattaagtgaactcataatttaaaatctcccaggaaagaaatattcaggttcagctccccgccacacttcagattaggtcaggcacccacttctgctttagttcctgttcttttccttcatgccatgcatcacagttcattataatatattaatatgattatcttattaagccactctcccagaatcctataaattccatgactatgttacttattttatgtctccagcataaagcctgacacctcatggaaaatgcagagatagtaactgaatgaatgaatgaatgaatgatatctttgaatgatagaaacatagctctcagggtgtcttatttaacttgtgatatattgagaaattgccctagaatatcaagatggaatttgtttggcttggcaatgtcttcatcattgacaaatattagctcatgaggtcagtcaagggctggctggctagaggaaaaagtaaatataggtatgaaggaagctcacgcccctaattctctgaagttttacacaatagagtttgtcttccatttcatgaagtctcagcccgtgactgtgacctttacctttttacttttgctagaaatattttttcatgagggtattttaatctaggatgcacgttcacttatctaagtgaaaagtcccaagtcgaaaagttccaaatctctttaatggaggttgcaattatgacttatttcctttgtctgggaacataaccttgctgtctggctgtggtacagattgccattcaatatacttatatgagtatgcttaatatgaatatgcttattcaaagcttattcaaagaatcaatgcaaaggtccccagggctccactttctcttttgctttgcattgttattgattattgtccttggggagatggtcaccttgggcagggaaggcccaggcatcccccaagggcaagggtggttctgctcagctggaagccagaatctcgcacagccatagcctcttcctaaatatctcctgaacaatgaatacgtggttcaatggatcctcagttttaaaggagatcccaggtgaagatgaacctggctgatatacatccttaaaaagaaaaaactaacaagccaaaaaaatctcccattttctaaaaaaatcctggtctggaaagaattcaagccatgtcaactccgatgtaagctttgggaatggaattatcataatcaaagagaaaatgaagtgaagagagtaggaagaggagtcatgcaaggaaaggcgaagcttgagaaagaacacggtgggatagccaggaccacagcattctccgaattgtggcagctggtgtgaaatgagggctggggtctctcgtgtgtgcccaggacatcttgcatgcatggaagtgctgcactggccaatgtcattctcactgccccacaagcctgcagggaggacgtatggtttgctctgtgactgattttaaagtgatctcagggaagaataggaaaaggcagagagtattgtcaccagggaagtggattaaaacgtgtggataagctgctgggtcgaagtctcctgcaaccctcatcacctccttacaaaaggaatcagtccggcttcccagatgcggacgttcaggtggtgaggttgtcggtgttgaggttgttgtttggccaagatcacatccatagatgactgaggggtggagcagggattcgatccactttgtccaaccctgagcctgagtgtctctcccaggcccacctcccaccaaccctgagttgggatgaggactgctgccctgccccactgacaggaaattgtggggagaacaatacaggaagttggaaatgcagcgcggagataatttaaaggatcagtagcaagaagttccatttatgtgtatagaatgtctaaaaaatttaaatgattccttcagaaatgtaataattttataaatataggtctaaaatgaatcaaagtttccgctaagatacacctcggtggaccctatatggtggcattaccattatgctgttgactgtaaatgtaactgaatgtgcaattatggtatcatttgacaagttggtgcatattgaacacatactatagaacacggaggctattttaatatttaggtgctgatttttttgtaatcagaaagaaaacaactatattttcaagtatacgttaaaaaagggtttgagtttcaggtgaagctattagattccgagaaggctgataacgagagatttaaaataacacgaagattcaggtgaagctattagattccgagaaggctgataacgagagatttaaaataacacgaagaggtgatgtacacagaggccggtatgagaaattccacattaactgtaatttgaaaatgttttgcctctcaccgctttctgcgttttaaatggaggtgtctggccctcactctccaaggcctgctgtctttgtgtcaggtttcagctcccgctggggcctcagatgtgtgggtgtggcaggccaggtctcactaacgcaggcctccgtagcaactgtttcagtattgactgggtggtgaagttgaacatcagaagccagtgcccttatacaacggctggaataggacaaaagcccaccaagagttttgcccgggcctttcctgggccttgaagcatgacaaaacaacgaaggcattcttaacaggacccatttagaattaaacaagttttactgggggtctgaagaaaccccccaaacctccatgatttagcagcagacaagataagggtaatcaccccggcacctggaccatttagatgacgtaaactcactgaggctccagaggaaggtcttcaggactcgaccttagttatagactagaagaagttcatcacttatgtctttaggggaatgaacacttacacgtagacatagagcttagaaggtacagaagctctggaaaactttgtcattctgagttggtctggcgatagtttctgctccttctccctgtaaccagttacagaaataaaaactccttcctcctcagttcatctgcatctcgttattgggcagagagaaatagcagcccaaccctcagtttggtccgggaacaagggcacttgggctcacagcttcgttgggggaagattcagatcctcaaaaaattgaagcacagcacggacctgggtcccctgggaggccgtggagcacgagggagggcacagaacccaccctggcccgaggccggctgtgcctccaatgagaggtgtccccgggctgtggatgcccaggttacggggaaggtggtgctggctggggggctgggagcagatgaacggcaggagctcagacaggtgttggtgagacaagagcggggctcaggcctgcttccaagccgatgcttttgcataaaatgaactcaagggagggtgtgaagctttcctcccctcagtgttactcctggtggagaaagcttgttaaagatgttctaatctctgctgtggtaaaagacaggaccattaactcagggggcctgtgttccttccgcttgagggcagagcctttgctgccccgggctgagcctccttctgcgcaaggaccattaacgagggggcctgtgttccttctgtctgagggcggagccttcacagccctggactgagcctgcctctgcaccatcctgcagtgtcctctcatccaaactgtggccgccctgccaggcccctctctctccttccacttcctgggcgagacttcagggttcacagcatcgttccaaaacctgcacgggagaatttaaactcaggcctgcctgcgtccagctcgggtcctgtcttgtccctggctgccacctgcctccctgctggccaccccagcaggcaacgtgaggctggaaggatgtggcctccgggaaggttttagtccacatgtcactcataatacgacattcagcaaaatgagtaaaaacgtttcgaagggaaaatgattttatagaaagggatgggtaacctttatgataaaattgctttgctagagcgtgttgcttgtgacagcaccacctttctgttcttgacaatgtttgtcttcttaactaaacaaacgttagctgagttgaatgaaattatgtacgaaccagagaagtcgggaggatgtttgaggctcgagcccccgtcatcaccttttgtaatataacttcattttgtaatggaagtggctcttgcgaggctgtgtgtgtgtgtacgtgatatgtgtttgcatgtgcgtgtgtgcatgcttgtgtgtgggtgtacaatgaacacctctattcaaatagagcagctcttcagaagccacttggattgatctgttaattttccagaattttacaatatggagaatcatcacaagggaaacctatactaccctagcagctactttttaaaaattctttttgtaattagcctaggtctctttttgttttaaagaaagtcttcactgatttttaacgatcacacttacttctcgtgagcaaaagccgataatgtctgcagtttgaaaggtaattatgcctggcttctcatccagcagctactctgatattccaaaataataatgttaccattggaactgggttattcttcatacgatactttgtagtattgtaaccatctttataataataaaaaggcatttatattatgaacacttaattttttgttttctaagatttcccacctctcaaagcttttaggaaagagaacattaaaagatgttaatgcacacagatacatctcaatttccctcggggagaagctaccttaactgccatttcaagttttacatttttgctttaaacgagtgatttcatttaaataaaaaagtcttattttctgtgatgaaaattcagctgctccttgtaaccctgaagcatcttgatttattattgactatatcctctttcaaggagaatattcttctcaaagacattatgcaggaattcttatattgcttactgtttggcattttctattaatctcaccacatctgttttcatgctatttggataaaaaaatcagaaaagtatagtagttacatgttttgataaatacaattgcaagaatcaacacattctgttcacctgaaggagcctgtctaatgtatgctgttagttgcattaaggaactcttagaaatttaaaaagcatttttaacagggcaaaggttttcttcagttcttttgtaaaaaaatgtacaaacttcactaaaataaattttagaaattactttgtaaaagacgtaaatgggaaaaaacattttatatgaatttgtcttccaaaaataatttggtatacatatatatatatacacacacacacatatatatacacacacacacacatgcacatatatatatatagctaactttccatatgtgtgtgtgtgtatatatgtggatgaacgtaaagttagttgtagcttattatgtcgtttctatgtatagttgcaattcatacatatttatagtacatatccatagagtcacaggacacacatgcttatggtacaaagactaagaagcgactccagccaggacgcttacagcagacacgcagccacgggtttattaggagcccgagtcaggtctcttatttgcacagcagttgtgtgcctggctgtgcgctgatctaaaaggcatctcctgccctaagagagttgagtgactcacctgagccgattgggaaattattaaggcaagaaatatgggaagaagggagggatccaagtgcatctgagccctgatgaggatcctggccttggaagagcgtcctgggcaggagtggggtttggacagcgatagcgggtcctgtggggaaggaagccagcatttcaggctggagcgaagcttctttggaggtgaaaagtgacacggaatgtgcaggaaacagtaaaacttaaaatgggcagaggatatgggacgtgtagggcagatggaataaacaggagcagaataactccagttaagctgagcagatctgctatctttaatcttcaacgcgaggctccccacctggggtctcacttcttaggaacattatgccagctggcatgaccccgtttactcatgagaaccgcttcgtccccttcccttcctgccacctctcactccctcctctcctttgggcagagtggctgaagcagggtgggcagacaaaggccctgaagaacactagctctggccttgggagtgagacgcaccttccttcccctcagtggacagagcaggtccttcactatggggctcctgagtctctcccaggatggaggcaggcccttcacgacagggctcctgagtctcctcagtggacggaagcaggttcttcactatggggctcctgagtctcccccaagacagaggcaggtccttcatcatggggctcctgagtctccttagcagatggaggcaggcccttcatgatggggctcctgagtctcctcagcagatggaaggaggtccttcatcatggggctcctgagtctcctcagcagatggaggcaggcccttcactatggggctcctgagtctcctcggtggacagaagcaggttcttcactatggggctcctgagtctccccaggacagaggcaggtccttcatgatggggctcctgagtctcctcagcagatggaggcaggcccttcatgatggggctcctgagtctcctcagcagatggaggcaggcccttcactatggggctcctgagtctcccccaaaacagaggcagatccttcactatggggctcctgagtctccccccggatagaggcaggtacttcacgatggggctcctgagtctcctcagcagatggaggcaggttcttcactatggggctcctgagtctctcccaggatggaggcaggcccttcatgatggggctcctgagtctcctcagcagatggaggcaggtccttcactgtggggcttctgagtctcccccaggatggaggcaggttcttcactatggggctcctgagtctctgccaggatggaggcaggcccttcatgatggggctcctgaatctcctcagcagatggaggcaggtccttcactgtggggcttctgagtctcccccaggatggaggcaggttcttcactatggggctcctgagtctctgccaggatggaggcaggcccttcatgatggggctcctgaatctcctcagcagatggaggcaggtccttcactacggggcttctgagtctctcccaggatggaggcaggcccttcacgatggggctcctgagtctcctcagcagatggaggcaggttcttcactatgggactcctgagtctctcccaggatggaggcagactcttcatgatggggctcctgagtctcctcagcagatggaggcaggtccttcactatggggcttctgagtctctcccaggatggaggcaggcccttcatgatggggctcctgagtctcctcagcaggtggaggcaggcccttcactatggggctcctgagtctcccccaggacagaggcaggctcctcaggatggggctcctgagtctcctcagcagatggaggcaggtccttcactacggggcttctgagtctctcccaggatggaggcaggcccttcacgatggggctcctgagtctcctcagcagatggaggcaggtccttcactatggggctcctgagtctctcccaggatggaggcaggcccttcatgatggggctcctgagtctcctcagcagatggaggcaggtccttcactatggggctcctgagtctcctcagcagatggaggcaggtccttcactatggggctcctgagtctcctcagcagatggaggcaggtccttcatcatggggctcctgagtgtcccccaggacagaggcagtctcctcatgatggggctcctgagtctcctcagcagatggaggcaggtccttcactgtggggcttctgagtctcccctaggatggaggcaggtccttcactatggggctcctgagtctcctcagtggacggaggcaggtccttcactatggggctcctgagtctcctcggtggacagaagcagtttcttcactatggggctcctgagtctcccccaggactgaggcaggtccttcatgatggggctcctgagtctcctcagcagatggaggcaggttcttcactatggggctcctgagtctcctcagcagatggaggcaggctcctcatgatggggctcctgagtctcccccaggacagaggcaggtccttcactatggggcttctgagtctcccccaggatggaggcaggcccttcactatgggtctcctgagtctccgctgcacattagtgctgacaagctgagcagcacctgggctccgagacagcctggattccaaactgaacatggccactgatgagctaggtgaccgtgggacagtcaatctgatcctcatggtgtggaccgtgtctaatattaaatctaatattatatctccagtccttaatattccacacctttgctacaaacgccttttttttttttttcttaccatctttaaaactggtagcatctggctcagagattgctttttggagccagagcccacgatatacccccacattgtgacaaaatttcaatgtcatgataatgaatgacatcagctacacataatattttcaattttaattcttagttttgcacaacctaatttatctgtagcctgtcctgggggcaggtctgtaccggtttcctgaaaaatgtctaaagtctaacataaattaaacaagattatgaacactctggtccaagataagctatgagccaagtgttaactgtaaagtggttcctaatgtgtttccaaagtccaacagaacaaatgcatgaaatgccaggagatgaaactgttttaagtaatgaaatggggtcctcaagagaacatgagcacagacttcaggtgagttttacagccatttttgtgccttagccaaggtgctcacagacatgacaacgaaaattcatgtgttcaagcctcactccagcctttgctagacctagaggaatgaatagctagcactattcattcacaacactgcaggatattttgtgattacactttatgggttcactggtggaccagtttctcagctcacttggtagtgtcagctgaatcatttccctaagtaggactgtcaggtagaccagatgtcagcttttgcatctgtgcagtagacgactagtttcacttgctgttgggtagttaataacatctgcctcctgaattgcctttcattatgcatttagagaagaatatcctagattccttgggaaaaaaatagaaaaaatatgtctagcaaaatcttttacctgcaacttatctaaaaaaaattgttttttggaaaagcaatattcctatctgctgtttttattgtttttgcttcagatgcactgtttttaacataagctttctaacatctgaaagaaagaagagttagtgtggttaatctttcagaataaagagacaacttctcagaggaaagaagatttgatgcagaaaacccattgtttacatatgattatttgttttggaagacactcaataataaataataacagttaaagatattttccaagtcctttagacatattatgtcattaaactcacattcaatccttcctatgaagtaggtattactcttcacttacacaaaatcacacaggaagtaaatcaatcatttttacttattctcatgacatatttgtctttttttctgtgacaatctattaatgttgtaaaatcaaaagaaattttaaaatttgttgaaatgttgacgcttcccatgcttaataatgtatagaatctcctttaattttcaaaattgacattgataataggatattcatctctgtattttacgcagatgagggaattgagcttagagaaattaagaaacttgtgctaattctgttattctgaattctctccttatactgtggaaataaatattcatttgattttatattacaagtcaattcccaagtaaatgtgtggatattcaacaccctggtcccaattaacaatgaagaaacaaaacaaaacaaaattcagtttcagtctgatttttaaccaatgcatgataaaacatccttgaaataggatctttctctaacttgcccataactataaagttaaataccccatggggtatattacgctaataaaatttaaacaatataactgtgtaagatctggattattcaaaatttctgcaacagcttatctccttattaccctgtcccaataaatagtttccctttttccaagaaccccttctggggaagatcagaagacagctcaggtttccctccttggtaggtgtggtttcctaatgtctttgtcaaatttctccctggttaggtcttgtctgtgtccccaccactaagcatcaccctgtggaattcatgtcttcacattttaatctaaattttaagtttcctctgtgttagtatatgttaatgtttcatgttttcagtgtggagctcaaaccacaggcctgctagagatggccatgctgtgcttgaagccaaactgaaaaaacaaaaacatccacacacaaaatagaaaaccagacattttcacttaatagctactctctcagttcaaataatgacagtgttattccaggctcacccaagtgctaccccgacaataaacattcttataaaatgaaaggaccagcagtcgtactcttgagagtgagacactgttcttatgagattaaatgaaaagatcaataagaaccaagctacctgttatactgtatatggtaaaagcacagaagatagaaaagttcagtttaacactttgccgttttgattttttttcttggaaaacttgggagagaaacagagaattctgacccagtataaaataaacagaccaagagatgctcgaggggtatgaccacctgagctgaatggacaagaggaaaaacaaaaacaaggaagatggggaaatgcaatgagccagtctgaaaagcgagttgactgtacttaaactgatagaagacagtaaagtaaatgagatgggacaagagcaaagagggatgaaaactacttcagcacaaaagactaaattgaaataacacctacaatgggttgggaaggcctggagagaagtgaatgaataaaaacaacaaacaaacaaacaaacaaacaacggaaacttctaggatgacaccaagtacaaagtgatgtaaatttttcctctaagtaggcataggccaagggggaaaaacacccaaattcaaagcttatttttctgtcctgtgcttgggactcatttttccttaggagagcttttgccccatttcatgtgggagaatgtgagaaacctggaacctacatctggttcttgctgaagacctttctttgccatttatgctccctcaaaactaactgtcttcagtttcctttcttattatgcaggcgaattaattctttaatgttaataatatattccatttgttaaatattatacagtttttggtctgccattcctaacaacttctttgattccccttgcaaattgaattagtatttttatttaaccatgtccttcagttttcaagttcttcagctattgaaggaatcgcctctgtgtgtgggaccagaggacaatgaaaaattcaacacctttctagtcaccattttaatgttttaagactattaagacattaatagaaacctcctttttttcagatatcagtatgagtttagctgatttcgcagctaattcctaatagcttggacttaagtgagaataaaaggttcaagagtaaaaatcgattaaatgagagttatctaagaatattgagaaagccattgcaagagatgataaaaactaaataaaaggaagactcgaagtcagtagattatctttttctggagagtattagaaaaaaaggaaggtaaagaaatgtttccttattcagcatgggggagtacaaatctaccactattgcaggttaacacaaatgctattcacccatccacctatctatctgtctgtccatctatccatccatccatccacccactcattcatccatctgtccatccacccatccatccatccatccatccatccatctatccatccatgcacccacacaccactctatccattcaccatccatctacatccattcttctatccatctattcatccatctatccatctacccacccactcactcattcatccatccatccacccacccacttactcattcatccatccatccactcacccactcatccatccatctatccatccatccacccacccatctatccatccattcaccatccatctatttccatctatctacatccatccatccatccatccatccatccactcattcatccttccatccacccagccatccactcacccatccactcacccatcccatccatccattcaccatccatctatctacatccatccatctatccatcctctatccatccacccacccatccatccattgatcatccatctatctacattctccttccatctaaccatccatccacccacacatccattcatccacccactcatccatccactcacaatccatccatctacattcatccatccatccatccacccaccactctatctattcaccatctttctatctacctccattctcccatccatctattcatctgtctatccatccacccacccattcactcattcatccatccatccatccacccactcactcattcatccattcatccacccacccactcatccatctatctatccatccatccatccacccatctatccatccattcaccatccatttccatccatccacccactcattcattcttccatacacccagccatccacccacccaccccatccatccattcaccatccatctacatccatccatctatccatccacccacccatccatccactgaccatccgtctacattctccttccatctatcaatccatccacccacccatccattcatccacccactcatccatccactcacaatccatccatctacattcatccgtccatccactcacccatccattcactcattcaccatccatccatctacattaatccttccctccattcatccatccacccacccacccatctatccatccatccatccatccatccatttaccatccattcactcaccatctatctatctacattcatgttttcattcatccatccacccaccaacccatccatccatccacacacccatccattcattcaccacccatccatctacatccattcttccatccatccatccatccacccacccacccatctattcattcaccatccgcctacatccatcctttcatctgtccattcgttattcatccctctacatcaatttatccttccatccatccattcatccacccattcatcatccatctacatccatccatccttccatctatccacgcatctatccatccatccacccacccatccacccacccatccattcaccacccatccacccattcttccatccatccatctgtccactcatccttctgtccatacatctaaactcatccatccatctgtccttccattatttacatgttgcatgtactcactagtaaatcacatgctgtgaggaaatcagaaatttaatatagaaccatgctcttaaaaacttattttttagttgagaaaattaaaaattgccagttaagtaggagaatacgctttcagtggtgcaaataagaacagtagtggtcaaagaaaaggaaagttaaaaggtgactggagaggccagggaatgagctaatgggctaataagctgacctgtgtgatggaaggaggtttgttaagagtgagacatacggttgatgatttggataagatagttatgcaatgtaaatgacaaaactctatagtgggtcattcaatattttaggggaaggaaaagcaggtgaaaaatccgtagcttttctttcgatattatagtccaaagtgagactacataaactctctctcaccatgtaaagctcctactccctagagtaaggttctatctttaacactgtaggacgaggaatggaagggagggggtgaaggaaacatgaggtcattaagttaatgctttgcgttgtcatggaccaggacaagaaggctgaaataaggttgtgtttttgttcttccactttctggacaaaattctttgggcaagtcatttagtctttctgaacctgtgcgtctccatttctggaatggaaatattattatttttatgactacgactacctcagatgattattgtgaagatgggaaagaattctgtgaactacccaaatggtacccccaatacacaaatcgtcatagtaagaaaaatagcaccccagctttctggacatttgtacaaatgtacaagctatgttacatgcacctgtttattcagtcttcacaatgactttatgacacagttgttactatttttcccacttaacaaatgggcaaactgaggcagagcttttcagtggcacagtgggtaagtatgagtgctgaggtcagggcttaggcgggggcgaaggcatgcagggaggcggtgctgaagcaggagacacgctgggcacagaggcagaaagcctgggctcccattcctgtttgtcagtgaatagctgtgctcctcagggcagtcacttgaactctgtgtgccagttttcatactttttaaaggaataatttttcatctctcttacagtgttctcgtgacagttaaaacgttcttgtatgcaagttcgcctattatagtgcttggttcagagtggactttgataagttttgctttcttgtgaacatattcaacgatttctcacttattgatactcctgccaaagtgcctgacttaggccccgggagggttgatggcctcagagggtttcgacctacgcaattgtcaagggtttatttcattcttcttaattgaattatagcgcttgggttcttgaagctcatgacttcatttaggaaatatttgaaaattgattatttaatcacttaattgtaaaacacgaatgaaatttcttagttaattaaagctgtggataataatttaattataactttatatgccagatttactcaaagcatcttaaggatgaggattcaattagcagccttcggatgcacgggtcagtgggatactacctacagcaacgcgtggaatggcttagagcagcatagctagcagcgctttataacagaagcttggagagcaggacacagcttctggctccacaggtatctgagattatcctggaaaaattatttaacctctttaggtttcagttttctcatctgtaaaatgggatttttatatctctttccaaaagatattgtaaggatcaagttattttcccctgtggctcatggcaggtaacaaccaacctggctctcaggtgtggggagaaaggagatggctgtaaaggatgtcactgtcattccaccaggcagaacacaatgggaagagagtacagaagtccagccatacagcttctgcatttttgagtgaagacagatcatatgtaattttttttttgtgtttgttttgtttggttgctttttaaaatgtgattgcagcttcaggggtacatgtgcaggtttgttatacaggtaaacttgtgtcacgggggtttgctgtacggattgtaatggcaccaggtaataagcatagtacctgattggtagttttttgatctccatcctcctttcacctccaacctcaagcaggccctggtgtctattgtttcctttttcatgtccctgtgttttcatcatttagctcctgcttacaagtgagagcttgtggtatttggttttctgttgctgtgttagtttgcttaagatcatggcctccagcttcacccacgttgctgcaaaagacatgatcttgttcttttttatagctgcatagtattgcatggtatctgtgtagcacattttctgtatccagtctaccactgatgggcattcaggttgattccatgtatttgctattgtgaatagtgctgcaatgaacatatgtgtgcatgtgtctttatggtatagaaaaacagtattacaaacctataggctaaattgatgttctttagttatcgagggggaaagataattatatccttggtggtgtttgatttgtgtaatacagatgtttgaaacaaacatgttagtggtgttggaaaacatataagacagtatctatgaagaggcgaggggaagattaggttttgggctgacaggctctctctacctccatgaaacaaatgtgaatgagacacagggtatggctccctttgatatttaaatgttaagtgtctactccaaagtgaacatgggttttatgtatatgcatgtgtcaggactcccttcatgaatatccacagctccttctgtcacctgttgactatgtatgtttagccaacctattcagcatagagctgctgcccaaatccctcctccttggaagtgcccatttctggtcttggcaggaagctcttcttcccagcctgtgagattgccatgcttctctcaggtgctttcttatgaaagttttcacagatcatttgcatggtaatagggtgcatggacaagcccatctcacatagcttcttatgttaacatctttatttcctgcagattgaacctagaaagactggttgggccagacatgtaagtttccctcagtccagcagctaagcaggaactctgtgccttatatggccttggaaaggaaaccgtgcttggtctaaatcaacagctttcctttgtcgacctagcactgctggactgtaatactaactttaaatcaaaggagccatacccccccagaagccaccgccttcccaccaacagccagagcctcagcctgccgaccccatgactgacatctcaggggtccccagctcatcttgtaagcatgaccaccctgtgcacactgcaccacaggacacacatgcagcctgatcctgcccatacactctggagaagcgagttcggggagaaaagggttctgggtaattgtgtcctgcacaccgggattcaagaatgaatggttgcggtcactggtggtcctgcctccatcctcggtctttccatgagtctggatgagaccaggtccccctcacccgagtgacccccactccttttctttattgccaggaacagtcagccccacatgctattatcaacaactgtcactttcccacatttgcccaagactctgcctcggtcagggctgccctttggccagtatcccttagttttgtattaggatctggtgagatctcccagctggaccccgtgccccttcacttccccgtgacccatcctgtatcagcctatatcattcagctgccccctccactgtgctgagtgtgtgcaatgcatccccatggtaaaagttcttcagaagtcccatatccattggtcctgtgtgttttctccccttttatcccaggtgtctcctgtgacttctgcttcctctcccctaattcctttcaggaccctctgcactagcacatcagatagcttcataaagtctcctggagcagaaattagatgctcatccagagagaattcccagaggagaagccgaagagaacatgtctgaaatctcatgcaaatccctgagagtcaggacctcatgggaagaaattcaatgtattcctttaaaggcggggacacagtgaggctcatcctcagggctttgtgcaaagtgcttccctccagattgaaatataggccgtatctccaggtccaatttaatctctattaggcactcaatggctaaattaaggactttacggatacctaatttagataaacccttaactattaacctccaataatgtcatcatttcactgagtagaaaagaaaacatctgggtgagttcaattagccaagggcatggaggagaggcctgcacagtgcctgtgcatgctaattttgtctcgctgaccctgacggaggggctggctgcaaggaggccgtggccagcatgacgcttgaatggaaggaggctgccgccagtatgacgcttgaaggtggccaccctgccctcctgggaagagcttcccgagagtctccacactgagagcacaggtggaggctcccgtcgagagggagctccccacgctcccgtcgagagggagggaggaattcctcctgcatagccctggtcctcagttacaagcctgcttcttttcctgccctctgaaaatgaggacaactcatcttattttatgcaattatagtctgttacataaaagacactaataatctttggaaaatcattatgggtgtgtctgtccacttcgtttcctgctgctggaagggtgctttttctttagccgctgtggctgcattttggttgctgtaggaggcatgcagagctgcccctgcctcccactctcgtggcttcggtgatgattcagcaccggactctgatgtcggatgcccggatggtgcctcctgcacctgcaaatgcctccctcgcccccttggatctgtcacttattgtgttcacatctaccgtttgctggctccttttgttgaggatgtctggttcttccccaggggaaactgatcacaaagaggactgaacaagaacaggctgcctaaagctatttgacgaggatctgagtgcaggtggatttattctgaaggtcatggcagggaacatgggtgagtggcgaggaagggaggtgaggggagacagaagcccctgcttgcatggggcccctggggctttgggggctgcaggagcatgccttggtgttgttccagcctgaaaacccaagatttggggtgttatctgccacctgaccctccacgagctgaaggctgctgctgaggggtgggaaagtggtgacttttgggtgaccccactggccctcaccatagctgggcacagcacacagtcagatgtgctgtcagggagctcctgcgaataggcacagcagccttgagaaaagcagagggagctgatggtgtctgctgtgtgcaagccagaaacacagagagatgtgtgtgccaacaaaacctggaaaataaccatgtcctcatagcctggggactctgggaagtcctacagcaaagaagaagcctggtctgcccatctttgtgtgacaagtgtttgcaggaaatagttcatcaaaaaacactttttctcaggagacaactaggaatcacctaggacacactatgaaatggtgaaccagcgatacaggtgaaagtgccctcccagtatgggaaagacggcagagtattcaacagggacacaggagcggtgtttatcctctggagggagcaaacagtggagtgtgcacctcactcagccaccaactttgcacctggcggtgctgccctgacacctgaggactcatagggccaagtgaggctcagagtctgaggcaacttggactgatccttaggtggacagcaggatgacagccacctgtgcaggaagagggaacacagctgcagagaaggggacacacctgtatgaggaggggacacacctgtttgaagaggggacacacctgtatgaggaggggacacacctgtatgaggaggggctcacctgtataaggaggggacacaccttcctgagaaggggacacacctgtatgagaaggggacacacctgtataacaggggacacacctgtatgaggaggaattacacccatatgaggagggacacacccatatgaggaggaagtatacccgtatgaggaggaagtacacccatatgaggaggaagtacaccgaacatacttgcagaggaagggagcccccaccatgtgccagggccccatggacatgagatcatgagagacatctggtctgtcttctcgcccacatgtgagacagatgggaagttccagcattttgtttatagacttagagaagggaatgagtggatatttttttttagagaggtcacaggacatctcagtggcttgttaaaggacagccttatgaacggtacctaggaatcacggatgtggagttggaggcagtgtgggagctgaggggaggcctgctgccatgcacccctgctggtcagagcagatgcctggccaggaggctgacacaccaccttcagatttggccgctgccaccatcacacctctgggtgtagtttgatccgagacagcagctttccagctgcgggaattcagtggcatgatgacagcatacacagggagacggcaaatgtgaaagcactggtcaactgtcgcacatgtaaatctaagtccatggcccacaaaaatcagctctgtgtcttgggtttgaataattgtgggaaaaatagtaataataataataacaataataaaaaaacttcttggttttctctctctccatgactttctagttcttttactcagctcaaaaactttcttagaaatacaggtgatgccatggaatactatgcagccataaaaaaggttgagttcatgtcctttgcagagacatggatgaagctggaaaccatcattttcagcaaactaacacaagaacagaaaaccaaacactgcatgttctcactcgtaagtgggagctgaacaatgagaactcatggacacgggggttgggggggggaatatcacacactggggcctgttggggggttgggggataggggagggacagcactaggagaactacctaatgtaggtgacaggttgatgggtgcagcaaaccaccatggcacgtgtatactgtgtaacaaatctgcatgttctgcacatgtaccccagaacttaaagtataataaaaaaagaagacatgaaaaaaaaccttttgtatttttagtgagcttatgcagctaataaattcatttaaaaaagaaatacaggcaacagcagtggctctccacatcagtgtgtgacagtcaccaggctttgtcacaatgcatcctggtgggccgcgcagagcctgggcctcagtggggttgggccgggcctgacaatctgcatttccagcacgtcccaggtgccactgctgctgtcattggggccacactttgaggaccctgggtctgtgacgcctagtcccttacctagaatttaattccacatcctctcttccctcccccacgtctgcaaaacgtggccttgaaggagttgtatcagcaagacgttagacaaggcagctcttccctgtctccccatggaaaaaccaagtaaatcatgggcttttccctttgctgattgtgccctttgatgctcaagacatttttaatgtgatgacgttcaatttctttctgccttttgtttcttgagcttttggtgtcacatccgagaaattcatttgccaaatccaatgtcatgacgcttcccctatgttttcttctaagaaggttttagctcttacatttagatctttgatccatgttgaattgatttttgtatatggtgtaatgtaagggtttaacgtcattcctttggatgtgaatatccaggtttcttagcactgtttcttgagaacactgtcctctctccactgaatggtctcggtacccttttcgaaaaggcaacccacagaatgggagaaaatacttgcaaatcatagatctgatacgaattggtttctagacaatattaaaaattcctactactgaacacacacacaaaacaaagaatctaattaaaaaataggcacaagacttgaacagacgtttctccaaagaaggtaaacaaacagccagtacgcacacggaaagaagctcaacgtcactaatcattagggaaatgcaaaccaaaactgcgagttaccgcctcatacccactggaatggctactgcaagggttagtgagaatgtgggaaaaaatggaacgctgtgcactgatggtgggaatgtaagatggtgcagctgctctagaaaatggtgtggctattttcagaaaattaaaaataaaattgccatatagtcaagcaattcttctagttatatagtgtattggtctgctctcatgctgctaataaagacatacttgagactgggtaatttataaaggaaagaggtttaatggactcacagttccacatggcttgggaggcctcacagtcatggcagaaggggaatgaggagcaaagtcacatcttacatggcggcaggtaggagagcgtgtgcaggggaactgccctttattaaaccatcagatctcgtgagatattttcactgtcatgagaacagcatgggaaagacccacccccatgattcagttacctcccactgggttgctcctatgacactgggaattgtgggagctacaattcaagatgagatttgggtgggaacacagagccaaaccatatcatagacccaacgaaattgaaagcagggacttgaagagaatttatacatccatattaatggcagcacaatttatgatgggcaaaatttggaagcatctatccattgacagatgaatgtgcaaagaaaatgtggaatatctactattcagctgaaaaaggaagaacattctgacacatgttacaacatggatgaaccctagggaccatctacaatggaaactaagccagtcacaaaaggacaaacaatgaacaatgtcacctgcatgaggtccctagagtcctcacacccacagagacaggaagcagagggtggttgctggggccggggagggtaacgggcttaatgtttcgtggagacagtttcagttctggaagatgaaactttctgtagacggatggtggtgattgctcacgactgtgtgaatgtacttagtgccaccgacctatacactcaaaagtggatcagagggtacattttgtgttatgtatattttaccataatttaaaaaaagaacagaaaaaagaagacccttgctgagctttacaagcaactcagtcttgtcttcaaatattcttcatgaattgagatggtgccaggttgctgtttaataccaacaagcgacagaggaaattctaaataagtttagtcacgttgtagaaatttgcttacgaaacacgagactggaatcaaactcctttagggcttttccccctcagtggaaagagtggataccttgtcactgaacaacgtgattttcccaggtacagtttatttacaggcaaagccacatcctgcttacacttatgaatagttggcagctggctttagtgaggatggattgcaggtgagaggaggaactttgttaaggaccagatgcttccctgttcttttgccaggtgcaaatcaagcgccacctggaagaaatgtaatcatttgaaatgtctttaaaaatagtcactctctgaatttaaaatgttaatttaaaacaattatgatgagcaaaataattaggaaatacagacttcctaagttagggagccaggctattcagactatgatgatattgaattacttatgtatcatggatgaagcagctagatctaaatgaacaaaaataaaaaaaaagagaaaacagaagattaaaaagattaaaaagaaaacaatttgatgtgtctttatggaaagttaagctctggccagagctaagttggaggtattgctgtttctttctctaaaaaagtttaatgtgttcgatccagttttttcatagcattagaaaaactctttttgggattgttacttttttaaaaattaatattcttactactactatatttgagggaactgagccatttacgattgtcaatttccaaatttcttcatggatacagattcatttctgattcattgaactgcaaacttattttttatagggaagaactgaccaaaagcaagcgatttttatatctagaaactattccccccttctgtctatttctcacctatcaccacacaaatacgtcttccatgaacgcaagcaaaataacaaataatattaaacaaaagggattcgtttttctttaatgtatgtcacttaaaggattgtactagttcagaacttggcgaactcatgcatagaagagtggttgaaaagtttcacttataatagcacattcagaatagatcatatggctataattatttgtatgcttttccaggcacattaactaagctaaactcaatacatcatttcatgcataattaaagatttaagatcaatgaaacttactctctttatctagtttcacctagggacccggcgagggaaaaagcttagaaaactttttagacgttatctactagtaagaacggaaaccactgtaattccttgtccctgtgttaaacaatactgggaccagcaaaaggatcttccctgatttctccaggaagtacctgcccgtgagagctaagcctaggaaccaaccaaccaagtcacttccttctcaacaccagcaacggctcctggaggctcctgcccggaagacgtctgctcttcctaccaacctaaagtttcctcattaactttgctccatacaagccagttcttggctctcatgcctcccgtccccggcccaaaacctatgaacaccccacactaattttctgctcttagctcttgccaggctgcaacccccacctctctccagggggtctcgtgaacccagctctgcctcagcaacgatcctgcaagggaccattttggggacttgaaggttgatggaattaatcatcaaggtgtgctcgagacgcgcggggcgtggtaaaaagggtcactagtggccctttcttgccctttccccttaaacatatttctcttttactttgggtaaaataaatagttgagacttctgtaagaaaataggatcttctgactgcccgagaaagatcaatttgtgtttttcttttgagacagagtctcgcactgttgctggggctggagcgcaatggcacgatcttggctcactgcagcctccccatcccaggttcaagcgattctcctgcctcaacctcccgagtagctgagattacaggcaagcgccaccacgcctggctaattttttgtatttttagtagagacgggggtttcaccatctctgcccgcctcggcctcccaaagtgctgggattacaggtgtgaaccactgtgctggcagaaagatcaatttcttttcttggaaagagatgacatggcacaatctcctgggacaggttttcatcctaaatgatacattttgcctgaacaaaataaaaccactcaaaactacaaaggaaatcttcagagaataattttctggacaactggaataagaaataaatttagacataaggctcagcttgctgcagaggagtggtgagcatgagggctggccagggcgctggacacgaccattgagacacaccagtgtccacctctaaccctgattccaggagggttccgagttcgctgggacaagccatcctcactttaaggtgccttctcatctcagggtctttgtcttctgatgctcctggggccaggcttctcccagctgtgggtggaaggtgcaccccattaacccacacacataaaagcgtattgctgcagcttaggagtctctgctatgactcgggaaataaaatggaatcttgggaccccacactcactctgccaaaaagaaagttacgcttcagagctgagccacgcaatactgctttccttttgttcctggacacagagctacaattccacagcctcatctctaagccaggttcccacagtgacagaaggccacatagctccctgatggcctccctcacaaactgctcacaacgaaattcctggtgaactcctaaatccctcagcctttcaggatagatatccccctgtttctagccctaagactgagttctgtggaatctcaccctgacaatgtcaatgaccagctcgtcttcataggtagagggcaaagactggaacaaaaatcatccctccacccaacccgaggcgaatgcatcattggccttttcctgcaccccttctctttgcacgtaaaatgtagattcacatcaaagcctccaagaacgtaaccatttgcctcattgcttaccctccctcctttctctcctgctctttcccctttaaatatcgaagttccccaaacgctctttagaaaagtcgcaggtgatggacactcatgtgacttttggttcttttcccagacgcatcgtcacactcaggccaaacaaacctctctcaatggaggtgtcactgtggtgaaccctctctaggcacgtgtccatctgtctgaacctctggaggtctccgcaggaagaacagcgtgcacccacatttaaatttcttgcgaatacttcccatctgcaaaataggatcttctgaagcttgcagttgctgtcaatctcctggccctaatgagctgccaggagaagaaggaaaggtcccacttgagagtgaaaacttggggtctcacagcttctctttctctgatgaaacaattgaggcttttctatgaaattaagcttctttgcattttaatatatattataagttttattgatcactaaaaacaatgaaaaaaagaaagtcaagaagccctgctcaagaactgacaatgcccctcttagccctatcctgggagaggctcacctatgcagagggaggccccgcagaccccttcttccttctccacttgggggtccaccgctatggcttccacggtgccctctggtctggcctctttgcttttacatttttctgcctgcccctcactccaggagctaaaaatcaattagttcttaaataacgagggcggtagccacctacatgaacctcatggggaaggcttctgtaaaatgaagacccatccagcagcgaacgtagttttttcctcatgtgtacatttctaagtttaacactagatttgctacaagtgtgacggaacaaacactcgacggaacaaacactcaaagaacaaacatatttaaaaaggtacttttcaaaagaagacacttatgcaggcaacaatcatatgaaaaaaagctcaacatcactgatcattagagaaatgcaaataaaaactgtaatgaggtaccatctcacacaagtcagaatggctattattaaaaagtcaaaaaataacagatgctggtgaggttgtggagaaaaaggaacatttaaacactgtgggtgggagtgcaaattagctcaaccattgtggaaagcagtgtggtaattcctcaaagaaccatttgacccagcaatctcattattaattatatacccaaaggagtataaatcatctatcataaagacgtacgcacgtgtatgttcactgcagcactactcacaatagcaagacatggaatcaacataaatgtccatcaacgacagactggatacggaacatgtggtacatatacaccatggcgtactatgcagccctaaacaaaactgagatcatgtcctttgctgggacatggatggagctggagccattctccttagcaaattaacatggggtcagaaaaccaaacacctcatgttctcacaagtgagagctaaatggtgaggacacaagggccaggcgcagtggcttgtgcctgtaatctcagcattttgggaggccaagggggggtggatcacctgaggtcaggagtttgagaccagcccggccaacatggccaaaccccgtctctactaaaaatacaaaattagctgggcgtgtggcacatgcctgtaatcccaggtactcgggagggtgaggcaggagaatgacttgaatccaggaggctgagtttgcactgagccggattgggccattacactccagcctgggtgacaagattgaaactctgtctcaaaaaaaaagaatgatgaagccacatggactcagagaggggaacaacacacactggggttgttggagggtggaggcgggaggagggagaggatcaggaaaaataacgaatgtgcatgaggcttaacacctggctgacataatctgtgcagcaaacctgcctgtgacctgagtttacctgcgttacgaacctgcctgtgacctgagtttacctgtgtagcaaacctgcctgtgacctgagtttacctgcgtaacaaacctgcctgtgacctgagtttacctgtgtagcaaacctgcctgtgacctgagtttacctgcgtaacgaacctgcctgtgacctgagtttacctgcgttacgaacctgcctgtgacctgagtttacctgtgtaacgaacctgcctgtgacctgagtttacctgtgtaacaaacctgcctgtgacctgaatttacctgcgtaacgaacctgcctgtgacctgagtttacctgcgtaacaaacctgcctgtgacctgagtttacctgtgtaacgaacctgcctgtgacctgagtttacctgcataacaaacctgcctgtgacctgagtttacctgtgtaacgaacctgcctgtgacctgagtttacctgtgtaacaaacctgcctgtgacctgaatttacctgcgtaacaaacctgcctgtgacctgagtttacctgcgtaacgaacctgcctgtgacctgagtttacctgcgttacgaacctgcctgtgacctgagtttacctgcgtaacgaacctgcctgtgacctgagtttacctgcgtaacgaacctgcctgtgacctgagtttacctgcgttacgaacctgcctgtgacctgagtttacctgcgtagcaaacctgcctgtgacctgagtttacctgtgtaacgaacctgcctgtgacctgagtttacctgtgtaacaaacctgcctgtgacctgaatttacctgtgtagcaaacctgcctgtgacctgagtttacctgcgtaacaaacctgcctgtgacctgagtttacctgtgtagcaaacctgtctgtgacctgagtttacctgtgtagcaaacctgcctgtgacctgagtttacctgtgtaacgaacctgcctgtgacctgagtttacctgcgttacgaacctgcctgtgacctgagtttacctgcgtaacaaacctgcacatggacccctgaacttaaaagttaaaaaaaacaattttatgtgcaataccgtgacaggttttgtggctaaatttaaatgttaatttggacattatatattctgttgtttttgattgtctactcagatgagaaaagtagtcaacgcaatcaacttccttaaaatcagtatctgctgcacgccagggacagcaacagaagaaatcatttcagcaacaacgtgacacttcgaacctccagaagaagtgccatatcaatgacatcatgacaaacgccccagaccgaattatttctgtgtcagagtcactcattatggctctggctcttgcaggtcatctcccatttaggagaacttgtcctattgtcttcatcagaacacgtgtacttgtcaggcctgcagtcctgatgtttggttcagaaaatatggtcactgtaattatagcccttcccgggtgaggaaatgagaatctgactcgtaatccttttatcattgacttggatgacttatttctcaccaaatgagaatggagaaatttcaagggcaatttatctaattctttccctgtgcatatatatttttttttttaaagaaatttgccctggtcagaaaaagcacattttccagagggattctttaatgatattgatctcttgtgcattacctggcctctggtagaccttacatgattgtcccaattaagctgccaggtgagtttcttaatcttttttttttcctttttttcttgaagcatcacagatgattttaaagttgtttttaggccaggtgcagtggttcatgcctgaaatcccagcactttgggaggccgaggcgggcacatcacctgagaccaggagtttaagaccatcctggccaacatggtgaaacaccctctctactaaaaatatgaaaaaattagccaggcgtggtggcatgcacctgtgatttcagctaccggggaggctgaggcaggagaatcgcttgaactggggaggcggaggttgcaatgagctgagatcacaccactgcactccagcctgggcaacagagtgagactccatctcaaaaaaatattttagttgttaattattaaaagttgttttaataattactttgccatcaggttctattttcccaagcaaaatgctcacggtgtgtgttcagcttctctgcccctcttggcaggatatagccattccccgctcagccctgcccacttcccaccacccccaggccccctgagcacccagcagcaaccctcagccagagcctgcctcggccacagctcagggctctgccagctccactgttgaagcccttatgtcacctgtgtgtgtgttctcttggccaagtgtccccagcaagccctttagtgaaagagagcttcaaggggagaggcaaaatagtggcaaaaagcaaattattacagcctgtgacaaaaggtactccacacaagcctctacctgccgccagggctgcgtcctaaccaaagacagccaggcaatgatggtgactttcagaatgggatgaggctgggggcttgagagttgcccagttagggcgtgtgcatgagtgtagtgtgcctgtatgtgcctgtgtgtatgtacatgagtgtatgtgcctgtgtgtatgtgcctgtgtgtatgtacatgagtgtatgtgcatgtgtgtatgtgcctgtgtgtatgtacatgagtgtatgtgcctgtgtgtatgtacatgagtgtatgtgcctgtgtgtatgtgtgcatgtgtgtgtgcctgtgtgtatgtgcatgactgtatgtgcatgtgtgtatgtgcctgtgtgtatgtatgcatgtgtgtgcatgtgtttatgtgtgcacgtgtgtgcatgtgtatgtacatgtgtgtgtctgtgtgtagtgtgcatgtgtgtatgtacatgtgtgtatgcatgtgtatgtgaatgtatgtgcatgagtgtaggcataggcatttatataccattgtgaaggagataactgataaatagaaatgttatttaaaacaagaaacagcctcaaaacacgtcctccactccggatgcagtagggaaagtacgtttctggggttgggtggggtgggacgcagctggtggggcaggtgggatgtgtgtccatttagggatgcctaagtgagcggagcatagtaaccagggtcatggtgggtttgtgggccattgagaaggacgtgctctccacgtgatgagtgggattgggggctgcagcgggggcacaggaagtcagcccacggtgcctgggtggtgtgtgggggcagatgcctgtggtgttcagcagtgtttcctctctggggcgttcacagcatttggtggaggccgctattccagcacttgtcacacagaatccctgcgtgtggccctcgctgatgaagctgcctcccgccctcctgtgtccctggtccctgctcagaaacctccgtgtgtcgttggcaaagaggagcgtgtcctggtccatgatgcagatgcagacacgggtagaagaggcagcaggtttgatgccgtcagcttttccgctaaagtggttaacccgggcttaagaagcgcgcgtattcatctcagaatgagagtctatttacgtctcataaataaaataccttcattttttctagtgtgtacaacaaacaaaagctctattttatttttcataatagacccagacatgattctgtctcaacttgtgctactgaaaggatttctggcacaagcgtagcttaagattcaacttaaatagtttgggccttactaagaacttgtgctctttgaaatgcactaagaatgaaaagagaagccacagacagggagaaaatatttgcaaatcacacagccaatgctggaccagtatccagaatagggaaagcactctcaaaattcaaaattaagaggataaataacccaacaaaaaatggtaaagggatttgagcagacactttgccgaagaagacatatgagagacagaagaacacaaaggacagccagcaccatcagtcattaggaaagcgcaaacgcaaacccccataagacgcctggacacacctgcgagagtggctgcaataaaacaaccacagagaagctgatgacagtgaatgctgacaaggatgtggaggggccaggaccgccacacacatgcgctgggggcagtcacagcgggcagtgtgccggagaagagggtggacacacactcccccacacacgcgcggggggcagtcacagcgggcagtgcgccggagaagagggtggacacacactcccccacacacgcgctggggacagtcacagcgggcagtgcgccggagaagagggtggacacacactcccccacacacgcgctggggacagtcacagcaggcagcgcgccggagaagagggtggacacacactcccccacacacgcgcgggggccagtcacagcgggcagcgtgctggagaagagggtggacacacactcccccacacacgcgcgggggccagtcacagcgggcagtgcaccggagaagagggtggacacacactcccccacacacgtgctgggggcagtcacagcaggcagcgcgccggagaagagggtggacacacactcccccacacacgcgctgggggcagtcacagcgggcagtgcactggagaagagggtggacacacactcccccacacacgcgctgggggcagtcacagcgggcagcacgctggagaagagggtggacacacactcccccacacacgcgctgggggcagtcacagcgggcagtgcactggagaagagggtggacacacactcccccacacacgcgctgggggcagtcacagcgggcagcgtgctggagaagagggtggacacacactcccccacacacgcactgggggcagtcacagcgggcagtgcactggagaagagggtggacacacactcggcggaggccccggtgacaccagcctcagtcacctcccgcagggtgaggacgctcacaccccctccaagacccacacgggactgcccacagtggcttggttcatcgtcaccctgaactggaaacagtgacatgttttcctatcaggagaatggaggagttaacacggctcctccctgggatgaaacacgacccagccatgcccaggaaggagctgccgacagtgaaactcaagacacgtcctgctcggtgacaggcacgggctcaggcgactgaggacggctccgtttatgtgtccttctcaaaatggcaaagttacagggtcgggaggtgaagccatggtctgtagaggctggggtgggaacaggaatgggccacagagggtgcgagagggttccaggtggtggacctattttacatttgatggtgcttttcagccatgtgtgcttgtcaaaacccagcaccgtgcaccaaaggactgaattttcctgtgtgttaacgatacctcagtgaaacctcagccaaggtgaaggaagcagccagggcttctcttagttggaaaacatcgaaggagtgcttgcagctgcctgcccctccgaggcaccagggggtcggggacgtcactgtgtccttggggaccgtgacgaccgcagtgccgacacagtgagccccagaatcgccctgtagaccagctcactcaagcaaagctgcctctggcagggcaattcccctgtagagagtgtgccttttgactttacctgtcctcagactgacctttgctcatgagaatagtgaaaaacgcaacttgggtggaggtttaagatgctaatgaggcacgtgatgtatggacaagcatggacagctactgcatgtgcacccagagggccacccagaatgtgcgtaccagcaacacctctcccacccccgcccgaagagtggtgtggggcccccagagctagagcctccctcgggcggtcctggctgactcactctccatcagccgcgctgactcgtctttcagagtgtacttttgcttttgcatttagtttgcagagggttctttctctgttgcaataaactgctttctacttctgtgtgtctctttaaattcttaactgctttctactgctgtgtgtctctttaaattcttttaaactaagaagacaagaaccgaaggctctcagttgccatcaacaatgggagcagctaaacacgacccaggcaagacctcccgtccatcgggttaaacccgtagtccactgctgactccacaactctgcccttgttcttacaccaaagctccctgcagagagcccatgggtgacatgaagctggcctcggacaccacatcttctggcttccctggcctctggccctgttgtttcctggaccttggccacggctgaagttcaggctcctcgtgataacaggctgctgatggcttctgatgaatgaaaacccgggcaaagacggtgcttctcctccctcctggccccttgcatgttagggaaatttgagtagcacaaagagagatggtctccctgagggtcttcacaaggccccatccaagtatctccaggatgtgggcagctctctgagcacacggaggtccttgcgacggccgcacacatggtgggggatgaaaaacgtttctttctctgggaatcctggggtgggaacctcacctagtggctaggcggacacacagcacagggtggattcaggcccgcctcaccctatgagagaggaggggcccctctcaggaacactggaggtggttgattgcgaccaaaggctctgccgtggggactaattcccacccttggaattcagtagacttttctgttgttggatccccagaaagccccaaatcaagtttgaatttctctatggaagactgtggcacctggaaccacagagcacgttccccgtgacatgggatgtgacactgcttatcagaagccgcctgggtcttcgggacagagtctactttaatgtaaactggaacccagggaaggtaaactgagacacagccctgcgtgttgacttcagggtggttggagagttctatggagaggaaggaacgtggtgagtggtggagacaggattcagggcgccattctgaaggaccggccttcagcaggggactccgtattctggtttccggtctatttacagcatctctctctctctctctcgctttctctcccctttcctgccacactttgatccattctcgtaaagcaggagagagactccttggtttatagccactgtctaaacattgcgatgctttctatgtgagcatggcagtcactctgtttctatctttaatactgtaactgctcatcggtttagctcttctctaccaattggagaaatgcacaagattcagggagatcatttgtgagaaaaggcatcgctgttcttcaagcccccatcttcaaagcaaacatctctctggcagaacccaagaaaaattccagttgggttttcaagagctaattaagccactgcacggcttcatgcgaaacccttctccctccccatctccttctcagtttcttcaagattaggctgaggttggaaagcaaacccgaaagcatctccaaccgcgttatttctgggctgtgttgatgcatgaagccacatctggctcaggatggagactcagggtctgggcaagttgacaaatccaaaggcacctgctgtcgagcgaggactgaagccaccgctgacactgtgcccagcaaaaccagcacacacggactattaactggtcgactttgctcctgggggcgtggaaggcagaatcaaagtgaataatgtaagcattccccaggcagggccggcacaccctgctctgggaaaataaaaataaatgttgatgctggtggattgtaaaatcccctaccacttccgttattccatcctgtgcttttgagtcgaacacattaagctcaccaggggagactggctctgacatagcgctgtgtccctcttcctgaaacgaaagccgtctgtctgacgaggacattgaggacccgtaatttactacctctgctacaattctaaatgctcccccaccgcagggattgaaacgttcttcctataattatagtggaatcaaaagtctagccggctaatgcgtggagcttctgtgccagctatttataataggggcttctcagccaatatgttgtttttaatatgtcatctatatgacattgtcaggatcaacctgtccttattttctgtgtttctcccctaaaataatattattacttaaacatataaatatttgtgagactaaaaagaaaaagaaaaatacctgaaaatgtaaaacccagccaagcccggttgcctcttggttggccatggaaggattctttgggagggaggcccagggtggggtgttgctggctgcctgaggccaagggggctctctgggaaagcagtctccacactctgggcctgttagtccgggtccctgatgagaatggccttctctctttgggaaacactcctgctccctggtagtgtggcgtcaacggggagatgctacctagtgtggcccaagatgcgcttttgtccaactcatcccactcacagatccggctgtggtgcagcttcgtggctatctcacaggtcacagtgttattctggcatcggaatcccccagcgctgctatccaaattctctccaacagagaaggcggcaggcagtggctggtgctggagaagcctctaggtctgccaaagtctggttttggcagtcggggctgggggctcccccagcaagcagcagcgctgtccaacccattctggtccaaggacaagtggtgccttccttcttctgactcagacccccggctacctttccctttcgcctgcggaagcgacggggcgtgcatggcaaagctgccacggaacaggtgtggaggtgatggtgagtggcaaacctccgtgcccaagtgggacacagcttgtactttcttgaattgttgaatttgaaagcttgaagaagcctgcaggatccacaccaacacttttgttattttgcacatgagaacactgcagcttagaacgtcggggtgtcttgcccaagtggccccgctgggctgatggggtcccctgattgctaccacgtgttctttccaacacagcaacgctttctcgctacccagtctgttcagattgccctctaggaattggaaacggcccccagatgcatccatttcttctctttctgcataaagtgctgatcacagacactgaaagagtcgtttctattagagatgggaacgttggactgggtttaatgtggatgtttctacagcagaactaacagagcagcacctccccagtgccccctgcaaagcaccgcggtctgcgcacggctccgggaggtcacggccttccctttattggcaaacacaaagctggcagatgatacttaggagtcacatctctaagtccaccgtctttattctcttccctatttggatttctttttcagtattctgatcttagaatttgtactgaaaaagtgaaaaaaaattgaaaaccgttggattctccagatttcactggagctgatgataattatcacattcttaataccaaacttttacacttttacacaagttcttgagaagtcccaaattatgaaaacctctagaatagattggtgggagaataattgtctcaaccatccagaaatcagtttattgaattggttgatttgatgttagttgtcgtaattgatgactggtgccttctgaggagagaacaaaaaagaaaacagtgctttatcctcaaggcacctgtgggctaagaggagccagtaacacctggagctgtgatactagaaaaaggtaacatgagaggaatctgtaaagtgctatgaaaatccacaaaaggatgacaactgctagagagatggtaaaagggctccatggcaggtgcattgcacaggggaagtggatttcaaaatcatagaatgaatccaaccagatggaaaaaacaatcaggtcttggagacaagaataaacagggctctcctagggaatgatgggagttcagtttggatgaagcaaagtgtcattccagggggcatgaggccggcgtgcctgggagcccgggtaggctggactttgtcaagggaacaacagagaactggagactcccggccctggagcgaccttccaaggtcatccagcctgaccctctcccagggtcatctgacctgaccctctcccagctgcgtccatcccgtctcacaccttcctagccatggtcctgggcaaatgattcccctagccacttacacacccatttctgctcagctgtagcaaaatcagtcagattaaaaaataagttttcaatacaagtgccttcgaggtcatgatgtgcttatgtactttatcaaaatgtgtatcacctactcctagtccaactgcagtacacacgtctttccatatccacgcacagcatatccttcgctaagatgctgctgatgcaaatacacatcactctgcactgtaggccctgtggggctaacaatggcatcccacgaaatcgctgaaaatgtcaaattaacagaactttatacttagcaaaatgaaaattggcaactcaaaaccatgactaactcaaaataacaagggctcttcccctgactgcaggaattctgggagccctttcacagccagaacttactgtaaatgcataatttcagtctttattaactcaagaacaccaatttttagcaaattttatgactcatgtagtgtaacgtgtaaatgatcattagatgtaaaaatagataaaaatctatggcatcaatttcctgtaagaaccagagaaaagagaacctataaaaacacctcctggccaggggcggtggctcacgcctataatcccagcactttgggaggctaatcccagcactttgggaggctgaggcgggtggatcacaaagtcaggagatcgagaccatcctggctaacacggtgaaaccccgtctctactaaaaatacaaaaattagccgggcatggtggcaggtgcctgtagtctcagctattcgggaggctgaggcaggagaatggcgtgaacccgggaggcggagcttgcagtgagccaagatggcgccactgcactccagcctgggcaacagagtgagactccgtctaaaaaaaacaaaaacaaacccaaaaaacacctcccatttcttaacagcctggcaacctactggaatgatcccacaggggtggttttttcaacctcaaaagaatggaaactcacgattccacaaaggatttcattccgcagaacactccagagaggttttcttctgttagtaccagcattctccttgtaaaaccttcccaccgttctccttctgaagctccacagagcaagtagaactctgtctccgtgtgtccactatgggacggcagctaattgcccttcttcagttttatttggtggggggccgggagtaaaactaagagcagacctttgtacaatttttttttttttgagatggagtttcgctcttgttgcccaggctggagtgcaatggcgaggtctcggcttaccgcaacctctgcctcccaggttcaagcgcttctcctgcctcagccttgtgggtggctgggattacaggcatacgccaccatgcctggctaatttttttgtatttttagtaaagacagtgtttctccatgttggtcaggctggtcttgaactcctgacctcaggtgatcctcccgccttggcctcccaaagtgctgggattataggcatgagccaccatgcctggcctgtataatttcttgttaaactttatgttgcttagttgcttatattattgtaatttggtgaaatacttttgcatcctaattctgatatttgctactttatgtgtgcttcccaggtccctgtgccttcacgaatttatggccgtgtacacatgttagacattgaataacacaggaccaaggagagaaccttgtctcaccctccacatcccccttcctatgaacagcggtctctgggtaccgtcatttgaccaaaaaagtactttaatttttggttgtggtcatttaactacttacacatcaagtttatttatgctataattcaatccacactataccatcttgccctcagaggagaccctaaagtctaagagttcaacaagcacattgagcctctactgagtgccagtgagacggctgagatgagagggacgtggcacccacacgagaagggcttgtcttgctgcttctttacagcaaactcatgttgatgctaagcacaatggccgtgtgtagggtctcaggaggaggtgctatggctgtggcatcacccagggaatacttttctccagctgaccatgcatgaggggcaagggtggccacaggaggaactgcccaagcagagaccaagggccatgcggctcaggggtcagccaggtgtgacgagctctgtgccataggggcgagggccacgcggctcaggggtcagccaggtgtgaggaggtctgggccataggggcgagtgccatgcggctcggggttcagccaggtgtgacgagctctggaccgtgggggtgtacccaagtggacaccgggccaggagagtcttcctcaccatgctggggacttggaggtatgctgggagaaggaccagttagaggagagaaatgtcatgccttcaagaaagatggtggccatggcccagcagcctcctggtctcacaatctagaaacatctgaaaaggaaatcggtccggcacaacctcttgatcgctctgtgcaatcactttttgcctgtgttaagtattaataagtgatttattgagtaattttagcgatgggagggccctgcctggggatctgcagggtgggggcagggccacgctcctcacactgacttgaggaggcatgaacagggcaggagagggctcccacacacagcaggagtgtcgggtgccatcaggtggctgtcaggcagccgtcacactgtctctctacggtaatagttggtcacagccggcaccaggaaaaagcatctcccaatagatagaaatgcttgggactggtgatcagcagcttcccgataggatctcaggaactgggctagtgggctcaggcgtgcacatgtggacagcccactccaagcgaagaatcatgggggaaggaacgtggggccctggaagcatgacaatggataaaaccccaagtcacaggtcaaaccacgcacccgtcctttggaagaggcttgggcctcttccaaatatactttccttcccctcatttctgctctgaagattttaaataaactctcactcctgctctaaaacttgcctcggtctcttcttctgccttatgcccctcaggcgaattctttcttctgaggaggcaagaattgaggttgcctgccacagaccctaatggatacaaatttgctgctgggatgattggatatattttgttgttgttgttgttgttttgttttgtttttttttcctgacagggcctcactctgttgctcgggctggagtgcagtggtgtgatgtctcactgaaaccttcacttcccgggctcaagggattctcctgcctcagcctcctgagaagctgggactacagacgtgccaccacccttggctaattgttttggtattttttgtagagatgggggtctcaccatgttacctaggctgctcttgaattcctgggctcaagctatccacctgccttggcctcccaaagtgttgggattacaggcatgagctactgcacctggcctcggatctgcattttaaagagtcactctgtccccagagccacagctgtctatagaggtctatagacattagggaaatttattggactcatggactggaaatctgggataaggagagaagggtttttgggcaatttgggtggcttctggggtgttcaccaggatggaaagtgtaagaagagaacaaacctttgtggtggggacaggtgtcaagttccaccctagagctgaagcgtggccgattacggaggagcccttggcaggggaccgggtagtttctagtgcaggagatgtgcctttccttgctgagcccccggatcacgggggagcccttgacagggggctgggtagtttctagtgcaggagacatgcctttccttgctgagcccccatcccactgagcacctgctcttcggttgctggcatcctctccactttgtgtgaatgtctcaggcttgattcctgcatggccttcgcgtgtatctcacagtacacgtcacatctgtaaattaaaaggcatcttctccatggacaccctgctccttcctcctgagctcccagcatccttgtgtaaattccagggaaatcgagggtaaaactcgttcccggccctctgggacggcatggccctggggagggtgagaggacaccagctgcagtttggggatgagcttccatgatggaaatgtctgggacacacggagctcagagcaggggcagcccggtctacattgggggtcagtgggtcttcagaaagactgatggacacacaggcctcttctgcgggctaggaggagggggatgcatcccaggaggctggtggcacccaagcaggactgtgaactgagtgacacagccggagcggacgggcaaggcgatgctgtgtccacacacgcaaacatgacccaggccacctccgtgtcccaagcacctgggagaggctctcagcctccatttgctgagtgagactgtccgcccaccaggaggcagacccagttcacctgcacccaggatacaggggagagaatgcgtgggaatggatgagccccaggcagcgggtgggtcgactgggtggggcatccaagccttggggagatgagatttacgtgtgcaaagtcgggatggaaacgcctgtgtaagagtgctgagcaggactccgggaggaggcggcttcagaaaggcaaggatgctcgcaggactgcgtgtcacggggggtcacgcaccacacggctggaccgagcccggggcctcagtgaccgaggcggcggctgccggtcgtcctggagggagagctgcctgtgaatctattgcacagtgggtgggaccctggtctaatggtgccacgcccacggggacccccacgggccgctgctacagagcagcgggtgccagcaggtcaggcgctcaggaagaggtgaagagaaatcaacgcggcgtcgtcaagctcagtcagcaggaggacccccggggagggtccggcactcaggagcccccccggggcaggaggggcctcttcctcccagactgaagccagaggcaggtctcccgctgctgctctaggggcttaggtggttttgaataactactgtggagaaaggaaacttgaccgcaggctgggtttgacagtgtatctgcgcaccttttccccttgggcttcctggttggtttagtgatgagtctgtttcaggtgctgtgacgggaaggcaggggccttcactctcttgctttctgtccctgagcagcacattacccatcccgggccccagcggcctcctctgtggggaggggacagcaggggaggggcctggagtctccagagtcgtgctgtgcggacagggaaatccttgaaataccctcaggattgccccagatgaatttgaaaattggaagagaaggagacacacgtcaggaagacaaacaaaagatgtgacaccttgttttttcacctggcacattctggcatattttttaaagttcagccatttgagccagaccttattatgagaattctatgaacgcttgatgtgtgatggatattttgcataaatttggatggaactgaagtttgaagagagatagggctgcccaatggaaagaaaatgtggaaatcaattaccctttgcatggagccttatctcaggatgcaaaggccaccggcaatgaggagggaaatgcccccacaactggaggtaattgtgtgaattttctaggccacagaggatggtttcttcactacaaaacacgaacatttttgtttcaccgagtctagatggcagtcttttgtcttggagacagttaagtgttactgtgagaaaattctcagctgctttgaaaacagtgaaaactctttgcatttttaacaaaagaaatgcattttgaaggtgggaaattgtcactagtgattaaagagaaagctctgcagaagtaaaacatcctttgaaggggtgagagaaggagaaggagagaaaaaaggaagagagagagacagaaaaagagagtgggagggagagagaggcagagagagaaagggagagatgagggctgcaggaaggagcctggagtggagccaggggggcctgcctcaggtgggggccagtgtggaggtcgaggtccagcccagggtgcccaactgcaggtctctggcaagggcccttggcagggagaagccccaggccctgcagggcagagctgggctgagtgggaagaaggccacacctggggctcaggtggttgctttcagtgtcctgcgtggtgactgtgctcgtaaaagtccagttcttgggggataaattccaggctcctgaagacgcctgggctgcctgattgacagcccagaagctgaggcctgaacgcatctgccaggtggttattgctctgcttccatggaaacgcacacaggacgggggagctgaggtgaggttttaaagacagccttctttttataacttccctaccttatcctcttccatctgaccgccgtttccatggcaaccagatcagaaaggccatcggcctcacgaactctgatttgcacggtggatttgccaagtgccaggcaccgccatgcatccagggaggcagaggcgtccccgtgcatccaagtcacccgaggccagctggatggaaagggccaggaggttgcaggtgccacggccctctggggtgtggagggaactctaatttctgaacccagcctgggtgccacaagtgagggtggccgcatgatattcacatgctcgggaacactcctggcccacagggacttcctttcttaacaatcagagacacaagtgctgggctgcccacgggttccggatgctgaccttgtggcaaatcatgatgactctccccagatccccacctggcctacgatccaacccctagagcaccttcacagccacgcaagggcaccctcccactgcgcagcactgcctctcactcatggctgtgaaacttgggttgcccgatcctgcaaacgctggctttctcctctgacccatggctaacaccacttccttacaggagaagtgactgcactgatcagaagtgtggagtcctgataagattagtaagtaacgttgaggaaggcgctacaggtcggggagaacagttgttctgagagacggccaatcacaggcaactgctggcatgacatgctgttcccaaatacctcactccacaagtagccccagcagcatgaccttatctgcccatggccccctccagcatgaccctatacagcttccttccagccctgcttctttgcagacggccccttttctgctgtgctgcccattgctttcttgcaacgtatcttcgtgctttctctaataaatctgccttctttacccacgactgtcttggtaaattcttttaccacccgtgacaccagccccagccattgcacccacaacaacacggtgatgtgccagaagcaatgaaaagccatccatacatagataaaaatatggggaccaacatgaagcgtcagcctgtgcgcctctttccagacgataggcggggtgcttaattttcagagaatgccttcgtgactatttcccttagacataaatagagaccacagccacgtgttatttcatgctatgtttaaatctaacttgggacttctgtgggccacacatgtctttaacaatcctgtggcgggcaggtgcctccccagaacgcttctcacaggtgcactgggaggttccctcctgccctgacatgcatcccagggaagagcccctctgctggaggactaagagggtccatgtgggatcctgtgatgcccaggtaaactgtcccactgtgtgcctgtgcttgggttctctccctgtgaaaaacccgactgcagcaaacctccccgagcctttactgagctgtgagtgaggatctgggcctgcaaagccaaaggagacgccagtgctgccctaacaggcagagactccagtcatgggagctctgctgggcctttctagtcctagaacagtgtgcagtgtcttaggaagtacatagcattcaggcgtgatgttattctctttcatgtctcagtaaaactctgagctgcacagatgtgatggaagccctgggaacagcgtcacggacatcagagggggtgggtcttctgtgtctcaacctggcgttggcacacggcatggaggtttccatggctggatataagtagagtcatgagaatgcctctgtcatctgctctacacttccttagtatctccgtttaagtaacttagtaccctgggtccaactcttaaatttgttggggaaaatgtcctaaatctagacacagacattgttgtttgaaagagttcagcttctcaaaatgatgatgagcaccgtcactaactgctgaccatcaggagaatgtcaaaataaggaccctcagacgggagagcaccaaaacaaggaccctcagatgggagtgcgccaaaacaaggaccctcggacgggagagcaccaaaacaaggaccctcggacgggagagcaccaaaacaaggaccctcggacgggagagcgccaaaacaaggaccctcggacgggagagcgccaaaacaaggaccctcggatgggagagcgccaaaataaggacccttggacgggagagcaccaaaataaggaccttcggacgggagagcaccaaaataaggaccctccgacaggagtgccaaaataaggaccctcagatgggagagtgccaaaatgggaaccctcaggtgggagagaaccaagatggggacccttggaggaggaggggcctgcaaacagatgggtcttcaccaacgaatccaatagctggtagcaccctcccaaaaggtaagccagcagtctatggcataacagccaagaggggagtggggctgcagctgtcttgggcaggggcagcataggttgtgtatgtgtggccgcatctcagcctctcagctacagggtgacctctctgggtcaaccaggatcccagttagtagctgcagtacagagtccaattcttaaggcaggagttaggctgaaggctgggactccattcagagggactgtttggagtgaggaccgggggtacagaccagaacccaggcaaggcagcagccacgtggagcaggaagaagccctgatgtgtgacaggtttgctggggcccaggcagtagcagatcacccatgacacgtgaatgacaagttagggatagcagattcctttcagaccctcggcctcacacggcgggtttgtgtggcttcagggcccggacagcagaggctgggagatggagttttggtagagcagcttggagtagagtaggtaggatctcacagcctagcttttgattgaaaacctgtttctgagaggaacccaggacagcctgctgaggaaagcaggaaatccagagtcgggttctgcctcctaaaccatgggtggcatttgggcgtatggagggcagagccctatagggaggggagaggctgaagaggggtggcggctccaacatgtaactggtttccaccaataacaccaggccggaggtcaatttacttagttatttgagggattcattttactattgatttatgttgatcaaagctgagaacaatgatttacagggaagtgtatttgaaggacacacacttcattcatttgtcaagagaaggtttagcttctctcaatatcaagacaaaacatcgaaggactccgtgcttaagccaggttctttggggccctccatagacgtgctttactccatagacgtgctttactccattgcattttggattatgcacccaaatgacacacagaagagatggaaggagctgtctttaaaaactcaacaaactggaaatagaaataaatgctctcaatatgataaaaaccatatacaaaacaaaaaaaaacctacagcgaaaattgtactcaatggtaaaagacagaaagcttttcctctagaacaggacaaagagaaagatactttaccacttttatttaatacagtattggaaattttggccagagcaattaggcaagatgaaagaagtaaaaggcatcctacttggaaaaaaagaattaaaattatctgtttgcaggtgacctgatatcatatgtagaaaaactaaaagcattgttagaactaataaatgaattcaacaaagttgcagaatataaaatcaacacttaaaattagttgcatttctatgtacaaacaatgatcaatctgaaaaggaaattaagaaaaagttctggccgggcgtggtggctcacgcctgtaatcccagcactttgggaggccaaggcgggcgggtcactaggtcaggagattgagaccatcctggctaacatggtgaaaccccatctctactaaaaatacaaaaaattagctggccgtggtggctggcacctgtagtccccgctactcaggaggctgaggtaggagaatggtgtgaacctgggaggcggagcttgcagtgagctgagattgtgcccctgcactccaacctgggtgaaagagtgagtgagactctgtttcaaaaaaaaaaaagttccatttatggtctcatctaaaagaataaaatacttagggataaacttaaccaagaaggtaaaagccttggatactgaaaactacaaaacattgttgaaagaaataaaagacataaataaatggaaagacatcttatgattggaaggcttaatattattaagtggataacactacccagtgtaatccacagattcaatgtaatctctatcaacatcccaaggactttttttcagaaatagaaaaacccatcctaaaattcatggaatctcgaagggccttgaatggtcaaaataatctttaagaaaaggagaacaaagttggagaatcctgacttcacttcctgacttcaaaacgtactacaaagctacaaatcaaaacagagtggtgttagcataccacacacagaccaatgaaagagaacagagggctcagaaataaacctttgcatatgtagtcaaatgaattttgacaaaggtgctgcaactagtcaatgcagaaaggatagtcttttcaacaagtggtgctgggaaaactgaatattcacatgtaaaaaagagtgaagtaacaccagctgcaaaaacaaactcaaaattgatcaaagacctaaatatatgacctaaaactatagaactcgtagaaaagctcatcagggaaaagcctcatgacactgggtttggcactgatttcttggaatgacaccaaaagcataggtgatgaaagaagaagtagataaattctacttcacatttaaaagcttttattcctcaaaggacaccatcaagggagtgaaatagaaacccacagagtgggagaaaatatttgcaaatcatatatttgatgagagattaatatccagaatatacaaagaaatatgggctgggcacagtggctcacgcatcatcccagctgaagtgtgcggatcacgaggtcaggagttcaagaccagcctggccaacatggtgaaaccccatctctactaaaaatacaaaaattagctgggtatgggggcgggtgcctgtaatcccagctactcaggaggctgaggcaggagaatggcttgaacccaggaggtgaagtttgcagtgagctgagattgtgccactgcactccagcctggacgacagagtgagactccatctcaaaaaaaaaaaaaaagagaatagaaaagaaatacaagtcaacaacacttaacccatccaacttaaaaactggcaaaagatttgaagagagatttatccagagaaagtgtacacatggccactaaacatatgaaaagatgctcaacatgacaaattattagagaaataaaaatcaaaaccatgagagaccacttcatacccatgaggatggctattactaaaacacaccacaggaaatgtaattattggtgagaatgtggagaaactgaaacttgtaaattgccagtgtgaatataacgtggtgcagccacttgggaagaacagtatggcggttccttgggaaaagtaagcatgattcctaacttgcacttgtgggtatacgtcccagataattgaaagtggggctagaatggatattcaatacccatgtacacaatagcgttattcacaacagccaaaaggtagaaacaacccaagtgtccatcagtgcacgaatggatatccatacaatggactggaattctggtttgtgcataatggaggcattaggctaagtgagatgagccggccatgaaaggacaaatcctgtgtgattccacttgcatgagggactgagagttgtcaaattcgtagagaccaaaagcaaaatagaggttaccaggaggagaagtgggagttcgtgtttaatggggacagagtttcagtttggaagatgaaatggttctatgggtggatggtgaggtgttggcacaacactgagaaggtgcttaacatgatggaactgtacactaaaaagtggtaaattttgtattatgtgtattttaccacaaaaaagatgaaacacccacatacccagcaaagctgtctcacgatattcttgttgtctgcattggaatgcagtgaggatgacaacccttgtcaggactgcttatgtggacactcgtgcaggacccttcttccatctgtgttctaggtttctcgggggccatggacagacattgttccctatgaatagcaagttcacaaaactgtgaagctgtcaaaattttctttatacttgggctgcaaggaagccccatgctaaatttgtagctcaacttgtaaattgcccatgtatgtgttctaactttccagtgaaattatgtttttatttttcctgtttctggacatgattttatttcatttcctgtttagttacactaaaagcatcctagtaactgagttcaatgttcctgtacactgtgttgtgctaattattataactagagctttgaacctatggtaaacatttttatttctccttggtttccctttttttctaaaagtcccgtaagatttaaattgcagattcaaatgatgctaaaagtaaaagctgagaataatagtacatttcaaaatggcatatttcaacacgtttctgtttcaaacaaagtagttattttgttagtcatttttctgaacacgtgagctccaggtcttttgggatctaggaaaccccgttactgaaaccacactgttctaacggtgtaagaagtcacagaatcctgaacgacaactttacagttcgatggtaattccaagacaatggtacagtcgtttcgtcctagctatgcagatgttcacggaaaacaatacttagctccctagagagcgaatacttttcaagagcatttttttttccttgagaagaaacacagctctctgtggaaaagtcagaaatctctttgtcctttctatcccagagtattatttttctggtctttcagtggtgctctttacctgataatacccagaaagtcagtttgattattatgtgatgccaacaaaagtgtttgaaaatgacgaagcaactaatgatttagcatttacaggtttaaaaagacagcacctgcaggagagactgtaatacgacgttgtttagtcaagttagtgttgagcttgccataaccatttcaactttcaaagtatttacgaatcaacagtgctggaattatccctccagtttcaaatatgacacggaagtaacttaaatgaaaaattcctttcttattccgccatgcgccaggggatttttcttcccctgaatgaaagtgtcagcatctcatttattaacaatgcagatacacatcaaagccactattgaatctgtctctccccattgactttgccttcctatttctacaccctatacttcttgttcaacgaattgttcttgatgtgacgtcttcacaataagcccataagcacaactgaaacacaatttcctgctagcttcagtcaagatacattaatcctctcgatatttcccaggacaatactatctctcttctgcagactttatttctctcatttggctgagaaggagaaaaatccttgaaaattggtttgaaaagtggtgtgcaaaaacagtcagagctaaaatttcttgggcacacaattttctttaaatgctcgcatgttcatcatgcaccctcacgttaaacactcgcgtgtgagaaactgagaaggagaagttgccggacagctgagcgtccctgtgccgctgccaccccaggctgccgcccaccgctcaagctcagagctagagccctgtccacgctgtcgtcccttcctgtggctccaagtctgttctgtccaagtcacttctccatgaaaatgctgggtggaacgtaaggaatgggaagaagcttaagccattcctcttatagacctgggcaaccacatggcgtttattctccagaatattcatttgatggggacctctgggaaatgctatggcagctacactcattgcctttctgcataggtaggtgtgcatgcatgtatgcaggtgaggaggcacatgtgtaagtgcgtgtgtctgtgggtgtggaggtgtgtatgtaggcgtgcatataggtacatatacagggagggatggatgtaggtacaaatgcaggtacccatgtagacatccacctatgttggcatgcaggtgtgtatgtaggcacctatgtagatatgtatgtaggtacatatgtggctatgtaggtggatttgtaggtgcacttgtaggtaggtgtgcaggtatctatgcaggtaggtatggaaatgggtacagatgtaggtatgcatgtaggtatgtgtctatgtcggcattcaggtatgtatacaggtacatatataagtatgtaggtggatttgtaggtgcgcttgcaggaaggtacctatgtaggtatgtaggtggatttctatgtgcacttataggtaggtatgcatgtagatacctgtgtaggtatgtaggtggattagtaggtgcatttgtaggtagctatgcatgtagatacctatgtaggtatgtaggtggatctgtaggtgtacttggaggtaagtgtgcaggtaggtatttatgtaggtatgtaggtggatttgtaggtgtacttggaggtaggtacctatgtaggtatgcaggtagatatgtaggtgcacttgtgagcatgtgtgtacatatacagatgtgtaggtagatttgtaagtgcactaatagatagatctctacctaagaggcatggatataggtgcagatgcaggcagacatgtagacatgtacctatggcagcatgtggggggatatgtaggcaccacgcagctccgcacgcagcctgcatcaacaactctcacccgccagtctctggccgctgcccacttgcagtgggtgggggcagaagagtccaccaagcgtcccaggtctcgtcagcatagttgatgactctcctggtctgatccacaaggctgaaacactaacttgttcattgctgtcctgtcaccttgtcacaacacgtgccccggtgggatggaataataacgctccgtctatggcgaaggcttaggctttgcagaattgtttggggtgagaatgaggcagccctgatcccccatgttcattcctctgtctcacccaccttgagtgtttgaaaccagaaacgattctaattcagacttgcaatgtgattgtaatggacaaaatattggccttggcttggagtgttcaagttacgtccaatgagaaataaaatatatgactctccctctctcttctaacttcatcattggattccagcaattgaatgtttgtgaaggcttggcagggaattaaaatctatttcagctggcagaagctctgaggtgctgtatttctggcctatgtatggttgtattgaagggagaagatgcacagttcctagaggtgccacatcggctactcattcatctttgagttttgtggttgggccaattatctcaagctctactgtaaacctcgttagaggaaaaacacaatgaaaatgtgtgtgtgcatgtgtatgtgtgtggacgcctgtgtgtgtgtgtgtgtgtgtgtgtgtgtgtgtgtgttgttaagcacatctcagagatgctttctagatggcatctattccaggtttatctgtttgggagatgataaatagaattcttaattattgcattattctctctaaattccagatcattaatatattctacagaggtaactctagatggataattaagtaaatcatctggagagtcgaacaatatagacacaaagtctgcacatttcaggtggagctattaaaaacaccaaggtctttagggactggctgtgtctggccagagttaatcaagctaggtttataacagatttgctttggctgtatattaagcagttagggctgctttcatacaaatatattctactgtgtcttccttggactgtgttttattttcttatttttgacagaaatatgggtatacagacctcaagaaaaagcaggggtgcaaaagaaacgacggccagccatcagcatcagcctcagaactgagggtgaccagggttggtggggactgaccagagacaccatgactcattgctaccacatgggaaggtatccaggactgccagatatttcaggaggagccagaaatctcgatttactggtgtaagagagtcccacatttaaaatgcaagaggagtgaacgtcactggaattgagatagatgaagtacatgtaactggtttagggttggaagaggaaagaagagagaacacgcgaatctctgttctaagtctcccactcagacctcccacacagacctctgtgctctcagtgctcattgtgtgtgagaattatctgcaagaactctagaaagtcgtggagccctgggccccaccagagaggctcatcagctgcacgcgtgggtgccgtgggagcccggatgctggggaggccggatttcagccctgctccccttggccaaggccttggatagcaaacctggaaagtcaaaccaaatccatctacgactgggtgagactcaggtgaagggttgtcaagttatctggtgattctgatgcagcattagggttgggaaccccagtaacatttaaattacttgagctcttcagttgcaagttattgaaaacaagtgaaaacaaaaagactaaataaacattctccacacacacactcacacttctcgtaaacagaatttggcaagataagctcttgctggtctgggagctggacttctttatagctcttgaggggaaggagaggaggtgcctgctgctgagtggagaccctgtgggctcacccatgccctgccctgacctgctcccggccctgggttgtgggcgaagctatagcctcacacttcattttgggccaagggttaggtggggtaaataaaggtcatggaacatgacttgggatatctgacttattcctaaagtgtagttggaataaagcaggaagaaaagaatatagacatttgggaacggacatggtttagggaaaaagtttaggtattacaaaatgtgcaaaaagatgtttgttttgcaatttatgttttcaggctggtgtgaactaaatacagattgacagctctgaagaaccaagagtggtcagaaaaacaaaagtgtggtggtagctcttcacctactgggagttaaaaacacgtgccgcgggtgtgaggagagcttggcatgattccacagaggaggaagaaaaaaggaaacaaacaaacaaacaaacagatgaaagggaatttgttgaatttacaatgaattagagtctttccattgtactaatttaaaagttaatatatcagcttcaaatttttcataaattgtggtaatttccaagaaggtcatctacatgtttcttggtttgctttgagaaagcactcaatataaagaatccattccattactttttatgtattaaaatctctcttaagcatctgactatttcataatttataagctagtgtagacttttgaggcaagcattttctttgaaaagatacagacattatctcagatttggcaaagaaaaaaaaaaaggatgtacaaacatcctacagttggcactgccttttaaagcacatccaaaaatgacccacagcaaagtgacaatggtaatatttgctcacatcacatgagcaggtctgagtagccaatgacctgtgtctgggttgctggtgtgatgtattacagtttctacaatttgctgcaggcagaaatcttaattaaggcctttcctaaagagtgaccttcagggagggcattactgaattggtgtgaaaatagacaagtggccaaattgccctggtgggacggtggagaacttggatatctctctcccaccaaagaatgggctgtgctggatataggccaggctgcaggatcaatgatcaatgatcaatgagccctgcaccccatgaaatagcctaacactggggagacgtgaaagggaggacttttctttttggcgaatgcacgtccgctcctcacactggaatattctgcatctccctgcatgcatgtcttctctgtgaattctgggcctgcgcgagtctgagaagagcaatgctccctaacagcatacgtgtatctgtgtttcctcgggggaaaacgctcgcatatctgcggtccttgacgatatcgtctgacaggttttagaaggagatggtttcttcttggtcagcaaaccaggatgagatgggaacacattccgatctgatcagggagaccttatacagtgtttgccctcctttttgagagaaattggaaggcatcctccactaaggtgaagatggattgtgcagcttcagggggcacaggctcctggccgggtgccagcaagcgcgactgcgcacctcggatcagtgaggcttgcttctgccagatttctcgcggctgtgtgaagtattgcagccaaatgtctctcaatttgctcatttcttggccaaagttactccctgatacttaaactctaagacattgatcaacttctcatgcacttgtggaggcccacggatgcatctgaccttccctttcagcaaggcgtgaccgtgcctctctgggagcttctgcaccggatgcacctgaccttccctttcagcaaggcgtgacagtgcctctctgggagcttctgcaccggatgcacctgaccttccctttcagcaaggcgtgaccgtgcctttctgggagcttctgcaatcagggcagtggatctacccaagtcgtctggtcacagttctcagtatcctctgatctaacattttcctgtgagtccagaggaacaaataccttcacagccgccacttaatgtgttgcccattagtagcggatccgcaagtctcgagctttctgtttgcattagcggaagaaaaacaacaaagtcaatctcagagttttttaaaccactgggaaaactataaagatggcaaatgcttttgagtaacaattattaggcagaagacaccacggttatttcaacctgcctggtctttaggtaagacgaactctgaacttctcaaaccagcactttctgaagcctagaagaagaatatgtaaggaagaagagactccaacacaattgtatacaagaaatgctggatgagggatcctaataattagcatattaggatcaaacactcttgggtgtctctcttgggtgaaatatctggtgagcctgaatgagagggggtcaaaatactgtgggatatttaaattaaaatgtctccatacaccacatactttcatatcatgagggtctgtctaggcaagctgctgctacaggtgcacggacaacaaagacctcagccttgcagctgactgacaattttgtgataaacagaagcacacgttagctgtcaggtaagtgagcctgtgcaagatgctgtcatcagagaatacatgaaaaaccaggaggcccaggagaagaagcaacactaacaacggcctaggagaagaagcaagcctaacgccagcccctttagtggaaggcttcacccaggacttgccttgggaacttgccctggaggaagagtaggattccaccactcagaaaggcaataatgggatgataatagcaggcaatagtatactatagattatatggaaataataattaagaatagtaggttaaatgttaagataaccttatatctgaaagcacttaactgtttacaaggtaagttccaatatattaattcaaatgaccactgaaaaaatcctctgaggtttcttttactactgcttttaatttttattttaatttaattttgtttttctgagacagagtctcgctctgtggcccaggctggagtgcagtgagacaatcagggcttactgcaacctctgcctcctgggttcaaatgattctcctgcctcagcttccccagtagctgggattacaggtgtgtgccatcctgcccagctaatttttgtatttttagtagagatggggtttctccatgttgtccaggctggtcttgaactcctgacctcaagtgatctgctctctttggcttcccaaagtgctggaatcacccgcctgagccaagacagccagcctgctattgtttttttaaataagccgttaaatggctcacccaagacaatatacacatgaaagtaagaatccagagctgaacttggttctctgtttccaaggaccataccccagttgtctcatgaactacatacgtcagcagataggatgccatgtctaagccttacaggattaccatgctgaaggaagaggaccttgaagtccacatcatggcaggtgcttcatatctcttaggaacaatgaaaaagtaactggccagaggaaatgccttctgcagtcctcacaattttataatttctttttgtttatgtatttatttaattgttattattttttaagagacagactcttgctctgtggcccaggttgaagggcagtggcatgatcatggctcacacaagcctcaaccaggcttaagcaatcctcccacctcagcctcccaagtagttgggattacaggtgtaagccaccacacccggctaattgtttttattttttgtagagacagggttgtgccacgttgcccaggctggtctggaactcctgggctcaagcaatcctcccatcttggcctcctaaagtgctaggattacaggcatgagccaccgtgcctggcttattatttctttttaggaaccattttgaaaccttttatttaactggagttttacaatcttactgacacctagcatttgtgtgcctacagaatgttaagaaatcctgataactcaaaaaagcccattctttgtttcaccattttgtcagctctagagtcatcctgcctgacaattagcagggccaattcataaggagtcccaaaaccaacacacactgtttttgtggaaattaaaaatggaataaacaaagtcagatgtaatgagacccacagtctggagaaaatcctacccctagacttgacaatgagcctgccataacctacctttctttatgtttttgtgtatacatgctacccctcaacaaggcaaggagcttgtctgtagcaagatttcagaaaaaaagaaaaagaaatcagagtggaaagacctttctgtctccgctgttcatggctgagtgattcgcctctttgagttgtagtttctcctgttaaaaagtagataaatttcccttgcttgtctaactggattgttgtaaaaatcaaaggagataagacagcagaaagctacttctaatttgtaaattgctacaaaatgagagttattgttatgtatctctcttggcctttaatagttgttgataagatcatttttgtgatataagcatcactcatttgttctataactcttcattgagtttctgctttttgatttagggaactgagtagctggcaagacagggaagcatatagtttagtggcagaaggcagagtgaaccatcaataagtgaacaataagcgccacacagagaagtaaaactaagtaatgggatgagaatgagaatggctgggggaggggcttcagagatagggattgttatgtgttcaacggtgtcccacccagaaaatacatgttggtgtcctaacccatgggacctcaggatgtgactgtgtttggatattgggtcctagctcgttaagaggagaccccactgcggtagagtgggtccatggtccagtatgttggtgtccttatcaaagagagtcgtgagggaacacaggagagtaccacgtgacgctaaggcagagattgaaggagcaggaaggatcatcccctgcggccttcagagggagtgcagtcctgctgacaccttgattctggacttctggcttccagaactatgagaggatggatttcagttgctttaagagcccaggtttgcaggactttgtgttggcagccctagaaggctaataggtggtccaagaacacctgtctacaggtgcagcatttcacctgggactcgactaaggagggaggcagggatgcaagtcagggagtgtcccgggtgctgggggaccccggccttctgagtctcacaatcagaaggtgggcaagacagctggaggggagcaggtagggaaggaggtgggagacgaggccaggagggagagcagggctttgtagggggaggtgatgtgcttggacttcatgccaagtaccatgagaggcctgggagagctttaaacacaggtcgctgctgacacggagctcaggccttgatgccagcatctaatccccacgcacttgccgagcaaggccacacgaaatgctcccaagaaggactgtgactttaaaaccctaaaagggacaggtcacagcacatttttaaagtttgtgacatgacattttctgttgctattcaatagttgtaaaaatgcttcatcagaacttttaaagcatgcaacagccaccacctaatgtacacttcgattaagtcagtgaaattggctccagactcagaaatcaaatcaggattccaatttttggcaacatagtatctatcatagtattttatttttgctattggataatggaagtatttatgctatttataaagtattaggtggtgcaggttacagaaaaatttaaattcctaatttttaagtgctaatttgcagtcagtagctttgttccatctttttgtttatttctttgggtatatttttgtattaagtagatatagtttagtttcagaccatgatagattcaggtcacaataatgaatacataaagattcagaggataaaatagtggcaaattggtctgtttctctgtgtgctacaaagaatgaactaaggaatcagaaagtgcaagttcacacttgattcatggtcctcttgctgatctctccgaacctatttcctcaattaattaattctttccttaatttaccaagtgtttgtccattgttcagtgctgagaggaccatactataagactggtgtgatcctgtctttaatgtgcaaagtagagatggaatccaagcattattattctaggcacagcataatatggcattctttttttttttttttttttttttttttttttttttttttttttttttgagatagggtctcgctctttcacccaggctggagtgcaatggcacgatctcagctcactgcaacctccgcctcctgggttgaagcggttctcccgcctcagcctcctgagctgggattacaggcgtgcgccactacgcctggctattttttgtatttttagtagagatggggtttctccatgttgtccaggctggtcttcaactcctgaccttgtgatccacctgcctcggcctcccaaagtgctgggattacatgtgagccaccgcacctggcccataatagggcattcttatgccaagtatagtacctggtttacaagagaccagaatgatccatttgcatggtttcttactcaggacgctaattttaggtattcaatagaaaatttagcaaaatcacacacaggaataaatgttaagtatattttcctccattttttctcctataaatagactttaaaattatgaaggaatgagcccatagacaatatccatgtctcctgagaggcagctttgggtctgaggtcaatcaactacttttgattgaatagtgtcctgtctggatttctgttctttatttactttgaaatatgtaaatatttgcatagatggtaaatggaaatggtgtacttgttggtgaacctgtttgattactaaagccataataataacaccaccagctatgaatgctaagcaaaaatgaccctttgttctactttttcaaatctgtggactacaacagcactcttggggacaataacccacacaatagattaaaagcctgttaaatgttattttcagcttggcagaacatcaactgctgagtaccctttagctccactttttttttgaagtatggcaaacttactatatccaggtgacaacagtaacatgtcattttagagtgattaaataattgtacaaataaatggaattaggcttactctctgactccgaaatacaaaattcaggtggagccaaggggtgagttgtgggggtctttgacctcccaaacgtttaccatgtgctccaaacctccctccacaaatgtataatctagtagaagtacacctggtggattattgcagcttcaggatgaaccatcacccattctccaaactacagtctctcctactttgaaaatctggagctatctcttgctaaaaacataaaagatttaaagatttttctaggttttctctttttttctactttaaattctcaaccaaaacagaggcataatttatatatatgttttagtaggaagtcttggattatctcctaattttaaatagtttgattctggttaaaataatttttagaccacagtttacatgatttagctgattggaaaattgctttttatcataattagtagaaattggtgaactgaactcctttaagtctgctacaaaaccaaccttgcaagaatatttcttccattaaagcacatggctttaagagaattgccaataaaaagcaaccagttagaagattcatgctggaggaaacattcaagttgtatatcaaatacatgcaaggtatatcaagtagttcacgttcacatttatttacaaaactcctcggagggtttctgctgtgctaaggacaaaaggagatctcataagttctgaatttaataaaaaatatcatagaggttattttgccaaatgaaaataaatccaatacaacactactatgcaatgggtttaaacatttatacccaggttgatgaatagaattccagcccaatgctacattttggcagaacatagtcttagaaaagatttggagctgcctccagtctttaaggtggtaagctttagaggagccttagaaatattccattccattagttagaatatgatgaaaagtacaaacttttctagtcatcatggttgtcattattaacatgattgtcaccatacttattaatataatcatcaccatcatcatagtcatcatcaccatcatcatcatcattatcattgttatcatcatcatcattggtataaacatcatcaccatcatcatcactgtcatcatcaccaccattatcattgtcatcaacattaccatcatcttcatcaccatcattattatcataatcaccttcattagtatcaacattatcaccaccatcatcatcattgtcatcaccatcaccatcattattgtgatcatcaccatcattgccatgattatcatttctattgtcatcatcatagtcatcatcatcaccatcattagtatcaacctcatcactgacatcattatcttcatcatcaccatcactattatcatcgtcatcaccatcatcatcgtcatcaccatcatcatcattatcgttatcttagtcatcataatcaccatcattattaacataatcatcaccatcatcatcatagtcatcatcaccataataagtatcaacatcatcactatcatcatcattgtcattatcaccatcatcattgtcatcagcaccatcatcatcaactttatcatcatcatagtcaccatcatcagtatcaacatcatcattagtatcaacatcgtcacctccattatcatcattgtcatcagcaccaccatcatcgtcatcatcaccatcattattaccaacattatcatcctatcttcatcatcatttagtatcaacattatcattagtatcaacattatcaccaccatcatcatcattgtcatcaccatcaccatatcattgtcatgatcaccaacatcaccatgatcttcattgctatcatcatcatcatagtcatcatcataaccatcattagtgtcaacattgatgatactaatcaatctaccattatcatcatttcatcatcatcatcatcatcgtatggttatcataataatcatattcatcataatcaccatcattatcaacttaattatcatcaccattgtcatcatcaccataattagcatcaacataatcactgttatcatcattgtcattatcaccagcatcatcatcaccgtcatcatcatcatcaccaacattgtcatcattatcattatgtaacttaactttcctcatacggagagcaacgcacactgggctatgaacaatagggaaattactgtgtactttggcttcttaggctgagacattaagtagaaacaaccacatattaagaggtcttagatacatatttatagcaccatgacccagtggtaaggacctggaatgcagactcagaggaccttagtccagccctgcctctagctggacctgtgacagtgacagtgaccctgtcactggcttttgaatctcaggtatgccccttaagttctataagcctaagtcgtcacatcaatgaaatgggataataataataacacttgactaagaagttattgtgaatgtcacacaatatccttactaacatcttcattttgcaaggagaaaaccaagcttatgaagattaagtaatgtatacaaggaagcacaggtgttaactgatggagtctgagtatgaactagggtctttttgattagacaattcgtgccccaaaccacttgtatatactgccttcatcatatgaaatattgcacatttaatagtgttcctctccatttttagagactcaccaaaaatttctaaataagtttgtggaaatatgcagaaaacacatgttcatttgagacaaattttagagaaagagctttttgaaataaaggctaatttagaaaccattttctaattcatcagttcctctcagttgtattaaacacttattgttctcctttctcttataaataattgattcaaaactatttataaattacatatatatgtacacacacacaggcacaagcatcagttatgctttttatacactaatcctaaatctcttcaatctgaaattatatttcataaagaacttgttctgaggaaataaaattatatataaatgtcacttctattttccaatcatttataagttaattgaggggatctcacatacattcctgagatatctgcagaagtaaccactttaagtataaattccatagaatttgaagggggtggagtttaatgttggttgatgaggtggagatgacttcctggagggcatggaagttgaggcatggaagagaatgtgtctgggtgggatgggagagaataactcagttttagaggtagagaaaatgaacatttctgggtggcaaagataaaaaaatctcattaaatcaaatatttgtgtgtatatggaaaagcagaaactctcattcagtgcttgtggtggtataagtcagtagatgccttggaaaactgtttgggctgggcatggtggctcacgcttgtaatcccggcactttgggaggctgaggcaggtggatcacctggggtcaggagttcgaagaccaacctggccaacatggtgaaacccatttttactaaaaatataaaaaattggccaggcatggtggcagatgcctgtaatcccagctactttgggaggctgaggctggagaatcacttgaacccaggaggcagaggttgcagtaagccaagattacaccattgcactccagcctaggcaacaagagtgaaactctgtctcaaataaataaataaataaataaataaataaataagtaatttttttaaaaacaaaggaaaagaaaagaaaactatttggagtgatctcatatgtgtgaaaatacacatggcctatgaccaggtaatctcactgatacatttataaacaagagaaattcctaggatacaaaaaaaaattactgtttataaaaaccaaaagtggaaatcatccatctatgttagaatgaataattttatgtgttcaaaattttaatgtgttcaaaatataataaacatgacacatgcagtaacatggatgaatttcaccaatacaatggtgaatgaaagacgtaaaacacaagttacagacatatacttttgtataaatttcagaaatgaccaaaatcaaaaaatgttgtttagaaatacatcactgactcatcacttactcatcattcattcattattcactcatcactcactcattattcacctcttactcactcatcatttatcattcagtcattactcattcatcactcaacactcactcatcactcaacactcattcatcattcatcgctcactcattactcatttattactcatcattcagtgttcattcatcgctcactaatcactcactcaatactcattactcaacactcattcattactcatcattcactcattactcgtcattcactcattactcttcattaatcattcagtcattactcactcatcactcactcatccctcaacacttattcatcactcatcactcactcattactcatttattactcatcattcatcattcactcatcactaatcacttatcattacttaacactcattcattactcatcattcgctcattactcatgcatcattcatcattcctcactgctcactcacactcacttatcactcaacattcattcattactcatcacgcattcattactcactgaattaaccattcagtcattactcactcattactcatcactcacttattacttacccatgtatcagtcattactcattcatcactcactcaacactctattacttattactcactaatcgctcactcattactcactcatcattcagttgtcagctactcatcactcacctatcactcactcattactcactcaaacttattcatcactcgctcatgtctcactcatcactcatcactcactcatcattcatcacccaccactcatttttactcaacactcactcatcattcaccactcaccactcattcatcacccaccactcactcattactcgtcactcacccattagccatcattcactcattactcactcataattcattcatcactcatatgcatcactcactgctcactcatcactcacttattacttgttactcactcattactcactcatcatcattcccttgttactcacacatcactcactcatcacttaacactcattcattactcattgctcactcatcattcatcatttagtcattactcacttatctctcatcactcattcattactcatcactcactcaacactcagtcaccaatataggtacctctctgactacatgaagaagtgattttgatatcttttaacccttaatcagctataaaatggtagcccacaggttgcatatgaactgcacaacgtattttattaggtatcacttgctttgtgaattttttgtatagttctacacagaaaagctagattcaagagttcttttgaagagttggagttgtttgtcaggcctgggtccctgcttctgagcagtgcctcccactgaacccagcacggaagtgccctgttcccatcatcccacccgtgttcttgtttaggcacttaccgtctcaccccatgtgtaatgacctgtctgttctctgttgttatttcagttttctccctgaactctaaggacatttaacctaagtgttacatgaatcaaagtgctggtgtgtttttctctgtctttggaaagttatagaaggtagaatcggcatgactttgaagcaattattccagtagaaattctgttttcatagctgccaaaaaggccgcatgacaaaaacagtggcaattcccaaatgcatcttgatacttctaggttgattctaaatgacaacttatttactaacataaaataataatttagtcaattatatttttagttcttcataaacacctacagcacaaaagggtaaaaataattttggggtgaattgtagcaaagaaaattttgattagggcgataaaagagaggtaaaatagatacacagcaaaaacatttaatcttgcccagctgttataggtgggctgcatatttagacaggagcttcctagctgccaatgcaaggaaattattctgacctttgcaagattcacaacaatcatgggataaaaacaaaacacttgttctggaaaagcactgttgtgctgtccctgaaacctagagtcatattctctagtgcaccttttaaaattttactttatttttatttttgagaaagagtcttgctctgtctcccagcctggagtgcagaagcccaatctgtgctcactgcaacctccatctcccaggttcaagcgattctcctgccttagcctcccaagtagatgggattacagacatgcaccaccacgcccagctaatttttgtatttttagtagagacggggtttcatcatgttggtcaggctggtcttgaacttctgacctcgtgatctgcctgcctcagcctcccaaagtgctgggattataggcgtgagtcaccacgcctggcctctagtgtacctttttaaagaagtgatgggtagtgtgtttgggcagcttaaacattcctgcagtaaaagggggagtttaacttgctagctatgtagggaaacagttttgagtctcctggaattgtacacagaatttggtgtgcatgtatacatgatttttctagagttaaatatccagaactttctccgatttctcaaaggcagcattctcctcaatgtgccacacagcccagttgtatcagaagccctcagggagtttggtaaattgcagagtactgggccctacatgaatcagagtcactggaggtggaactcaagaatctgcattagaatggctctttctctctcttcccccacaacatgtacacaaaccaattcatgtgtctgtttattaccattatctttaattcaattaaaaatgaaaaatagcaaaaatcaatttagcagaaagcaattccacagaggggcccaatcaaaacagctcgaatatattgctcgccagtagcctgttttgatccaagggtaaaatgtaaactagccaggggaatttatggacttcatgtccttcagccaatcctccataaatatcatttctccccactgggcatttcaggaggattagaaaacagaattctttttttattcactgacaagaacctggagggcagaaattcagtgtttcaactaaggacaaagccatttgattcattaatcaactgggcagaggacaggattaaggttttattctcttctttcgaagaactctgcctggctgaagggtcaccactgcacccggtaccaaagcaggtccatggatgttacctgtgggaatagcctggtgagatctgcaataaaaactgcaatcgtgaggaaacttccagaacattgaggctgatcactgaccaccaggtaaactggcaaggaaggatgccacacagtgtccacctgggtgccatcaagaacggacacaatagctgttgctttcacagcgaaaggagacttctcgttcaccagcctcagtgggggcccggcccctcctgcacctgctgcccccagcggggctctgtgatgctgcatctcccacaactgtccagccagtcatgctgaagaccccttacttcctggagcatttctaattttaagttttgtgcacccacaccaggaaagaaggtttagttctatactctggagaggtatatgaccgtgtgctcacaggcagacccacacatccttggtctctcaaaagcaataaaaggtgcttttgcaaactataggcctccttcaaaatcctgagattcccagcaaggttttgggtcacccctcccaggcttgaatcagtgacacggcaacccatggaagaagcaaatctactaaatttacttgtgtttgaagaggagttaagctgcaataaaggaactgtcacccgcttgcaggggcctcagtcctgcctctgtcagggcctctggcctgtggacggaagtctgagtgggtgtcactcgggtgcatgagctgggcctcagggtgaagtccaggttgtgtagtttaaaacatccattttctaacctgtgttactttaatctttatttgttttctcacaacacttagatggaaaaagaaacgggatcatgttgtctggttattgcattaaaaatctttaagcatgcaagaaagaattatttttcaataaattttggtaagatgtctgcatttcagagagatcttggtaatagcatgagcatatggtgccatttattttctgtcaccatcttattcatttccttattttttgcggcaatctagcatattatcttaattatgttttaaataacttttggagaaagcattaaggaatagcaatgagattaaccctaaacacacgtatcatatgcacatccaaggaaaaatctaaaagaatacagcagctatctccactatttagagctttactcagtaaattattttcctcaaaataacacatacatatttaatttttaggaagagaaccatggattatgcaatatcaggctttcgtgaagggatttttttgttgttgttgttcagtctgtagcccaggctggagtgcagctcatttcaacgtctgcctcccaggctcaagcaatcctcctggctcagcttcctgagtagctaggaaaacaggcacacgccaccatacccagctattttttttttttttttagagatggggttttgccatgttgcccaggctggtctcatacttctggtctccagagacctccttgtgcccccaaagaccttgataagtcacagggaagcacaaaagcagtcaattccctttcagccccccttttagcacctgtgagcccttcacattcattgtatcatttcctttatacagcacgatatagatcttggtcagcaaatattttccataaagggccgtgatatggttctgatctgtgtccccatccacatctcatgttaaaatgtaatcctcagtgttagaggtggggcttggtgggaggtgactggatcatgtaggcggatttctcatgaatggtttagcaccatcctcttggtgctgacctcgtgatagtaagtgagctctggctagatgtggtctctaacagtgtagccctgcccacgccccgcccccttgctcctactctgccatgtgacatgcctgccctgtcttcaccttctgccatgattggaagcttcctgaggcctccccagaagtcaagcagatgccagcttcacgcttcttgtacagcctgcagaaccgtgagccatttaaacctcttttctttatacatggcccaatctcaggtatttcttgatagcaatgcaagaatggcttaatacaggccagagagtaggagtttttgatcattcagcctctttcccaatccttcactctgccagtatttcatgaagcaggcacaaatgacatggaagtggcatgttcagtgaacttggattccgttgcttaaactggctccttcacttccatgctgaggtcctggatctgcagctccaaccccctttaaatccctcaacacggagcccatcgcttccagcagcagctctcacactgtgagcgggcatgctctgtcccaggcaacacttgcacacctttcttcacagcccacaagccagtcctactgttttctcccatgaagccaacactttcatttttccaacactcagcccaccccttactttttcccctctttaatgggaaataatgcatctggcgctggacattctgagtgtgtctgagtacacgtctcattgcagacacgtgtgtacgcgggcattatgtagccagcccggccctgttagggagttctgctgcagacccctgactcggctggctgtgcactgcgtggagccccacgtgcgtgggcctggacgttcacatggagctcctgccgtggtggtgaaatattgtggactgcttggctgactacacgggtcagttgctgcaaaaagccagtctgcaggtggggcagtccaggaccgtttccgtgacaaaaggagaaaaacaatgaccttgaagtaaaatttgtataaagctacatttttttcaatatttaaaaaattcttaaaaagtattcttactattcattttttgctattaatatacaagggggtagttgttgccggcttcatgctgtgcctggcactcttttttgaaattactctggactgaaatccctgaatctgggacccaggttctaggaatgcaaacacacacacatgcgtgtgcgtgcacacacacgtacatatacacagagacacacatgacacacacagacacacatacacatgcaatgcacacacatgcacacatgatgcacaaacacacagacacagccacacatgcacgacacacagacacatgcatacagacacacacggatgcacacaggacacacacacacatgcacacacagacacacacaacatagacatgcacacatacagacacactgatacacgcaaaacacacatgaacacaaacacacaggcaccgacacacacacagagacacacatgcacacacagaaacacacacaccaatgacaaatcagcctcactgtgtgcctcgcattgccccatttaacccgcatcctgcgttgttggaaagtgtgtatgtgatgatgacgctgaggaagatgacagcacagagggaagatggcacctgcaagggatcggagggtttttgttttttttttttttgcaacaaataactcagatgccagttttcctttccagggaagttttatggttgagttagctgtcttagggaggcgaaatgatttctctaaggtgtcgtctgactcacatccacacacatcttccctcggaaaacactcgttctgcctgaattgaaaccagtgtgtctagccctgagccagttagcctcaccatgccccagccaggcgcgtcagccgcctccccacacctgtggttatgccactcccatccccaccatggcagccacctccccatgcccgtggttctgccacttccgtccccaccgtggcagccgcctccccatgcccgtggttctgccactcccgtccccaccatggcagccgcctccccatgcccgtggttctgccactcccgtccccaccgtctgcactccagacatcttcttgaattaggaggactccaagccagaagctccatcgtgttctatttctgtgtgagtgagtgcatgacatctcacaaaaaagtaataaataatctttcaatgtatccttttccttgactttttccattcttggtatcaaaatcagagcacactttaataatcatctaatcgtttctggttgtttctcttaaaatctgatcatctatgatctgattattattttatctgataatctattatcagattttaagagaaacagtgcatgtgactgtgtctttgggaagatgatgtgcatgtcacctattggactttttactgtctgtcatgacggtcctttggaatggttttcaggtagaaatgaataatattatggtattggtcaggaagaaatttaacgacaactgaatttgtttataaaagtttgaattttgtcgtgcggctcatttcaacttctcctcctgcaacccttctgaaatagagaaattctgcccataatatttattatttatgggggggaaatgctggaatgcctaatggaagcttccagatgataaaagtcccaggtctagcaggaagcccacaggctgttcaattcccccactacggtatttgcatatttgaggctcatgttcccaagcaccagacaccagcaaaactctgcagcgcttttctgttagtttcagcgacagcctgtctaggcatgcccttctagaaagaaaactgtagtaatgctaagaacggtagctctatttactgaggaccatgtgggctccaggcgtcctgccgacccactgtgcagggtctcatgtggctgtccacacagccctgggagatggagattcctactctgttcatctcgtaaaagaggaaaattaaatgtaggggagaaacttgctataagtacccgctgtggactggctgtggggtcccccaaattcctatgttggtaccccaaccccaaagggatggcattaggaggtggagtctttgggaggtgattgggtcatgggggtggggcccggtgatgggatcagtgcccttctaaggaaaaacgtgagggccctggtttcgtccctctccgatccctgccgtgtgaggacgcagtgagcaggtggctggctgcaggtcggaggccaggatgtcaggaggcaggtcttccccacaatccggatctgctgcctggacagtgggctcccagcctgtggcactcagggaccaacgtccactgcctaagccacccagtctgtgccccgctgctatggctgcccaagacggtggccgagacagaagcacttctgagtcctagggtgttactcactgattcttccagtggctgtcgagtgacttccctataggagggcagagctgtgatcaataaatacggaagccaggaagacaggagttgacgctgctacagaggaaggaaacagagtgggctcagatgtgctggctgtagaagaggagctcgttttatgtgagggaacctcaggaggccctggagtcaggagggagcaagaccagacccactggagaggctggcatgagccttggcaccggacaggaaggctgcacctgcccccttcaccaggctgcatccggagctccctgctatccacacaccccagcttctgctcacactgcccttcaaggcccctcgtgagcacacatggcagtcccttctgagtgcttcctttactacgtgaatctgacgactgcctagagggaaacgtgagctccgtctggagatgtttaccctcgaccaggtggcagctttgaatggcagggactggaatctaccagtgtagctcctgtgtgggcaccggctcaggacgagagacaggccgagttccaatgtcttccaggactcgatggaggggcagggtgctgtctgaaggggtttcccccgcttgttgtgagtcctaagtgccagatagcgggtgtacagtgacttcattaggcatacgcagctttcctggcacgtacacggggagaactggaggagaagagctgggagcagccagccctcccagtcctggatttgaccatggtgcccttcttgccgtcttctccagggtgggacaggcagcgatggctcttccactggcctctgggtccttcagaactagtaacgtggtcagggctgttctttaattttagggatgtctggtccaaggttccacaattgacgactgtgtgaccttggggaaacctcacctttctaaatctcacaagggagatcacacaattcccgagtggtgcgttcatcaggaaggtcaagtgaggtcgcgtgtgaacgtgaattatccagcagcacacggccagcgagaccttgacactggtgttggcgttggatgaataggatgcgtttgagggccccttggtggttgagagccctcactgtcaccgacctccatccatccccaggacaggcatcttgcagaacctcaatggacgtcagtgctgtccccgcagctggtgaagacacacgctatggtcagaggctgcgtctggacctcggcttggccaagctatgtgtgagcatgaagcttgtttccttctctcaaacatggggagaacccagtaaacctgcctggcagagtcgttgggagactcccaggaggcccttggagtcacttgcctacattattgttttcacgctggcttctaaagaagtcgtgttagctgggcacagtggctcacgcctgtaatcccagcacttcgggagaccaaggccggctgattgtctgaggtcaggagttcgagaccagcccagccaacatggtgaaacccgtctccacagaaagtacaaaaattagccggatgtggtggtgggcacctgtatttccagctactcaggaggctgaggtgggagaatcgcttgaatccgggaggcggaggttgcagtgagatagctgagatcacaccactacactccagcctgggtgacagagcgagactccatctcaaaacaaataaagaaggaaagaagtcgtgcttattctgtcagtccctaagaaatcaaccttgattttagtagacattggaaggctgcagagctcctgaaagcccagccgtgaacccaggctctgcggaggcctttccttctcctctggcttcaggtgagaagtcgtctggcccagcggtccctgggcctcagcatgaaggctggggagctaagcgaggagtttggtgcctttcttgaagaggagtctatgaatagatcctattttgtagcatccgggaggagccggtccatctataaaaacctcgataatcgtgcctcgtttcctgctttcactgcgtgccatgccctcggtgattagcgtgtttttcagactaacagcaacagtatgttgaactgaatgccacctcctgggtaaaatgatcaatctctttgacttctgcagtaaacacgttccatcagggggtcactaatatgcttttatgacctcactgtcggagatgataccattaccaagcttgataaaccattcttcagaggcttgcttttaattttattttttatgcaatcatggggactataaccaataaatttagctcgatgctttctcactattaactaattctgaagaagccctcgggggttcgtcaggcacaaatccttcaaagaatttgtacaggatattggaaatgatattcacccggggacagaggtttaagcccgagctgctactgttttctttgccattagagttacaacttggctaaatgtcatttagtcaaaatgctggattctgcaggatttgcagataggcttgactatttgtctttaataaattcattgactcacagaagaggtattagattatttgtttgagaaaaggatgtgtaagtggcaccagactgctgatgtgcagtttctcattaggtccgtgcaggctcaaaagtgctcaaatccaaattaagctccagagcctttttggaaaacattgtaacagctgcgaaatggaaaggggaattcagatgagagcctggctagggatcttatcttaaaggggcatcagctaaagccatgtctgtggtacaaaaccatgggcctggctattttcttctttctttatgtcaaggagggagcttcttaaaattatgctttaatgcttgcattgcttctgaggttctgacgtcttaaaatcccatttgcttccctttctttttctctttctttcttttctttcttctttcttttttctctttctttcttttctctctcttctctctctctcactctttctttctttctctttctctctctctctcttttctttctttctctctttctttctttctttctttctttctttctttctttctttctttctttctttctttctttttctttctttctttttctttctttctttcaacaagatctcgctctgttgcccaggctggagtgcagtggcacaatctcggctcactgcagccttgagctcctgggcttaagtgattctcctgtctcagcttcatgagtagctggaatgacagctgcgtgccatgatattcagcaaattttttgacatttctttagagttggggtctcactatgttgcccaggcttgtctcgaactcctgagctcaagcaatcctccctcctcagcatcccaaagtgttgggatgacaagggtgagccactgtgcaggcaccagaagtgatttctggctgttgttttcaaccactgaggacacccattgccgaatgattattttcaaaccaaagctaaaatttgaaaggtgtcttaaactaactgtgggaatcatttcttggttgaatttcatatgcatacatctatctggagaccttggagatgaaggatagaatcaatgacaccttagagtcctttgtgattctattgtaattatcgtaattactgtgaatctcagactaatgactcccccaccccctacagtcccttcttcactggaatctagcccaaagccaggctagaacactgaaagcttttgccacaaaaccagtaatcatcaaataccattatagatggaactctcaattccaaagctctctctgtctctctctctttctttcttgacgctgtcacccaggctggagtgcactggaatgatcatggctcactgcagcctcaaccttctggctcgagtgatcctaccacctcagcctcctgagtagctgggactataggtgcatgctaccatgtccggctaattttttaaattatttcgtagagatggggttttgccacatgggccaggctggtcttgaactcctgggctcaagccttggcctcctaaaatgctgggattacagatgtggccaccgggcctggctcctgttctattgcttgttttgatccatttatttttgtgctgctggggtgggtgggcgtatcgggtggatgcacttataatattgttaaaagctaaggtgaagtgctatgttcaacggatagattatgtatcagaatgccttttttgttaaagcaatacatatttattgaacacctaccccatggtgggctttgatctcatgcctggaattcaacagtaaacagaaaagggggactctctttcttcaggtagctcctattccagtgaggggagacatgtgtgggatgtgccaaggggagagaagttacatggagaacagaaaagcaaagtcaacgaggtagggattcctgtggaatggggggtgggggcagtgtcaacatttgatgctacatctgtgagcccggtctgaaaggagtgaagaatcagccgaggaaggattggctgagcacacatatgagccattaatgccactacactggataccaagacatggagctgtctacactggataccaagatcttgatggtgtctacactggacaccaagacgtcgatactgtccacactagataccaagactttgatactgtctacactggataccaagacatggatgctgtctacattgcataccaagatgttaatgctgtctacactggacaccaagacgtcaatgctgtctacactggatactaagacatcgatgctgtctacattagataccaagactttgatactgtctacactggataccaagacatggatgctgtctacactggataccaagaagtttatgctgtctatactagataccaagactttgatgctgtctacattggatactaagacatggatgctgtctacattggataccaagaggtcaatgctgtctacactggatgtcaagacatggatgctgtctacactgtataccaagatgttgatgctgtctacactggacaccaagatgtcaatgctgtctacactggacaacaagacatcgatgctgtccacactagataccaagactttgatactgtctacactggataccaacatatggatggtgtctacactgcataccaaggtgttgatgctgtctacactggacaccaagacgttgatgcttctacactggatactaagatgtcaatgctgtctacactggataccaagacattgatgctgctatgctggataccaagatgctgatactgtctacactggataccaagatgctgatgctgctacactggataccaatacatcaattaagtctacactggataccaagactttgatgctgtctacactggataccaagatgggtgtttcacgttggccatctaatcctcaaagcaacagaatgaggtcagtatcatcatatgcatttcctagatgagaaggctgaagtccaaagagtggaagctatttccaaataaatccaagtctcatgacatggagaagagctgggatgcaaattcaagagcacatgattctgaagcaaattatttccctccaagtttctgctctcattgccagacaacaccttctcaggggtcatagcttcagccacaagcaaggtgtgtggacattggaagagttgtttgtcccccagggatgtggagcaggtgctcttacgtgtcccagtgagatgcaggagctgtgtgctgatcttgtcatgccagggacacatctggagtctgtgctgggctcaccccacgtctgccaccagcctttcgcacagcaggaaatcaacaacgacttggtaaagacaatgggctctgccaagctgcttactttaaagttcacctgacacatttacactcagggagagtgacgatgtctggagagcgaacgtgaagaatgaagactacagctgatgacattgcatactgaaaatctgccaagagagtagattctagtgctcctaccacatccacactgaatggtaactttggaaggtgatgggcatgttgatttgtttgactgtagtgttcatttcactatttgtatgtatatcaaaacatcgtgttgtacaccttagatatatacaataacagtaaataaaaaaattaccagaatgttcactagttccaagaaacctattttaatcttgagctgccagaaacccatagcccatacattaatgacaaagcgtaactagaaacgctccttgaagaccctcagtgacaaggctggctatgacgggatgaccgccaccatcaggcctgtttcctgaagccggcagcgccctgcagccgactctggcaggagggcactctggagtgtgtggctagcgatgacggccgtcctccgtggctcaggatcctcttcttgcctgtgtggagttcatggctctgttctggctctggtgctcccaccatggttctagccaggagtctctcatgatggagcgcgctgggaagggctactctggggtggaattatccagacacacggcagtgctggggttccagggcagccctgaggagaggggcaggggttctgcaacccctctgcccaggtgcatgctcagaagctcagcgcctgtgtggagggactcagtgtcaggaacaaccagggatttgctggagaaggagaagctctgggccggtagagttggatcacagctaatcatgctggcttgaagtgatagccggtgaatgcttgtctatcacctttctggcgcctcttactgttcaactctccattttctgagctctgtttaccctgttctatctaaaacacttaaatttgttctaaatgaagctgtgtataaacaaaataacaaaaatacagccgggggcaatggctcatgcttgtaatcccagcattgtgggatgctgaggcaggaggatcacttgagctcaggagttagagaccagtctgggcaacatagcgagaccctgtctctactaaaaacaaacaaaaaattagccaggcaaatcgcttgagcctgtgagatcgaggcagcagtgagctagatagctctctgcactccagagttgggtgacagtgtgagacgctgtctcaaaatatatatatatatatatgtatattatataaaataacaaaaatacataaatatataaaaatatacttgatattgctgatacagaggactcctgaatgttcagaaggacggctctgacgctttgggacagtagtcggggaatcagtaaaccacacacttccacggccctcaatttcagggtaacagccgtcagttctccactgcttctcaattatttgaacaataaatgaattttgaattttaatgtttctcagtgaccatgtggtactgagtatgttttttgatgcccattatctgggatgtattttcctcctacctcctccctcagtggggctcgtttctggctgcccccacacagtctgatagaacttggttccctccagatgtgtccagatctgggatgtcctgcacagcggcccctggcctcctatggccttggagtgcttgaaatgtggctgccgagacagaggaactgaattttaagttgtatttaattttgattgaattagagttgtcacctgtggcagatggctactgcactggaccgccacccaagaagcttaaaatcccaggacactcaaatgtgggtgggttttgtgttgtgagaacaagaaatcctttatgaagaggtttttacaccttgccaagtacatggaaaattatgcaatttggccacgttgcaggatggagtggagccctctgtgctcacggcaagaccagcagtggagcgtagggtttgagcactctgtgaattctcgtcatgaccacagtagagaaaggacacagaaaaggggcgaaagagacagtaaaatggaaaggcacactgtgaacaggcgtttacactggaaggcctttgttttatagctgaaaacgaaatctactggccaagttcaatttaaattttagctggaggctttgcagaagacctgttgcagcagcgatagtgcaacatcattaacaaaaaaagaacaaaattggagaggaaaactatggaatagccaggaagcagactgaatgtcagcctcaatgaggccagaagaagcctcaacgaggccacagcagcacagagcaggggcaggcgggcacacagtgtggctcgtgcctggatcccccgctgggaacctggtgcccgttggctggtgcactgggccctgaccccctgagccgacagagtccaggtgagcacagcacgtctgtttccaggtgggaaaccctctgcctggctgccgccgtgacccagtagatctgagatcacaaccattacagctttctgggtgatgagggggacattcacactgcagaagagtaaggacatcccagcaaggtcatcctgcagccaagacccaggtcagttctggagaagctgaaggcgtgggaaaacccgccagccttgggaggctccccaggccccagagtgaccccgttcttggagcactggtcctttgtccccacagtgagagggtggaccccatcaccttccacagctgtgctgacacctgcccacccacccctcagccagagtcacttaggtggccaaggaaaaagtaacttcagatcccaaagtgtttcttccaggcccggaaggtgcaggaagcggccagccactgattgcccggctggcacctgcagcaatgatgctattctcactcagccgatttgtgagcagatttttctgattctttgattcttctttgtgagatttaaggaaagcctatgtgacagtgccactatcacctctccaaattcttgctgtctcctcatgtcaacatggagtgtgcagtgctaagatgtcttccacggctgggctttgcctccatatctgtgggcaggagatctgagccagtgccagatgtggacaaaactcaagtcagagcccagaggacggccctactgtcaatcagaccaggggtgccctgaccacaccctcttcccagaggacgaccctgctgtgatacagaccggggtgctctgaccctctggcaggctcaaggccggcctcattgcgggctgaccttccttcctcgtgtcctgcagctgcgtcccttacccttaccccaaataaaccaccttccctccatcctgacccgaggccctctcctttcccaggacaatggaggccggcaggtgagctctgacaggtgtgtttaacaaccatgggtgcaacagaggcggctttccctgctccctttcccgaggtgcagctggattcagagcttcccacctgcttgtgaccagcgtgcattctcgacatacacgcttcagaccaaatgtctgcttgttcacctgtgcgggctttgtgtgggctgctctgtgctatgcgggctgctctgtgcgggctgctctgtgctgtgtgggctgctctgctctgtgcgggctgctgtgtgctgtgcgggctgctctgtgcttgggaaaatgaaggttggcatgatttcctgcggcaatgccctcccgttttatgccttaataagggctagaaagaaaacattttcctcgagctgcatgcgaatatcgcccaaagtgcagctccccgcggaggccccgtgcacccttccaactgtgatgcgacagagatgggggaaaatgagttaaagtatgaggataatcggtaaagtgacacaaaaaggttgcaaatggcctcacttgaagcgtttgtattttaaaggtctcaggcaatgacagcgcatggaagttggctgggtagtttattctagacacgtgtgtttgtgactcagcctttcacgtgctgggttttaggagtcattattcatctgaagtagcagaaaagggatggcgtttcccccacgccggccagtcccttcccggtttttcatccgagcacttgctgtgggaggaacatttgatcccagcggtcgtggcgtcaggccgcctgctcactggagggaggatttccattagaaaatttcaaattcaaagttggaggcagctgcaccgagagtgtgagagataatgtcacccagacgtggcccctgaaagtaactcttgcatcgtgccttccttttttggaaaagggcactaccgtatgtgcttaaatggtgaattggacaggaagtgattcaaattcatttttttctccttcagatcatttaggcaaattaatatccaatagcacatatttcttgtccttctttatattctcactaaaagcaaagcaaggtagagacatcctggaatgctgtaatcttctctggggtaaaagcaattatggaaactggtattatcaggaaaaaagctctactaggtagtaagcctagaattccacttggaggttcagtaagtcagctcttgatatggctgggaaaggatgggaaaacttgctctctttcgtatattggaacttaagtttttaaatttcctctttccttttcttattttcctggtctgcccccaccaatgcccaccaagtgaatttgctaatgccatgtgtcacctcgcttaataatgaggattttgtcagaatacttacacacgcagctttctgggacaccatcccaaggtggggtggacccagcgactgtgagagtccattttcatgaagaatcctgaaaagagcctgccctgagaatcacgagatgggattttgtcttcggtcgtatgatcagctagccaggaagttacttaattttactagtctctgcttcctcctgtgaatccccaggataggcactctgtgaggaaaggggttcccaagccagcctttccccgcagctcagccccaaagcacgggacagagcctttgcatggcaggcgctcactaaagattccttgagtgaatgaaagggggcaaaattcacatccctatcagtcccacatcactctgaaataggccttcttagtggggaggtaaaaagaatttaagcatagaaagacagatgagacaaaacaggcgatatttgttactttgtacgtgagaggccaacccgttagaaaagcaagtgctccagcagcgagagcgatggatccgaaactccccgatcagatcagaagatactgtgttggccgcatgagcttcggtctcagccctctaagtagaagcagtgaagtcagaaaaagtgaactcagagctgatccactctaccacgttctcatgccagaaccccctggatgacctgttcaattcccacacaagcgatgacttctagagtttccaggtgaatgctcccaatttcccttcacaactgtacctgtttgccttggaatgcgtctgcttcatctgtggaaacgtagcctgtgaggacggagctctgcactccaagctcctggaaacaataacgtccctggacctccccaaggggtgtcagatggagccttccatgtaacatctgcatgtagtgttgtcatacgcctgcatttcgtgtaatgtctgcatgtggtgtggtcatatgcctgcattccgtgtaacatctgcacatggtattgtcatacacatgcattccgtgtaacatgtgcatgtggtattgccatatgcaagtattccgtgtaaagtctgtacacaaagtggtcatacgcattcattccgtgtaatgtctgcatgtgatattgtcatacgcatgcattccttgtaatgtctgcatgtggtgtggtcatacgcctatattccatgtaatgtctgcatgtggtgtggtcatatgcatgcattccatgtaacgtctgcctgtggtgtggtcatacacatgcattccatgtaacatctgcatgtggtattgtcatatgcatgtattccatgtaacatctgtatatggtgtggtcatacgcatgcattccacgtaacgtctgcatgtggtgtggtcatatgcctgcattccatgtaacgtctgcacatggtatggtcatacacacgcattctgtgtaatgtgtgcatgtggtattgccatatgcatgtattccatgtaacgtctgtacacggtgtggtcatacgcattcattccgtgtaatgtctgcatgtgatattgtcatacgcatgcattccttataacgtctgcatgtggtgtggtcatacgcctatattccatgtaacgtctgcatgtggtgtggtcacatgcatgcattccatgtaacgtctgcatgtggtgtggtcatacacatgcattccatgtaacatctgcatgtggtattgtcatatgcatgtattccgtgtaacatctgtacatggtgtggtcatacacatgcattctgtgtaacgactgcaggtggtgtggtcatatgcatgcgtttgtgtagtgtctgtatgttggtattgtcatatgaatgcattctgtgtaacatccacatgtggtgtcatatgcttgcatcgtaggggcctacttttgtgtctgaggagctccctgaaggaccctgcagctgggccagcagagagccatcatccccggtgccctactgtggttcaggtggtgtggaacggaggtgtggtgctctctgtcagccccgggccctacctttgggtccgtttgacttctctgttgctgtgatgcccatattatcagaacatgaaaaagtcattccactcaggatttgggactggccatggcacagttagcaaaaccaatggcctgagggtttttcaccctgcatcatggatcttgtaactcttacctcccttcgccctgcatggatcttgtaactcttacctccctttgccctgcatggatcttgtaactcttacctccctctgattccttgaaacagtaaccatagagtattcaaataattgccatgtaggctgccttctgccaactggaaatgtcttttcagaagctcacacaccctgggcaaatcctttcctctagaatgagtcccttgctgtccctacctgggaattccacttcagaagaggctctactgagcacttgggaaaagctcgcattggcatatttgctagtgttttccataaaaccaaaacgtttaagtagaataaatatccaacaaaaactaaattaagtgtatccatacacaggagcatatgcggttttaacttggtagcacatttgcttacagattttcatataatacattgttaggttaaaaatccagtttctgactgaaccatatgcatcatatgaccctgtttttgtaataaaactgtatttatatttacagtttgcaaatgtctatgtatgtatgtgtataaaaatatatctggaaggacacaaatcaaaattgaagaagcacttatatctggctggtggggttatgagtgacttttcactttcatttttaatatctgtctgaattctctagacttttaccatggccatactttatattttttaaaacacacacatgaaaagctaaacttagggaagaaagaacaatgagtcagactttcccatctgacatctgatgataactaaatcatttaggccaattaattaatagatgtagggaacatttgctaatcaccaaacttgcattactttttgacatttcaatacaaagtggcaagaaccacattgcttagtttgtctgctgtttggccaaaatggctagactaaaaatctgagttaaggtcattctgtgtgcatttttggctaatatgtatcacctcctatgataagaaaattatggaaaaattacttcacacatttcctgggtggtgggcactgaggcttctcagagaacactattttctacacatgttgatatcaaatgatatttgaatatttactacatatgtagcattgagatgcaagcttttcagatggttcctggacctttttcatttctgagaataagacctcgatttacgcagaaatgtttaatttgacagaatacatttcagaaacgtcaaatgggttagtctaggtccagccccactgtcatcctgaagttttcttctttgagttcaggatcacttggaatagaccctgaggctgcccttcagggactcggaattaatactcccatgtgctcagcaagtacaggcggcccggagtcgggtgaggtggctgtaaaaactctgtattagtcgtagaaactgcatgtttaaaagctgccacaagttctgtttatgacgggcatggcattactcccccaaccatagatgagttgggtcccaggcatctcgggtgacaatagaatgtagtggttaaaagcaagtctttgaagcccaatggactcaggtgtggattcggactcagctcctaaccacctgtactgtcttagacatttaaaacctcgcttcagtcttttatatacatattccctatgtaaaccaaaaataacattctaaggccccctaagcttctgaatgcacttcctccccagccagggctcttttaaaatttaacctgagagactgtttgaggcaatgttgggaagtcggggtcagacatgcctcatgatgcctctccggcattaacagcaacacagaccttaagtctgataagaaacatttacagcctcttctctctgaagcctgctacctggaggcttcatctgcatgataaaacttcgatctccaccaactcttattgcaacccagatgtttctttctgttgattccaggactttggacaaattcaaccaattgtcaaacagaaaatgcttaaatctatctataagctggaaggggcacccccccatccaccccccactacccccaaccccttccctgcttcaagtttttccacctttctggaccaaatcaatgtatttcttaaatgtatttgattgaagtctcatagctccctagaatatataaaaccaagctgcgccccgaccaccttggacacatgttctcaggatctcctgagggctgtgtcgtgggccgggtcacccatatttggctcggaataaatctcttcaaatattttacagagttggactcttttcattgacacttagttaaacatgtctactccacaagattgttacgaaaaatgaaaggaatttctgataaccacacaattgtcaggagcaagggaaacattctgtgaatggtaatcatcattattttagtgttgagaccctgcctttgtgatattgtcagagttgctaaaatacatggctacctctcagttctcagagagcctcacgtttgaagtagctgctagtaacagaggttgtcttcatataaccagatagacagggatcagagacaattgatctctggcctcacaaactataggaatctgagagaaaaagccacaggacactgcctctaagagggggaggtggaaggcaggaaaattcgctgtggggtgtctgatgcctgagagtcagagggcagtaaaacaaagggtggctgaaggcctttcctgcaaaccagaaaccagtgtccccagctagccatggtgtaaaccccgactcccaggaaggtccaggcccagatgccaccttctgtctgtgatgaggacgaggacaacgtctccacttttgcatgttccagctccttctgtcactcagtgtgtgtgtcaggtggtccagtatgtactagggactcttacagacacatgccaaccctacacatgtccctcttctcagcaatcattcctctccttcttcctttgcccgtttatacgttagttattgaactcgtggatcttagccccatttttcagtagcctctaaagactgttgcacttctacttctcagaatacttccgaggtcctcagaggacagcgtgcctgcagctcaggccaggccccttcatgctgggctccaagctcaccatggctcctaaccagacaccttgtttgtgccgctccagtccccatggcaggagcgactcctctctctcaccagtgcgaggatcacaatgttattgcttataaagcccttaagctctctttcaggtgagtttcaaatcgttatctccttacacccagcagacagatgtgagtccgctgcttggtgacatcatccttttgttagaagagcaccgactcacgtttctatagcaaatcgataacactatgtgacaaatccaaaatcgacaatggctatttcttagctttaggttttatttttcttcagagagaaacaagtatggcaaatatctgtgaatttctgtttaatctgatgacaaattaattaataatgataacaaatggttatctacttagatatgtaacgtaggcagtggaagtaatattttatccgaacattagaaccaagattttgtgtaagtgcaagaggacatagtctccaccccactgtgttacagatcaggaagttggaggtggctcggttacagggttaagttacatgcacgtcacgcagccctgagctggggaaaccaagaacaaagcccctatgcttgctgggccatcccaccccctcacattagatttgcttaaagaacctgccagaggcttcgtctggaatagcacctcggtctcattcatctctatcacgagtttctgcattttgaccatgagcctgttccaacatttcagattctccactcatcattaaaataactttattccaaccttgcagcttccaaattaatactgactctttccttatcagaaacaagcaatgatttagagtatcactgaaataaaatcaaaatgttttaccttgaggcttaattctctctaaaatctagtcagatgctccccatcccagtttcaccattatatcagcacaaatcttgaacatttcattttctaatctgtcatccttttaatctcctattttataaatgctcttttctgtataaatggcctgcatattataaacagtattgaatagcttgtttctttctctaatcaacctgatctgtctactcaatatccacccatgcatccatccatccatccatccatctactcattcattcacctattcattttttaattaagcatttcattaatttattcagcacttactatattctagacagtatcctggggatatgaagatagatagatagatagatagatagatagatagatagatagattagagagagagagaatagatgataggtagataattctttgtcactatctttaaggtacacaaaattttgtaggagagtctgagacatacaaacttcttataatacaatgaatgtatttggtgcaatagagcaaaaatagggtcaggactttatgactactaagcctcacaggtgttttgatgcctatggaatcaccacatataagtcccactaattcagtcgccatttgtgactaacgtgtccaatactcagtaggaaagatataaaagaaaataattagagttccttaatatctctttggtccaccagcaggcatccatgtttgtgatcttctgggcaattttcagacctgctggcatcacaagttcctccaaccagacttggataatgggtcaatcagcaagaagcacttttcctgagcccaagttctaaaacctccacagcaacagccctaatgaaaaatgtagtatctcccacttctcctttctattgcctttttgtttggttttcacaggaatctatttctgagtgtttgctgtaggcagacactttcctcatctccacctttgattacgagaacagcacagcccggtggctgcccggggggaggtggtaggcagggtcagagtgcacacgcgcgtgtgttcatgtgtgctgtgtacaggtgctgtgagggtccaggaactgctggctatcacagtgagcggtgacacaaaggcctgtaattctatgttgagaataatatttccagcctagaactagcagtctggctggaatgaaatacacagaaaatagtcaggatagtccaatctatgtctgagcctccagatttaaagatagtttatatccacaaatacatactgctatgtctttttacctttccattttcacagctagctgccaatttaagtaagcatccttgctttagttaagggctttagtaataaaataataataataacttcacgaacaggaagagattctataaatcctgagtttcatgccaggaaaccaccccagaaaacactttttgtactaatagctgtaaaaaaaggtcaggtacctgacttaaataattgctttcctttttgtatgtttgggggaggaggaatttctggttctacttgtaacacgtgcatatgaggttacacaaagatttctttcctggaaaactggaaataagcataatcaaaactgtaaaatgatcaaatactggtgcaattattttcttcaggaatctcacgatttcatctgcgggagtggatctgaaatctaaaatctgaaaacatttatttcactttatgattctttttattccacattcttctctaattttttccttgactgaaacattggtatctctgtttctcatggtctctcttcgcctcagccgtgcagttctgtgggtatctagggggccttttcagttcaaagtacatcagcagcccgacgctggtggtccacgttttcctgtcggctctgtgggttgcatctgtgtcctgttacctcggaggggttgtatgtgcgtcctgagaggaagacagcctgggaagacagggtggcttgcagaagacgcccaccatttgcacagagctagccgaggcagctggcctgaacatgtgtgcatgcgtgtgcgtgcatgtatgggtgtgtatgtgtatgctcatgtgcttgtgtgtttatgtgtgtgtatgtgcgtatgtgagcatgtacgtgtgtgcgcatgtgtatgttcatgtgcttgtgtgtgtgcgcgtgtctgcgtgcgtttatgtgcgtgtatgtgcatgtgtgtgagcgtgtatgctcatgtgcacgtgtgtctgtgtgtgagcacgtatgggtgtgtgtgcgtgtgtgcttatgtgcgtgtgtgcatgcatatatgtgcatgtgcatgtatgcacgtgtttgtgtatgtgtgtatgcgtgcatgtgcatctgtgttgaggggctgttgctcaggaagcgagggacagggcatgtcctaggtagagacagctttctggggaaagccttgttctaaggcagcagggcggtcttgcacttgcgcggctgctcctgggatttggaaaggacacaggtgggaagttggagagatggcctggggcaggtggggtaggtggggcaggtggggcagatggggcaggtggtgcagatggggcagtcattaacgagcatgcctggaaccccatccctagtcttgtagaggaggcaaggagctgtccaactgtctcttaagagtggcacagtcagtgctatggtttggaggtttgtcccctccagatctcatgttgaaacgtgatccccagtgttggaggtggggcctggtgggggatgctggggtcaggggtggatccctcacgattatcttggtgctgtcctcctggttatgaatgagttcttgctctgtgtgttgcagtgagagctgattggtaggaagagcctggcccctcccaccgcctctcccaccacgtgatctctgcacaggccgctcccctccccatcggccacgagtgaagcttcctggggcctcaccagatgcagatgctggtgccacgcttcctgtacagcctgcagagccatggctgcacaaacctttcttcctcataaatcacccagcctcgggtgttcctttctagcaacacacacggactgagccggatgacatgaagcagctgttcccgcctcctcctggcacctccctgactcacgcacttggtgcgtggaggggtcgtgagcgggcacaggcagccacttcgctgcttgcctcatcagcctcacagttccccacaggtgagtcctggcatagaaacatcccctgcatcttaatttgcatttgttaataattatgtgaaatagagaaaataacttatttgtgcacagctctgacttccaaacgaaaccactccagctttttggaagcttccgcatttggggatgatattaaccaagtgaccacagacgagagaggcactgcccttctctttaacccagaaactggtcaggagcctgaggagaatgacaaagggaaagaattcttacaggaacttctccctccgcttccctcagtttaaaactacagtgctcgccacagaatctcacttccaattccttgtggagaactgcttcttgtacttatcgcatcctcatttacgatatgactctgctagtattttaaatacatgtctagcgttccttatagagacattctcatccccacatagatcggtggttatgagggagttttctttcctatgcctaggattctgttttgatgatttttacggggtttgcttacagtagtaactcagcaaactgcctgatgatatttaaaaacttcttcctccttgattttcattttaaatcaagcaaacacaataatccacaaaaactaaattaaaatcaatgcccttaacatgactggcaagaagaatgctgtttctgttgtaagaagacttgctatacataacaggatgattagaaagacttgctgtaaaaagacttgatatacataacaggatgatatacataacaggatgattagaaagttaaaaatataatattgtgagatgctatttggtttggtaagacgggggtcagatagtctatcagaataattttcttccgtttgatcacacatctcatcagaggagcaggagagccgtccagcgtgagatatttgaaggggtgttggcaagaacatcagatggacgacaggggagaggggcccagctgcacggggagaagccgatgagggatgggtctttgctgtcatcaacattcataaatttatcattctggatgcacaaattaaaattattcactaagcaagaatgccattgaactgaacgttataaaaatcctggagtaagtagaaaaatgccaggctgatatatctgtgcagtaagaggcatataattctgcctccatcaataacagcccccacactttatggactcccctcttggaggtggctgtgaataacccgaatgcatgtgcagcctctcgacaaactcgtgtccgcggctgtgggctacgttctcgccaatggctgtgtcttcggccaacacacctgagcttactgcattaatgttactgtgcgatacagcagctccgcgcctcctgtgagtgcccgtgttcacttcctaaactgctggtctacccagatttttaaagggacatatcaaatactgttcctccatttctggttcctttcaagctgcgttggtatcgatgtttggaacccctggccacatttcatatttatgtaactgatctgacagtgcacgtgaatctatgagcagttacttattgagtccctgctgtatgtgaggctctcaggaaggacttatggatgcgccaaagtactgctgatgataatggtgtgaggaacacacttttactcctgttttatagaggtaaaccgtggtatagaatttcacgttacttgtctgaggtctttggtcatcccagcagcgcccggtgtgagccctctcaagttctccatggttttcccatcacccacacccctcctgtcatgctggttgatggcactcttgcccgttgggtgagaaagccctttcctggacaggtgatgccctttgtagtgaaaacagttagatgctgtcatgtttggtcagaagctgaaccacagattttagaatgaggcaatgatggcctgagagggaagtggattctgttgacaccagcagaatgtgtggaattgggattttgaaagtgtatttacccagtggcatgtggtcccaagcgggatctgccctctatgagctccagactggactcgtcctgcccctgtggtctgtcccttcctaggttcccacggttctctctttccccacaatgtagctttgctttggactagtttttgggacaagatgttgcttgtgaggtgggtctgactgcaggagccaagcagcaccaccccaacaaatcctccaatcagtccacccaccatgcccaacaccaatcctccaatcagtccacgcaccatccccaacacaaatcctccaatcagtccacgcaccatccccaacacaaatcctccaatcagtccacgcaccatgcccaacaccaatcctccaatcagtccacgcaccatccccaacacaaatcctccaatcagtccacgcaccatgcccaacaccaatcctccaatcagtccatgcaccatccccaacacaaatcctccaataagtccatgcaccatccccaacacaaatcctccaatcagtccatgcaccatgcccaacactgcgagtcccccacagattgagggggaagattagggaaggcgaggacctgagaaatctgactccctggggtcatcagcacccacgagacatctgcctgaatccgcccctgcacagtagctatggccatccttggccctgggccccacacccttccactcttccgatgcaacgtcacctctcctgtgaccccttccatagttttcccctcaccgacacccttatcaccagattctaaacattttcaaatctcccccatttaaaaaatagcccttgttggagcccctctgcccctgcaactcagtagcttccacgggagggggaggcttccccaggagacagaatgatgtcagcagaaactattggttgtgagacttgcgggcagtgctgctgcatgtagagggcagagttcaggggcacgcgcagggcaaaggacagggtatctccaccaccagtgcatggctgggaagccgctctctgctcccctgtgactgcgggcacacgtccactgccccctgccaccacggacacccatccactgaaccctgccactgcagggacccattcactgcccctgccactgtgggcacccatccactgctcctgccactgtgggcacccgtcaactgtccctgtcaatgtgggcacctgtccactacctcatgccaccatgggcgcctatccactgcttctgccagtgctggtacctgtccactgcccctgccaatgcgggcacccacccactgctcctgccaccttgggcacccgtccactgcctcgtgcctttctcctctgctcacctgttgcccctgctatgggatgtggagcatgcagccgagttgcccgaccgaaacgcccctctcagagctcagtgagggtctccctcctggcacccaggtgaagggacattgttcagacctcatcctgcatggcctctgccccaaggcctcccacacccacaacattccctcctcctgaaacacttgcgtcctgggtttcctcatccagtttccaaacccagcacccgggccacagtcacttcgtcctcctttctccagcctgccaggtcctcgtgagtgcgtctcactgaattctctctctgcacggccactgcttcagccagggtcacgtggcctctgtgggagccacaggacgagactccttgcggcctgctcttcatgcggagcctgagtgggcttttctgttcatcagcctcgtccgcccctgcgcccaaagccctccatgcacaccgaccgcttgtcggtttctagacaagatccgtttagaaacagtatgtgggcaccccatactctccaaactcctctcaagtcatggcccacactctccctgctcacggcatctctgggttctctctccagctcactgaacttgtttcgcatgtatgcctttgccttgaggcttgctccccttcaactctggaaacccacttgtcactcagcactcaggtctcagcactcagcactcaggtctcagcactcagcacccagcactcaggtctcagcactcagcactcaggtctcagcactcagcacccagcactcaggtctcagtactcagcacgcaggtctcagcactcagcactcaggtcagtcgttgcttcttcggcaaggtcggccctgagcatttctgcctcccattaggttagatcctcgaatgaggcttttggacaagccctgcgccatgatagctggcgatccacagcctaccatgtgctccaggatgtcctgcccgtgggccacccataggttcgctgagtgcctccccctctactatgtcccacgcaggcagtgggcagagtaaccacggaatgatctagtaaattagtgagtggccgaacaggtcttgcctttttgggagtgcaggatcatttcacaagtcgatcccatcaggacaaagcgagtgtgcaggctgctgcatgccaagggctcctcctccaggcagcccttcgcgagaggcatggccaattctccaaagattcaaatctttctgggcctctggctgttgacagttccttaattaaaaatcctccttccagcccccaaatggataccaatctacaatattccacaccaactgcagctcagtcaagcattttactcattgcagtgataactgtgcaggctgatcattgttacagccacacagtaatagtgctctagagactgggtgcggtggctcacgcctgtaatcctagcactttgggaggccgagtgggtggatcacaaggtttggagtttgagaccatcctggccaacatgatgaaaccctgactctactaaaaatacaaaaattagctggatgtggtgtcaaatgcctgtaatcctagctactcgggaggctgaggcaggagaatcacttgaaccccggaggcggaggttgcagtaagctgagattgtgccactgcactccagcctgggtgacagagcgagacttcatctcaaaaaaaaagaaaaaaaaaatagtgccctagaattccagctttcctcctaacaacacacgtggtccacatccggtgtctgattcccatccccactggaagttcctccggcattctgtgtattttctgtgtgttgttttcaaaaaaacaccatccggtattgtaggctgcaaacttacatcaaatagtttcctgcctgtgatttgaatcagagcaaaacatccctgggcacccaggcactgtccccgaagaggtaattattggtgctcccactgcgtgctgcctgcaggtgttttcctgtatcagcccgcaccattccctgaagacagacggttctgtgatgctttctggatggcgttttcctgtatcagcccgcaccattccctgaagacagaccgttctgtgatgctttcccccttgaagacataatgtctatctctaattcccacactgattttctttcttttaagaaaccaacaaaaccagcaccaaaaacagctgttgaccctcatcatctgaaagcgtgggaaccaactttcccccgtgatctcccgctctgatcttcatgacacctggctccccgtgtctgttcatggggccttcggtgtgggctcctgtttgtggagcctcagtggcccgtccctgtgtccttctgctgtgggcctgtagctgggaaattcaccccctggcattgaccaggggaaggtgcgattccctgtggagttgggaagtggctctcaggggtcaggcattgggtgctgccccagtgcatgttatgggcagctgtccactgcgtgcagggccagtgagacaccaagaggtcatcacgggcctcttctcatctcagtgccagccgtgatgatcagaaacatttctttagggggatgtgaccgctggctatggcgccgggactcttctcccagtgggtcaatcgcaccttcactctgggcaggtgagggcacaggcaggagcctgaatgtgcaggtgcccgcaggcgaggtggagaatgggcgcttctccaggaacttaaatcttgataatgaggcccatctgaacccctcaggctgccccaggagcctcgcctcacctgcgggcatccagcggtgtctgtaatgaccctgccctgaaatgaaggggaggaaccgcatcctgtgtgttactccaggggaaggacagggtaggggccggcctccaccctcctcgaagcaaactctcattagatgttcctactgggccctggagagtaacgagccagctgattactgtctctagtgtaaacatcacctttttttttttttttctgagatggagcctcgctccattgcccaggctggagtgcagtggggtgatctcggctcactgcaacctctgcctccctggttcgagcgattctcctgactcagcctcccgagtagctgggactacaggcgtgcgccaccatgcctggctcattctttttttttttttgtatttttagtagagatggggtttcactatgttggccaggctggtctcaaactcctgacctcgtgatctgcctgccttggcctcccaaagtcctgggattacaggagtgagccactaccaccttttaatcacgaccaaacatcaccttttaatcacaatcctgagaggtgtgaccctggcattgccacgtgcgagtccccctaggaaaccaaggctacgctgggagcactgtggggctgtttagggactcaaggccatgccacgtcctgactctgcgatgcctcccaagggtgagcagtgggttcttgcctttgccacaaaagatgctgcccttgggaataccaggatgagttaatgatttctgagcatatttcctaaactatgttccaaagagcaccacagctagaggtttgaaaggaatttaggaaagatcttacgcatattccatttcctcctcggagtaacatcagcgtatgaaatgcccagacaagtcctgtgcggaagagaagcacccaccctccccctctgtcagcggacgggaccctcatggccccaagggaggctagtccacgttcaccacacacgcattcctagaagtggtttttaacgtaatcatttaggaatatttttgtaaataattttctgattatcaaaaccataattacaggattttaattattttatggatatgcaggttgaagagactgggttttgatgactttgatgggggagggagggagggagagagagagagagagagagattgatttagtttctgaggagacaaacactagggttaagaaggattagaaggcgattttcctgcattgaaatagtttttttttttttttttgagaaggagtttcactttgtcgcccaggctggagtgtaagggcatgatcttggctcactgaaacctctgtctcccgggttcaaccgattctcctgcctcagcctcccaagtagctgggattataggcacccaccaccatgcctggctaatttttgtatttttaatagagacgggggcttcaccgtgttggccaggcttgtcttgacctcctgacctcaggtgatccacccaacttagcctcccaaagtgctgggattacaggcatgagccaccgctcccggcctcttgcactgaagtccaaaggccagaagaacccggaggctttcggcgtttccgcctttgccttccgatgtccattcccatctgagcagtcatttctgcttaattccgccattacttcctcccttgatgcttctgaaactgtctcctcagcagatgatccctgcattagttggcggagctgatggtgttccctgttttaccctgtggtctcatttccggatgctgctaccaatgcccgtctctatggctccctgcccacgtgtgcagccccgtcactgagagggaagtggctggagaggtgtccagatcattgtgaatgaagtcatctgtgaaaccatgggagagagatttgatatctgcttccctttcaaatgaaaggaaaagagtggggtgagagagggcggcactccccagacaggccctgaccacaccctggccccacgcctcagcagaacaactctgaacctctatggactcacaggggcgaggtcggggcaaggagactcagggcctgcgctgctcaccgggtgagaagtcacagctggttaggaggccacaggtaagcagaggtgcgagccaccagggacggggtgagttattcacaggtgaatgagctaggacgaggcaacagcacgcaggccacgcctcgccaacccatgggtcctcaacaggattttggtgacacgcaacacccctctggctcctgctctgatccatgatggtgagggaggttcccacggtcacgcgtgtgctgggattctgctctttacgccgtccccgggcaacacagacatcagctcttctctcctccagctgagcaaatgtaagctgtccaggagaatccatcccagctgctaacaaaatcttcagacgagagtcagtctgattcggagtggaatgaaatgagcattcggcaatacctccgtgtgccagtgcagctgagttctcggtaaacacaatattccgaggtgatactgagctctgcgtcctcagattaaatgtatctccttcttagatttgctcgtgcactttacggcttctgcaaatgacagcctcggcgctgcaaagtaattccacactgtcatatttgtctttggaaattgtaacaaattatggtgatttataacatcaaactcaactcccatttttccccagacggcaatgtcgctgatggcgagattccgggccatccatttatcctgtgtggaggctgacagggacgcatgcctcatctgctgccaagacactgggttcccttgaggggactctgtcgacataactcaccctgtcccgggtggctcgcacctctgcttacctgtggcctcctaaccagctgtgacttctcacctggtgagcagtgcaggccctgagttcccttgccccgacctcgcccctgtgagtccatagaagttcagagttgttctgctgaggcgtgggggccagggtgtggtcagggcctgtctggggagtgccgccctctctcgtcccagtcttttcctttcatttgaaagggaggcagacatcaaatctctctcccatggtttcacagatgacttggaatcctggccttttaggatagaaagagaacacagagatcccggcccatcaagcaggccccagaaacatgggcagcagcaggagagtgcccaagctcctggcagggtgggtccaaccctgtgtcgtgcccctgattcaggcgttgaagcctcaactccagatgctggcatgaggaggtggttcctggggaggtgatttgggttagatggggtcctgagggtgaggccctcacgattagaagagaaagagaccgggctcttgctctctgccacacgaggacacagaaagcgccatctacaagccaggaaggggccttcatggcaatcctagtgggctggatcttggtctttggtttccagccttgagaactgagaaataaacatttattgtttaaactaaaccaccaaatctatggtattttgtgatagcagctgagtgggctaagacaccttcctcccagcacagtgtcacccaaaaaccttgaggcttctccatcagcaacggactgggaaggcaggtctgcacctgcgtctccacgttccacttcacatgtggcatctggcaccggacggtggccgcctcctttcagattactcacggctctagaatctagcttatatgtttattttctgaatgttgtaactaggactctggctctagacaggcaaaatgttcccaagaaaaatgagaaaataaaaattgctctttttcaatggggaaattgttccctatctaataaatggtgctgggaaaactggccagccgcaagcagaaaactgaaattggactccttccttttacttatacaaaaattaacttaagatggattaaagacttaaatgtaaaaccccaaaccataaaaaccctagaagaaaacctaggcaatgccattcaggacatagtcatgggcaaagacttcatgacgaaaatgccaaaagcaattgcaacaaaagccaaaattgataaatgggattgaattaaactaaagagcttctgcacagcaaaagaaactatcctcagagtgaacagacagcctacagaatgggagaaaaattttgcaagctacccatctgacaaaggtctaatatccagcctctataaggaacttaaacaaatttacaagaaaaaaacaaacaaccccgtcaaaaagtcggccaaggatatgaacagacacttctcaaaagaagacatttatgaggccaacaaacatatgaaaaaagctcaccatcactggtcattagagaaatgcaaatcaaaaccacactgagatgccatctcatgccagtcagaatggcaatgattaaaaagtcaagaaacaataaatgccagtgaggatgtggagaaattggaacacttttacactgttggtgggaatgtaaattagttcaacaattgcagaagacagtgcaacaattcctcaaggatcaagaaccacaaataccatttggcccagcaatcccattactgggtatatacccaaaggattataaattattctactataaagacacatgcacacgtatgtttattgcagcactgttcacaatagcaaagacttagaaccaacccaaatgcccatcaatgatagactgaacaaagaaaacatggcatatatacagcatggaatactatgcagccataaaaaggaaggagctcatgtcctttgcagggagatggatgaagctggaaaccatcatcctcagcaaactaacacaggaacagaaaaccaaacacagcatgttctcactcaaaagtgggagttgaacaatgagaacacatggacacagggaggggaacatcacacaccgggacctgtcagggggtgaggggtgaggggagggacagcattaggacaaatacctaatgcatgccggtcttaaaacctagatgacaggtcgacaggtgcagcaaacccccatggcacatgtatacctatgtaacaaacctgcacgttctgcacatgtatcctggaacttagagtaaaaaagaaaaagaattgctttttttaaaaaattgaaagttcagaactgcaagcagtagctcctcctagagcaaggtggtgaagggctcaagttggagtgcttctgagacacacacagatgacacagaggcctgggggatctcctttagaggctggatgtactgagcacctgcctgcctcccttcccttccctgtcagggccaatgccgtgttcttgcatgtgtccagagagcctggcagtctctccagtgcctgcgtttgtggctgtggctgcaggggtcgcagacctctgggaaggagggagcccgtgggtctgtgccggctggtgggtgtcccacaggggtcttgatctgggactggccagactgcgaagccccttccagagcacaagccggaggggtctcctctgatccctccttcaccctctcctcaatttgcattagacacaggggatccaggagtgagacaggacatccccaagcatctggtagacgagagagaagtgggcagctgtggcagagcccagtgtgagttatctcagaggatcacgcggcccccagaggacatgctggacgcacacctgacccagacctgcgggaagagtgagaggcatggaggccacagggcacttggaggatgggcatcacgtggtggacggggagcgttctgcccatggacgtggcctgggtgagggtatagtaggctgaggccaggcatgccgaggggctcgaggtcctttagtgccactagaggacgtcacaacgtcggggccatgggagtcgaggacaggaactcagcagaaatcagggcaggagaagcctctgctgcccatgccgcctgaccctggctgctgccgcatgcagtggacactcagttccacccctagagggagagtgacaggctctgcctgcccagaagttcacactgcacggcatcccatccaccctcaccgaggcctctctgcagtcctgtgggtctcagagggtgcaggcgtcattctcacgacaggtgaggggtctcaggccagagagggcagagacctgcctggctccacacagcatgcacgtcggccctgggatgtgagtctctgcatcctacagccagagtttcctctaggagactgtagcggaggggaggcaaggccagagcgggtataacagaaactccaggggcagcactctgggttcaaagccggccttaggatgtagctgctctgggattatgcaccttacttaacatttcctgaatgccttgtctctcgtttatttattttttggttcagcagtgcaacagatgtgctacccacttgctagtgagcatgaaggggcctggagtccttctctgcctaagccttgcaggtgttaggcactcactccacagcggctggtgccattttctccatgccatggtctggtctgatgcaaacccatcgaccagtgctgtgtgcctggcttccaaggctacagaaaggggacattgggcctgttggtgttgaagtgcaagtaacctctccgggactaggctacctatggtggtctcatttctctcaaacaggaaatgaaacacaactggcaaggtagagggtacaccggaaattggggaggcccacccatggtgtttggaaccctgaagttgcccaggagagctagttattgccttcactttgcgagggaatttaaagcggcatgctcctgtttgacaattttgcttttatttacaggggctggatcaaacgtatattttatgtgataagtggaaagtgtcaaaatgagccacacataaagtggtgacaaaataattcacttcaatgaaattacataatgtaaaacaaaatcttagaaacagcccccgttaaatatgatttgcatgcaacataacattatacaatttttgacactctgcaaagaggtattgggtcggaagtagctatgtttagaaggcaatttgcagaatttctgttcttttagtggtttgaaagcagtgataattttttttttcttttggtggttgacaagtgaacaaaaaccaataattgaatagcaccattttacccagaaggcaagctgataattagaggtgtaagagacagtttggattttatctgaatcgtggcagctctgacttgtttttaaaatctgggaaccaaatcaaggccccgattctcaacaatataagaagaaaacaggattttatttgcagttgctcgttcttggctgacacatgtgttttggtccctaaagggcagcccgtgggtcctgagatgagcaagtccacatctgatttaggaaatgaagagtttctcggtggccaacgtggtcaggaggagaatgaaaataaactcagtctatgccaccgagggcacgtcaggcaacagcccccgccctcctggtctggctgcctcaaggaatgttccagggcacgtgagtctcacctgcggccttagaaggtagcaccccactcagacgcaatttgaaccccatgatcacagccgcccagaccccactcagacgtagttcagaccctggatcacagccgcccagaccccactcagacgtagttcagaccctggatcacagccgtccagaccccactcagatgtagttcagaccctggatccgtccagaccccactcagacgcagttcggaccctggatcacagccgtccagaccccactcagacgcagtttggaccctggatcacagccgtccagaccccactcagacgcagttcggactctggatccgtccagatcccactcagacgtagttcagaccctggatcacagccatccagaccccactcagatgtagttcagaccctggatcacagccatccagaccccactcagatgtagttcagaccctggatccgtccagaccccactcagacgtagttcagaccctggatcacagccgtccagaccccactcagatgtagttcagaccctggatccgtccagaccccactcagacgcagttcagaccctggatcacagccgtccagactccactcagactcagttcagaccctggatcacagccgtccagaccccactcagacgcagttcagaccctggatcacagccgcccagaccccactcagatgtagttcagaccctggatcacagccgtccagaccccactcagacgcagttcagaccctggatcacagccgtccagaccccactcacactcagttcagaccctggatcacagccgcccagaccccactcagacgcagttcagaccctggatcacagccgcccagaccccactcagacgcagttcagaccctggatcacagccgcccagaccccactcagacgcagttcagaccctggatcacagccgtccagaccccactcagacgcagttcggaccctggatcacagccgcccagaccccactcagacgcagttcagaccctggatccgtccagaccccactcagacgcagttcggaccctggatcacagccgtccagaccccactcagacgcagttcagaccctggatcacagccgtccagaccccactcagacgcagttcggaccctggatcacagccgtccagaccccactcagacgcagttcggaccctggatcacagccgcccagaccccactcagacgcagttcagaccctggatccgtccagaccccactcagacgcagttcggaccctggatcacagccgcccagaccccactcagacgcagttcagaccctggatccgtccagaccccactcagacgtagttcagaccctggatcacagccgtccagaccccactcagacgcagttcggaccctggatcacagccgcccagaccgcactcagatgtagttcagaccctggatcacagccgtccagaccccactcagacgcagttcagaccctggatcacagccgcccagaccgcactcagatgtagttcagaccctggatcacagccgtccagaccccactcagacgcagttcagaccctggatcacagccgtccagactccactcagacgtagttcagaccctggatcacagccgtccagaccccactcagactcagttcagaccctggatccgtccagaccccactcacactcagttcagaccctggatcacagccgcccagaccccactcagacgcagttcagaccctggatcacagccgtccagaccccactcagacgtagttcagaccctggatcacagccgcccagaccacactcagatatagttcagaccctggatcacagccgtccagaccccactcagacgcagttcagaccctggatcacagccgcccagaccgcactcagatgtagttcagaccctggatcacagccgtccagaccccactcagacgcagttcagaccctggatcacagccgtccagactccactcagactcagttcagaccctggatcacagccgtccagaccccactcagacgcagttcagaccctggatcacagccgcccagaccgcactcagatgtagttcagaccctggatcacagccgtccagaccccactcagacgcagttcagaccctggatcacagccgtccagaccccactcagacgcagttcggaccctggatcacagccgtccagaccccactcagacgcagttcggaccctggatcacagccgcccagaccccactcagacgcagttcagaccctggatcacagccgtccagaccccactcagacgcagttcggaccctggatcacagccgtccagaccccactcagacgcagttcggaccccggatcacagccgcccagaccccactcagacgcagttcagaccctggatcacagccgcccagaccccactcagacgcagttcagaccctggatcacagccgcccagaccccactcagatgtagttcagaccctggatcacagccgcccagaccccactcagatgtagttcagaccctggatcacagccgtccagaccccactcagacgcagttgggaccctggatcacagctgtccgtccgcccgagcagattcttgtccaggtgtttttccacttgcagctccgcgctgggcagcttcaggcctgttacagcgacggtgcggcttccctgcctgggttgttgggacggaagggattccaccctggggcggtgtggggtggcttccctgctctccctgctctctgcgttcccacggtgcaggatggcggcgttgagagccagaaacgaaaccctgagaagcagaagccgggcgtcctgcccgccctcctctaccaggcctcatctggagggctgcgccaggtccttccaacttcaaagagttgcctgtgaagggcgtcctccaggtgggtctgcagtgcagtcaaggcctcctgcaattaatatgctgggaacacattttaaatagctccctcctcccttgaatagcagacggggacaacaagcctgttattcagtattccatttttgatagctcattgtatctaaaaagagatcaattaaagctctcagaaagctctccagcttaattgaaggacaatttagacattgcagtaacggcagatctgccgtccattgccgcatttattcgggctgggagctattggcgtctcccacacaccctcgcagatgaagagatttcaactggaaaggaaacgctaccatcagaggaaagataaattgtcaccaacttcattcttcaacggataaagggagctttggaaataaaaaatagacccgaaccatgatgtggtggaattatctgtgcctgtgctctcctgagcagccgggcctgcgttccttcttcttccctgtgaaggggcagcgctgggcccgcttattagtgcaacagcaaagactcattaagtttacagcccgcccgtgacgtgaggcagctctggccagaaatctcaagttcatcccatcaagtcaattttgtctgtattttaagaacttatctcttgcaaaatgggaccttaacatgtttgtgatggtccacagatagctcttactgaaagcgagaatggcaggtgaccaaaaaaaaaaaaaaacaaacaaaaaaaaaaacacacaaaatggtgacctcagggacgtgatgaaagggcaatgatgacttcactgtgtgttttcctgaccgtggagtagagccgtcccaggcagactctctgggccctgctcaggacggtcatgaaaccccatgctcttgttatgtgaatattgaaagcaacgccagggtctgggagggcagtgggatgagcctggcctggggcaggtggcaccagggctgctgagtttccaggggcactggctggtgagtggccacagcccctcccgttggtcaccacctggtgggcagcagcatgaagcccccgggggtgcggagtgttgggctgtgtgccaccttcgggggctctgatgagcagctccactccttggcccagggcaggcttctcaggagcaggcttgggggtctgtggcttttcacacgggacgtggactagctgcttgcctgagagaccacccttctggattccagaggacccagccagagtcgtcacggcagggtctgcagggttggagaaggctctgttggggccgggcacagcaggtggtggcaggaggataatgccggggcctggacagggggtacaggggcgggaatggatgcacaggtacagaccctgctcttacgtctaggaggcgggtatagtcaatgcgatgtgtaatgtgtacatacagtgtgaaatgtatgtagcatgtaaagtacacataataaagtttatatgatttgtaaagtacaaatgctatgtcaagtgtacataccacataaagtctatataacatgtagggtgtatatgatatgtaaagagtatgtaatatgtcaagtaaacaaaatacgtatggtctatataattcaaagtgtctacattatatataaagtctacatattaggtaaagtctatataatatgtgaagtctataatagcaaagtatacacacacacacacacacacacacacacaatgtcccttgcagcaggaatgtggatggtccctgggaagtctggtaggcttggtgaactgacttttgctgagcacccagtaacaggagttgaaataccagctccatctctccacttgtctcacagctgctggccttggcattctgagcctctgtgtcatgcggtgccacttcattctgaagagtgtgtagcacagtgcagccatggctccatgcttcctaacgagtattgatcccactagggaatattttcagaaccagatacagtgggtgcaattcacaccagcatccttctctggaagactagctacatcttgcacttttcttccattttctatctttcttatgtttaaagatagttcaaaataattaaaatcagtgtgatctgaacatttgggggatgtttgtaacagtaaaccatagattctctgggatataagataaaggaaaacaagtagaacagaaatgagaatggatttccttgtacacaaagttagaagagagtttcagtgagctcccgcgggcagtgaccttgactgcgaattttgtctcttccctgactttttcctccccttcctccccttcccttaaggaagatggcctcggttagccaggaagggtcctcgtggagctctgggaatgctgtggccttagcagccaaggggtattacctgttcgtgggtgtgggcagccttggcagggatggcaaaggggcctatggtgactgtgctgcactccatgaaaagcaacaaggaagccccaaggtcagcagaggcagaagcgcagtgagggcgcacggggcatgtagtcagtgccctgcactctctagtgttgggagcagtcagcagaacggccagtgctagtgggcaggatgagggaggctgcagggagcacagatttcaaactgacccaacagtcccatagctttttgaaatgaacagagaaatggacccttctggtcttaaagcttgaaaattacatttgctttatctgagtttcttcctcaggaaatgacccttagtcctttaaaaaaaaaaagaaagcaccaaggagctgaaactcaccagatcactgcatcggaagagcaagacaccagccccttgcctgccttgactgcctttgtgaccacctgctgcctgttgactgatggctccccctaactctccctggttcctgttttcccacacatggttacatttcttccctgctacgtgaactcccgattttagtcggtccaggagatggatttgagactgagctctcctctcctctgcgtcagcagtactcgtggtcccagtgattggctttccgtgcagagagcagcaggatgtaggtcaaaaccctggtgtttcggcaacaggttcctgcacttacagaccggcctccacggggtgggaaggctctcccgtgcttccgttaccactgttgaccagctctaaaattaccacctgcaactcgcagtgaaaaattctgcctgtctgtcctgctcctgactttgaggagaaatggtgaggagatggggacacagcctggggacactgtggctctccaatcacaacactgccaccacaagtcactggagaaggggcagcaactctccgtgtcctgggtctcatctgagacaagagtgccaccctgtaccaggcatctcttgccccttaaggcagatgctaaagcctttgcagaaaggccacgtcccggctggaggatggtaatgatgtttaggagatcacagctgggcaaagggtgaaaacaacgctgggaggtcgaaaggctgcagaacccattacccatctcccgatagccattccgatggaaggccctgacaaacgactccctgcaaagccggataagccctctgcatccatcggctaatgccaggcaaggcgggaatgcgatgagggctggctggaggcagggctgccaggaagggagggtctgtgaagtgcgaacacactcactggttttggggaaagggtgaacaacccagtgagcactgcatgttaggaacaggtcagtaaacacagcctggcaggagcagacagaagccattcgtcgagagcgggacgcgggtgggaggccttggctacacagacacaggacctgaagataagatactgtggcctgtcggtcaccactctgtgtgcatagcagtgcaggtgacatcattacctttggggaaactgggagagatgctgcgcaggtgtatacactgtggggagggggagagaggctgtgcaagtctatgcactgtgttgggggcagaggctgcactggcgtatgcactgtggggagggggagagaggctgtgcaaatctatgtactgtgttgggggagagagaggctgtgcaggtgtatacactgtggggagggagagaggctgtgcaggtctatgtactgtgttggggggagaggctgcactggcgtatgcactatggggagggggagagaggctgtgcaagtctatgcactgtgttggggggagaggctgcactggcgtatgcactgtggggagggggagagaggctgtgcaagtctatgtactgtgttgtgggggagtggctgcactggtgtatacactgtggggagggggagagaggctgtgcaagtctatgcactgtgttgaggggagaggctgcactggcgtatgcactgtggggagggggagagaggctgtgcaagtctatgcactgtgttgggggcagaggctgcactggcgtatgcactgtggggagggggagagaggctgtgcaagtctacgcactgtgttggggggagaggctgcactggtgtatacactgtggggagggggcaagaggctgcacaggtgtatacactgtggggagggggagataggcattggtttgtcattgcaggactgatctgaaggccagagccaagactcagggcagggctgttgggaggcccctgacaggcctgggaaggccttgcctggtcacagtgttttgtgggcctgaggattcaggacacgtggtacttgcttgaccatatagtttattttaataatggaattatagagaatttctgttttccctctgggaggctggagtctgagctgctgtggtctgtcacacagacactgcctccctaagtgactgaccctcaataaaaaccttggacgccgaagctcaggtgaactttcccagctgaaccttggacccggaggctcaggtgagttttccagctggtgtcattgcacacattatcaccatcatttctgggggaactaagcccattcccgcaactcactgggcaaggatgtctggaggcaaatgcctggattctccttgttgtcacccaggctcccctcccttcgctggtgacaatttgtggactttcacaatgttaaacaatggctgctggtgcgccagccctacccagtgagtaccagtgagtacagagcctgaggggggtttcggggacccccggcatagccaaagaccccttcactgacatggtgaatacactgtgtaggtccagagacagtgatgacaaactaagtttcacagactttgaatttgggaaggccagtgagatatcgcagccaagataccccagaggcagtggagcagggtgaataaagtctcactagagggtcagatttggcaaatgcgtgggttgcagttgaagccacagatgtgaattgccgtccagtaagtgtagggggagtaaagatctaggataaggagagaaagagaaactggcactgacagaaagaaacaggaagagaaaaagctgacagaaactacatggaacctaccacactcaagggaggttggctaatggtgtcacgtgatgccaggacacctggcgagttaggaacctgggaagagttattttgtgacctgggctgacagttttattaaaagggacaagtgagtggccagagtgtgaggggccgaggcaggcctggcaggaatgagggtgggctgttaaggtgatctggctgggccacaggggcgggggagagaggcgttggtttgtcattgttcttgaattaagcatgttgagttgccaactacaagatgctaaaagagagggagaatctgaagacgtctgaggggaactgcagccgggtttcagtacagggtgggagcagaggctggcgtccggtacacggagttcgaaacactaggggggaatcactttagctggggggtcccctcctctctcactgaaaggtggagtggggtggggcgtggagctgggggggtcccctcctctcattgaaaggcggagtggggtgaggcatggagcagacatggctgagtgtgtaagttggaactcagcaggcaaacaagtttcctcaaaaaaattcgactgtctctgtttagcagggacacaaggcgctctttttgaaagccctgggagtggatggattgtgattcatctttgttatttgattattccaaaggtatatttgtgggagaaatgcaggaaggaaggagggagacgggaggagggtgcaggggtgagcagggtgcccggggttggtgtttccacccagtggcatggatttgtcctgattgtgctaagagaagacgctgcctccttttcttcctccgagacccacgcatggtcaaacagtttaaataagaggcgaacgcaatgcagagcacggcactgagagagctgcgtaagagagaacgcaatgcactcttcctcctcattgtcacagagttggccaaacccattgtccccatcctctagactccaaaaccgatgccctggaaaggcaggagatatcacagggtgcccagcgggacaacccgatccctgttcaagcgtgggaaccaccccagacccttccttccagccaactgcgatcccggagagacggcagccaggagagcctctcaccccctctcctgggtgctgggtctgcagcgtgagattagatggagctctctgtgcccatccaggaagccttgagtttctgttaatatgcaatacaagcttacaatagagggaatccctccaaaacacaacacaccatattgtttataagaggctaccagggactgaaaagtaaacacaaaaagacaaacaaagtcttccctacacccagcagggccaaagagatttttccctctttccaataagctctgagaaatggggtccctgctccccacaccacagcccacacctggaacccctccccgctgcaggctgcccggccacctgctccactgtactcggaaaacacacaactacattttgtttgttttcctctctgggcctctgatcgaatttttaagcacctccttgttgctttattctccctgaatttcctggaagtgctaacctcaaagtaccacggaaaatgccttcctagagtacctttggcctgacacggcgaacagcagctattttctgagaaagctcattctttggagagtctcagtgtaattgcactgattgtgctggctctggaaacctcagagccaccataggtctttgaaaaccaacgaatatgagtcaacacatttttgcagctaatgacgctctctagttgatgaaagccgatggcccacatggcccaatttaccacgatttactggagatataaatggcatgaacctcaggccccttcagggaggttgcagccacacagaccgacactggagaggttttagtgtaatgcagtctcatggctttggagtgaaaggaactgattttggaatttgttagggtcgtgggagctagaagagatttggagaccagtagatacctctgttgtacagacaagaaagccacaaccccgagtgcttagtcatttggcaagagtgaaggtgaagagatggtagatctagaatgcagagtctccgcctaacggtccccgcgcttcccaggccgccgtgcgagccctgtttgtgccgcaacaggaagaatggtgtggagttcggagactaaaggtgcactgtgcttttaaaataaaaaggacggcagaaaaggggctgttctgggctgtattcggccctgtcaaaattcacacgtggaaaccctgactcccaggacctcagaaggtgacagtgtttggagatggtgtccttacagagctgatgaagataaatgaagtcatatgactggaccctggtccaacctgcctggtgtccttataagaagaggagatgaggacacagacacacacagaaggaggaccctgtgaggacacagagagaagacgccatctgcaagccatggagaggcctcaggaggaaccaggcccctggacaccttgatctcgggtttccagcctctctgactgtgacaacgtgaatgtctattattgaagccacctgggctgtggtcttatgacagccccaggaaacttataggagccagctaaattattctccacttgcttaagagaggaaaacctgttgtccgggctgccacagtggtaaagtccttctcaccttcacccagacagtttctcaatgatccagaagatgcaaaagaggcaggctcgagcaggactgcactgccaggagcaggcctcacactttcccttcctgggcggctgtccctctgcccgcccttcctgccatccctctattgtagaactggtaaaacttccattattatttttaaagcaaaaataaaataattttaaggtctttcttccaatgacatctcacctggtaacccagaaatgaaacaagaaaacagagggagcacctgaggcgccagggcctgggattggctccaaaatccccttcctgcccctctggtggccgatgggccccaggtccagcgatggccaaatcgaaggtcctgccgggcttccggctctgaatgtctccgggacacaatgtaccaaatagacaggtgctctgagaagtgagggctgagctgggcttgtcagaatgtgctgggaaaggcagacagaatgggactgactggcctttatactgcagacatggagtcctggcctcaggaggggcagcgtggccaccccaggggggcggagtgaggtgagtgaggctgagcggctccaggtggcctcctgcgtggaggccaagccctcctcccgcatgtggcctgagcctcctccctcgcagccgatcacagaaccatacagtcccaatcctgccaccaagtcattatcaatcaggggttaaaggctgctcctggccactcccactccgagcaggtggctctgcagcccccaggatgcccatggggggagctggcctggggccaggagcctttcctttgcagctcatggactgcactccagggcagctgtggcctgtgccgtgtaagtggatacagcctcgggtttcactgcacgctccctcctctctggctagtttggggccctgtccttggggcattaggggcatgaaatgcctgcagacccacgggtgatgccttttagagagtgggtgaagagaagtgggaggcacagccccagtgctcaccccagggggccggagggagcaggatctgtgtgttcaccccacagtggctccagagaacatgggcggctgtcctgcctggcactcagtgaggggctgccaaggtcggcttcagggaacagtcaatcaacacatctactggggacaggaggagggagggaaggggagaagagggcgtgaagagcctttttctggcctggtcctgcccggcactcagcgaggggctgccaaggtcggcttcagggaacagtcaatcaacacatctattggcgacaggaggagggagggaaggggagaggagggagggaaggggagagaagggcttgaagagtggccctggagtcagagagcaccttcctctggcctggtcctgccggacactcacccctggcggaaatggaatggatccttgtggtcttggcaggtattttattggcctagattttctgtatgttttggtttttacctcctgtggaacggaacccttaattaattcgtttagtcactcattcagcaaatgtttgtcaggatctttgaggcagaaactgtatgtcacccccatggtctgtgcccagtcactgtgggaacatcctgggacatggggggagagcagtgtcacccgcagctccctgccggagaccctgccccattgctgggagcaccgcgtcctcgcagcccaggccagcaccatctctgaatgctaccagacaccaggtggctcataacattgggaaatgactgttttaatcgttaattaccaaaaaaatgtcactgtgctggtacaatatatgcggtgatttctgtcataaattgacatctgtaagtcataaattgcttagttttagctgcttttaatggctgaattttcccaagctacatggtgcacacattttggatcaagttcaaactcttctggcaccgggcgccttctgggaactggcatggacgaggcaggcagcggattctgacggcgtcagcagcgcgagaggcacccgacctctcactaaaacgtttggcctgctcccaggaagaggcttccatggaaagccagaagaccctttaatcagagaagattctagccggtctcaaaggaaggatgcagtttgcgccgtcgaaaatggaaatcaaaggaacgcgatgctctaacggactcgaggaggccggctccgtcttggcattgttcagaaacatcccggcttcttctctgtttgatttccaacaggttattcccagaggaaccacagtcctttctacccagaagcctaaaaatacatgcttttgagagcactgccagagtaggttaagaataaagaaggcgtttggagcgcaggcagaagacacttgtgctcttctaagcgcagcgaccgtggcaggaataacgagctacagaggccacacccgcacacgggaaacgcatttcccatcgccccaaacacaaaccctgcacctctggcctgtaaaggaagtccaggctcacttagaaccggtagaattctaaaattacacaaatcagcagaggaggcctgtaaaccggagtccagaaagtcggctggtggaggctgtgcagggttggaacctgcccccagcgctcagctctgctccgtcctctcagggggcctgggtcccacagcccagggcagagacagaatctggggtctgagtccccctgggtcccccaggctcatctcagcggccctatttctctttccccacccatctgcagggcaggccctggttctgtctccgggtggcctgtgccctaggctctgggcttcttactcagctactcagctctccagcatccacccagccaggggcaggggtgggcctgtggcttcctcatccctggctgttttcgtggggctcccagtccttccctggcccatggaatcatctcctaggattaaattccctctggtttaaacgcagagagtcattttgttctcacggttgggctgtcacagaaccatcaatgaatgctgtctcttccctggtgtatgctggagattaaaacttcacttaaaaacacaccaagaacctctgccccggtctccactgtcccccagccagcatccccccaagttctgctggtgacgctgaagcacaactttcttcccccgggggaggtgacttcagggcacagatggcttcccttcattctcctgctttccccacagcccccaacggtacttcagttattgtgggcatcagtaggtcctttccgatttcaagcaacatgtgtgtcctgggcctgttttgcctcttatttctaggatagctttgtttacactactaaaaaggtatttttaaacatttaacttcaacttttcttgtgggttcaggaggtacgtgtgcaggttgttaccggggtatactgtgtgacgctgaggtttgggatatgaacgatctcgtgccccaggtagtgagcatagaacccaatagtttttcaaccctgtccccctgccccctcccagggtccattgctcccatctttatatccgtgagtatccaatgtttacctcccacttacggatcagaacatgcactatttgtttttctgtttctgcattaattttcttaggataatggcctctagaggcatccatgttttggcaaaggacacgatttcattctttttgtatggctgcatagtgttccatggtgtcaatgtgccacattttctttatccagttcaccgctcatggacacctaggctgattccatatctttgctgttgtgaatgaacacgggactgcatgttgcctttgtggtaggatgatttactttctttcggatatatatcccagtaatcggacagctgactcaaatggcagttgtcttaagttccttgagaaatctccaaattgcttcccacagtggctgagcgaatttacatttctaccaacagcgaataagtgttcccttttctctgcaacctcacaagcatcttattttttgactttttaataattgaaaaggcatatatcttaaatacaatttgaagctcaatcatccttcgtaagagaagtgggggctaatgaagtttcagggaactcatgtcctgtggtttcttgaagtgtgagaagtttgactgcagggaccgtgagtgagtgtgctcttgataaaaatgaaggatggaccggggcttcattaagaaactgtgtccctgtgtcaggtatgcgagactacaaggcagagctgagggccttatgaaaacatatatgggccgggcgcggtggctcatgcctgtaatcccagcactttggaaggccgaggtggttggatcacctgaggtcaggagttcgagatcagcctggccaacatggtgaaaccctgtctctactaaaaatacaaaaattagccaggtgtgatggcgtgcgcctgtaaccccagctactcggcaggctgaggcaagagaattgcttgaacatgggagatggaggttgcagtgagccgagatcacaccactgcactccagcctgggtgacagagtgagaatctgtctcaaaaaacaaaacaaaacaaaaaactgaaaacatacatgttgtgcatgttaatgaaagaatggggaaacatttgaacataagaaattgtgtttttctttgtctgtctttcatatattctgaattatcagctcttagagattagggtctggaatccttcaattcctcacactgtttaatatgatgctcaagtgacgaaattcccaggatgagggggcaccttcccgtggctgggaaacgaggacacggcttcagggctccatggcttcctttcctcttcaccccaccaagagcaccttcaaagaaagccttcctctcaaacaaaaagtctttttttttttttttaaatttctttactgggggacaaatccctttgcttgagggggttctataagaggaaggggatagatgcattgtgtaggaaatcttggatttgtgtttccacttttcttggtgaagcaattcccaactctaccctgtgccgattccagagtcctgccagcaaaaatgctctacgtcttcctccttgtctctaaatattcccttccctcttactccctgctggtgcttcgcaaactttgctgtgcattcgaatcacctgggatcttattaactggagatttcgactccatggtctggggagggcctgagcatttgcttttttctgtctcttttgcagctgtcgaggatgccctgatgtctgttctcacatcacattgcgctccaagtaccccggctgcaaccagagctcagcaaaccgggaccagagggcacatccaccctgcctgcccatgtcaacagagttgtgtgggagccagccggcccccaggaagaccccagatcttcctgcccctgaccacagctctgtccctggaagcatatgctgcagacacttgctctgctgcagattttctgcacaacccctcctcatgggggaaggtttggtacctgaatgaggcctcttttgacctctattcctatcactatttttggtgacctcaatatttatgaaggtaataacttggtctttaatccagacaattttcacctccaggaatcttgtcctgcatctcacttttcttcttgagtcctgtggtcatcaccaaaacctgtccctccttggaaacctcagtttaagcatcccactgtccgagggtacctctttccttccattgcctcagtttcaggtgtccagtccatggcgccccccgtctttgcccagtcaccatgtccagtcgactgtgctcccatctttacccagccactgtgtccagtccatggtgcccccatctttgcccagccaccacctcgtctgactccccgtcctccccttggtgctgggctcctgcctgtccctcctctgtcaagtgcacctggacctgggagtgaccttggagtgaccttgaccctggcagctccaactctcaacccgtcagccaggctccttgaaacctggctggagggaaacggcaaaccctgccacctggagtcgcctaaaattcgcagccacggtcctccaacaggccccacgcttcccgccagtccagcacatttcctggttaatttataattctgttttcccaggcagctattttgcaatttccaggctcaacaaagcctccaacagttcttcaccttcctaattccgagctgttgcccacatttgtttattttatcaaaagaacttccgggccgggtgcagtggctcacacctgtaatcccagcactttgggagacccaggcgggtggatcacctgaggccaggtgttcgagaccagcctgaccaacatggtgaaaccccatctctaatacaaaatacacacacaaaaaattagctgggggtagtggtgggcatctgtaatcccaggtactctggagcctgagacatgagaatcgtttgaacccgggaggcggaggttgcggtgagctgaggttgcggtgagctgaggttgcgccactgcactccagcctgcacagcagagggagaccctatctaaaaacaaaacaaaacaaaacaaaatccatgttcttccagcatctgtggctgccacattccctgccctccttttaaagcagctgcaagcagctgagttcccagcctcagtggcatcaccccaggcccagcagtgagcgtggcttccatgcttttcatggagcaaagaagaaaggagcttcctggaccccgtgactctggaaccctcacgtctccatccttcccacccccaggctgtgcctgggcaccgtctccccggagagaccccgcgtgccccatctaaatcttcatcccacctctgcccccctccatgggtgctcagaccccgcatgctccatctaaatccacatcccacctctgtcccccctccgtgggtgctcagcccccacgcaccccatctaaatccgcatcccacctctgtcccattctgtgggtgctcagcccccgcatgctccatctaaactcgaatcccacctctgcccccctccgtgggtgctcagcacccccatgccccatctaaatccacatcccacctctgcccccctccgtgggtgctcagcccccacacaccccatctaaatctgcatcccacctctgtccccttctgtgggtgctcagcccccacgcaccccatctaaatctgcatcccacctctgtccccttctgtgggtgctcagcccctgcatgctccatctaaactcgaatcccacctctgcccccctccgtgggtgctcagcacccccatgccccatctaaatccacatcccacctctgcccccttctgtgggtgctcagcccccgcatgctccatctaaactcgaatcccacctccgccccactccgtgggtgctcagcccccgcatgctccatctaaactcgaatcccacctctgcgcccctccatgggtgctcagcttgccttatttttcttcagagccatgaccacttcccagcataacatgcatgtgtttctgttttatgcgtggatgtttatgttccatgagaaccaacagtgggctggtttgttcacgtttggactcaaagcctggcacatgtacatctggtgtctgtgtctggcactgcttttgaggcttgggaaaggcggataaagtctctcaatcgcatccccagtgctgagacagtccacgtacacatccacatgaggctttaagacactgatgcacttcagctgcagggcctgtcaaatccaagctcaagagagaatgatgtggtttccaagataaatgccagatacttgcttctccccacccaggactctgctgcttttatggaaatacacattgctgtgggagaggaaagagggctgaacagatcatgttgcagtgtggatatgggttttggctgataagggctgtgatcactggctcttggagctgtccccgacaaggtgtcaagggtcctgagatgctaacgtgcgtggtgaggtcggagtctctctaagatcctgcaagtgacacgggtcacattccctggggagggtcctccagaggctggtccactgggtggacgcctgtgcccccgagataggggacttctcttccaccactggcctggctcaaaggacagatgccctctggagatgtggcacttaagctaccgtgacaggggatgggtgctgacaagcagatcctagttcagattttgacacaagacggtcaggaggagcctgggccggtggggggtggtgctgaggtcagcggtggaggaacagggcgagaatcacaccagaaaacaaatgcctcgcttagcgactccacagtcctgccctcggttgactgatgattttacacattttaagaaatttcatagggttttctgtagatttgacaggtcttttcttgttggagcaggaagtaaaaatgataggactaagcaagcaaaaacagtttataaagaggagcccatgttgcggtgacattctcatcatcgctagagatgggcggcttctcagaagcgtgtcctcaccctcgggggagcagcgggcttctgattgttaaagaaccctgggctccgcatcagatctgagtgaggaatcccactgcgtggacggcaggtgaaaactgtcagtgtaaacaacctattttcatatctaggacaaaggttaagatgtgagattttcgtcttccaaggccaacttggattacttatctaacaaatcctaagattcccagactagtcggctccctaatgcatttctctaaaaattcctgaaaagaaaagagagccaaatgtttgtgtttttctggaccccccaactgaagcctgttcctgaaatgcagccttgaaaagaataggatctactttctcccttgttcctgccaagaggtcaggagtgattaattagaaacattatttgatcaaaaccacattcgttttagtaaaaagcagcaagagtttaacaacttctttcacccatcacatgcagcagaaaatcagacgagaaggatgcatttcaatgaccctggtgcaccctgggtcatcacgaggcgcaccctgggtcgtcacacacgcgtgaacacacggggggcaccctgggtcgtcacacacgcgtgaacacacggggggcaccctgggtcgtcacacacgcgtgaacacacggggggcaccctgggtcgtcacacacgcgtgaacacacggggggtgggttggattggagagttctccagcaaagctggagagtctggcagtcctggaaagtccaggcaattgtaagactgcagtcagggaagtcaggacaggcagaaaaagccacactctcgcccaggcaggcaagcagggtcaggagccgaggatgtcggagcagacgcagcctcccagggacttgtggacggtcatctgtctacaccgagccccagactgggcagctggctgttgcagggagtttgaagacctgcaggaaacccttgcctttgaataaggtacacagagagaaaatgtcctctcttccaaatacgtcttgccaaaatgcagggcaaccttgcctctctttctccagtgagggcctcgtgtactacagacttgggtttctaaatacctgacctagagtttcagatcctcactcaccgtccaacagaaacgtaacgtgagccacaggggtaccactaaattttctagatgctcagtaaaaaacacaagtgaaactaattttaataataaattttatcatcccagtatgtccaaaacatgattatatcaacttgtaatcaatataaagacatcaaggagatacttgaaattcattttttctttgaaatgtgttgtgtgtgggtcactggcagcccctctctctccagacctgcccagctctgagtgtgtaattggcacgtgtgccctggctgcgggactggatgtcatagacccagacaacttgtgcttcaaatgcaaggtacagatacatgaatttattttcatcagtcccaaacttgctcatttccttgactgcctagttttttggaattgacttcatacagcattcaacatattcttcaacaactatttcctgagggtttatgatgggctcaccactgtttcaagcactgaagatttaacaagacaaaacaaaatgaacaaaagaccaaattagaccccttctctgttcacccaggctgagaaccatatgatcatttcggagccttttcttaatcccagatttgggggagttgccggaacctgccagtccacccctctctccacctggtcccccatgcagctgctgggcctgatcctggatgctgataagagcttcctaaatgaatctcatgcaccgtaccctagaactccccccaggtggaggtctgagaggctcctcctgcccgaagaccttcaggggctccttggcactcaggatcctcccgatgtggcctagagccgctttccccagcaccgccgctccctcggcagccacttcatgctcactccacttcccctctcccactcttgcccatgcaaccaggattgccacatcgtgtctttgctcctgatgcctagaagccctggaaatatgcaaatcagatcctgctaaaatgcttctgtgaactgcagtcacctctgggtgcagccccagcttccgagctcatcgcctcccaggagtggtcctgcctcagccggaacccgtctccctctggccattcacagtgcggttctcaggggcccccgccacgtgtcctctcttctcagggacccttggttcttctgcctggagcagcccctctcaccccgcccaaccccctcccaagcccagtcagcttttgttcaccttgagcattcacctccgggcccctagatctggccattctcctgtgagcgtgttcggctcatgctgccaatccatgtccctcccagccctcatcacatgaggccctcatcacttgtgcagctgccgtttctttctggcagggtcaaaagtcgcaggacaaagaggttaggatcggggctctgccatcagaccctcctagttacgagcctcactccatcactgggagaaaaggttcccagcatttctgaacctgctcctcaagtgtcagacaacaaaatctagcctgtcaggtatatgcggtgcagtcatgagctgtctccctggaactggctcagtacatgccagttacgatctgtaatcgctcatttatctccagcacctgtgataaggcctagcatatagtaggtgctattgaatattcctaaaaaggagaatgacacccccctggttggaatacttcctggaggctggccctcggcattgggctagacctgaattcaaatcatggttctgccagttaccagcctgccatgatgggcaggccacttcacttctttgcctcacgttcttcagtaggacagccaaggtcaggcctttgcccttgcaggggtgtggggaggccactgcatgggctggagacaatgcaggtgacagtggtgtccctcatggcagagactcaagaaatatgattgaagttgttattactattcttcctcttcttcaattgctccttcaacaaatgtttccttaatctctcagccagaaagaagcacttctcatgctgagctcccgcaccctgtggcactgtctgtggtgagaacgtcattcacttaaggtgctgacttgagtccctgtgtcctccgcacgtgacctcctgaaccctttgagctgtccagggtgagaacgtggtctccctaaggtgctgacgtgagtccctgtgtcctccacatgtgacctcccgcaccctttgagctgtccagggtgagaacgtggtccctctaaggtgctgacctctgtccctgcgactccccaggtgacctcccgctccctttagagctgtccatggtgagaacgtggtccccctaaggtgcggacgtgtatccctgcatcctccccacaagatctcccacaccctttagatctgcctatggtgagaacgtggttgctctaaggtgctcatgtgtgtccctgcgtccccctcatatgacctcctgcatccatctcccacatcagatgcttgctgctggctatagcttagcttaatcatcttatcctccttggccacttaattattaagaggccactgatgaaattttgttgaatgaatataaggccactactataatcgcgccagtttatggaacaaacagaaggctgacttgaggaagagagagcactccctgtctctataggacatttcattttacttttttttttattattattatactttaagttttagggtacatgtgcacaatgtgcaggtcagttacatatgtatacatgtgccatgctggtgcactgcacccactaactcgtcatctagcattaggtatatctcccagtgctatccctcccccctccccccaccccacaacagtcctcagagtgtgatgttccccttcctgtgtccatgtgttctcattgttcaattcctacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcaggtgtctttatagcaacatgatttatagtccattgggtatatacccagtaataggatggctgggtcaaatggtatttctagttctagatccctgaggaatcgccacactgacttccacaatggttgaactagcttacagtcccaccaacagtgtaaaagtgttcctatttctccacatccaacgttagacctaaaaccataaaaaccctagaagaaaacctaggcattaccattcaggacatatgcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggtcatgaacagacacttctcaaaagaagacatttatgcagccaaaaaacacatgaaaaaatgctcaccatcactggccatcagagaaatgcaaatcaaaaccacagcgagataccatctcacaccagttagaatggcaatcattaaaaagtcaggaaacaacaggtgattttacttttattaccttttttttttttttaatttctgcctttaaaacaaacccagagctttgtaataatagcaatgccttttgccttaacagctcttagggtcagtgggccgcagggtgaattcaagattcctgtgatctcaattcatctaatttctagagaatttgagcaatggctcctccagcgattcaggcctggcctcggccgtagacctgcatcccacctggcctgggggccgacgtgcagcagcaccggtgccttcccctccctcccgtgcagggctctccgctctcctcgcctggaatgataccattcctgtccttctgattacgctggcaccaggtcttctgtgaaatttgcttgataacattttaggttctggacctctcattgtgctctggcctgtaatttgccccatgatcatctgtatgtctctcagtctacaactttggatatatttatgtgcattattctggtttctttatacaaaagacacaagaaacctcttattgtgtctttttctgttttaatctaattccaggaaaaatcattgcctgcaacacagatcgaatgcgtcttcatgaaccactataaatacatgggtatgcatgtaatgttatgcctcccctcccccttctctaagcacgctgtcttctccggtgctgtctatctttttagatccatggatatacttggaatttctgaaatggaactgaaagtgtccacaagaggagaagaggctgaggggaggcagcagggaaaggggccaatctcttgggggccttagaaacaattagggagcatttttgaaaggcgtctgacttctgccacccaggaaaagagagatttgaatactagaatttggccacctagaataatttaccttactctgtcgagtgagggcaagcagctttttcctcctgttttccacaatttgtcccggctgactatacactgtgtttgtggtatgccaaagacacttatttcatcaaagtattaggaatgagtattttatccgaagaagattcctggaaagaagggacatttcggtcatctgtcttggaggttcggtgtgttcacgcgcttctccgtggtgggcagcattgcctgctctggtcctgcctgtaactctgcaccccaccctatcagccatcaccgtctcagcttaactctgcaagcaaaggaagccaggattgcagagccctccatgtaggctggtctgagaaggacagagttaaaagatcttaatacttttctcatcgttacttctcctctaggttgagctcagtctagcaaaaaaaaaaaaaaaaaaaaaaaaaaaaaaaaaaaaaaaaaaaaaaactcccctgtgtacagtgagtgtgtgtgtatctagttgagaatattttgtaattgtttgtaagatggtttacttcctgtgaagctttcactgtcatgtcacatacccagggttagcagttgttggatttgccagggacagacccagcttttgtccccgtaccatgtaatttctgctagcaccccttgcccacttaacagcatcctggtttagaaaaggattcatattttcagtctacacatgtgtctcctttaaagaacggtactaagaaattgttttttctctttcgttagcaattctaatttgttttcccaagttgctactctaaagaccaggtaccatgaaatcctaattgctttccctcaatagctgtgcacacgagaaagtaatttggaaataatggacagcgttttagtggttactgtggggaaaaagaagtgccttcatttttcagtagaacaattgtatgtgattcagtgatgtatattttctaatagcagatggcagattcaatgagagaaattgcaactcaaatcattagttaaaaaatttgtgtcactttgttagatgtggtgattgcattctaaactggaggctgaattatacactatttagttttacatatcctgtttaactcttctatatattgtttatctacatataacgattttaactgcaaaattccatgcatgtatatgttcctttcttaaatgtgtgcttccatataactacattctttaaaattctaacatctggctaaagcaatttttatgaacagaaaataatgtcactataattgacttaaaattaataggaagatcagaaatgaagaagtataaatatacaacacacctgtcaggaaagaaaataaaaaccctggggttttagaaatacaatgtaagtaagaattcttaattgtattctctttagtttagacttcagagcagacttagaattgtggaagtttagagagcgaaggacgaacagtaggaaggccagtgggcacccatgtgggtgaggctgagggtgactgggggtccctgtgatgctcagaggaagtctgtgggtcctccccccaccgagaagcagacctgctcacactgatgcctgtgcatttggaagattggagtctggtcttttgaaaacctgcccgtccacttcaaatccttttccaagaagcctgagatgacccagtactttctagatgctctttctcccaacgtgctttgagctcgcaggcgtgaacccagtgcggtgggatgggtggtgcctggatgtggctgtgggtgttggctttagcatgggtctctgcaccttgcccaaggttcacatcccaggtctgtccctcccactctcccaggccaggggaccctcactggccacaatccttccatcaatctgtcgggacccaaagcaaactgcccccactctgaagagaaaatgaaaggacggtcagcccctgccaggggacttcatgccaggacacaggacgtggccaggcatggaggcttcgtgcttgtgcctcttagctctgcccaggtgcctccacagccctaccagggcactgctgacttcgaggctgctgatgctcgatgtcttggaggcagaccttcttttatcctctcttcctcaccactatcttcctcacaaggattcgtccactaccatgcgcacagcaggggctcaaagagcgtttgttgaaggaatgggaaactgaggaatggatggttatgtgcctcactcgaggccaaggtgtttagcagccagacaggcccgggatctgatcctgactcctcggagtgccctttgcctcctgcctgcgggagcagctcagagacaccgttgatggcacggcatcaccccatctggagcagctcgatccttgggaacctgtgtcacacagcagcagctgccattctctctaactcacaggaaacttaaacaggttcacaggaaacacaactgaagaatactgaatcatctcagtgaccagtgagagacggcgcagtgcaaaccacccggggaacagtgtcacctcgcagggcctgagccgccactggggaacccttgacatagctgaggagtttcaacagaggcttggccaggcctccgctgtcctgactctgccctggtgtcctatattggtctagatggagcttgggaccacggctgccaggaaacgctcagcggggaggcggagggaaggaagggctcctgcaccagcagcacagaaaagcagcaccgatggtccagccggaggggcctcagcgaacacacggtccagctgcggggccgtctccgcagacactggctccccgcaaccaaacttctcaccagtcaacctgcccacgtgaacccagaagtctgtggttttagtaaaaggctatttgccaagttaatagtttaaaaaataccaaaaagatgaaagaagaaagaaaagaaagaaagaaaagaaggaaggaagaaagaaaaaagagaggaaggaggaaaggagggagggagggaggaaggaaggaaggaaagaaagctggaggtcttcacatggagttaaaatgtcactgtttcctaaggagtttggagaccaggcccttggacaggtaagcagatctgatttactgacactgggcccaactcctgaaatgctgacttttgaatctaaacttctgtgtgcatatatctatatgtctctatctctatctatctatctatctatctatctatctatctatctatctatgagctaaatggacaaagcacacacggcagaatcccccatttgtcttgagcctctgtggctagttcagttccccaagtgaataagttacgatttgtatgatgacctggaaggatctgagacaggagatgcgcccattagaaggcgaggcgagatggtgagagagagacacagagagacagagacagagcgggacagagatagagagacagagagaaagagagacagagacagacacacagagacagacagagagagacagggatataaagaaagagacagagacaaagagagagacagagagtcagagagagacagagatatataaggagagggacagagagagagagaggcagagacagaggcagagagagagacagtgaccaaaagagaaggtggtggcgggggagagacagagagcgagagagagagacagagagagagaactggatccagaatgtacccagtggcctccagcagcggctgcttctttgctgtttcttgcccatcgtgtggcaccagacacacagcctgtgtcatgaacccccagcctgcagaacgtgagcagcaggaggcatgtagagaggatgggcagttggggagcaatcctctctcattcccagagggagcgtggctggtttacccaacacctaacgaggtcagcaaaggttgcctctgggttctgactccgtctatttttcagcttctgattttattcttaaattctgttctgatgagctgcagaggaggaggcctttggaagtaagcatttctatattcgcacctgtctcctttttagaaattaaatgcaaccatttgtcatatcttaaaatcagtttagggtttaattggccataaatttgatcatattttgccttcatactctagacacatagaaattattttctaaagtatcatttttttttaaaaaaatgtaatactgctcaaaatactatgatattatgctcaagactttcttataaatgacgtcctaaaagaatggcagcatttggcactgcttgttttttatccctacatttttatactgccttgggacattgacaattattatttaaatcaaaaaggaaaccaaaaataattcacattgttggtcactgttttcttccttgaatatattactaaaccatgtctgggaactccattttgaaagtagcagtttctcctgacatgaaaactacatatattgatttttggcaccgagaacaagatttgttgtctcattcacatacaaacgtatatacgttaaaattaccttaaaacttcagtataatttagaagatgttaaatgcatccacttatgacatatcgatttgtgcggttttattttttaacagtatatgttgaagttgagtgtgccactatttaaaaatgtttgcggtatggtgaatatacactaggatttagctcgagactgcttttttttaagatgtactaaacacatgtgtttgctttgctgtctctcccccttggcggttgctacctgggctgattaaccacggctttctcccttttgggtcccccagcacctgcacctgcgaggtgctgggtagaatgcccagtgacagtggaggggaagcaggacgggcaggcaccatgctcaccgcacggcaggaaaggcctccctcccgagtgtgtctctaagcctggtggcttcaggatttgctgatttcttggtgaagcctcagctgaagcacagaccttttgcctcagatcatgtggcagtcttacatcatttctctcaccagagagtctcatgccccctggcctgtcacagcagtgggtgagtcaggagggcacaactatgggagaagatggggattctgacaggcaaaagaccaaagtgagtcctgctagtgcttcggaaaggcatgggggctggttattgtagtggctgggaggacggggcagataggaacccacagggacaggggggcgctggacctgagtggggacacagagagaacaccgcatgctggaaacttccaggaggatgggagcccgcatcctggaaaccggaggacttgagtgacaggtgcaggagaggctgctgctccaatcatctgagagcacagtctggccaatggggaactcagggcaaacacctgctgggctttagggtctcctgcctcccagacaaaacctgtcattgggtcttccagtttcatggaattgaattgattccatttatttattccaataaataaatatcgaatgatgtgaaagaatcagcatttctaagaataatttttaatgcactcagaattaaggtggagttaaaagaaagcccactctaaagtcttttcttgaaggccctcgcatttgaacatctgccatccagcaaaggagacacacactttactgcagagcaaaactgggatcatactgtatacttttagaagtgtaacttttgatctatttttacttttttttttttaaaaaaagcctgtatgacaggttttgtttacaatttcatgaaaatatttgcttggtgcttgatactgatactatagtttatttcaatcatgtttgtgttctgtgatattttctcattataaatttaggaagtaaaacagataaatggtgtggagttgttcaaagcaaaatcaccactgggatttgaaatgtttttctgctgcaaatgagtaagaattgtggatattgtggcagctgcagttcctgaggagctatgaagccagatacgtgggtatcaggactccctctttcatctcccctttcatttagttgcagaggtgagagtgcaggcgagcaggcaggtgagtatgcaggtgagtggacaggtgagtgtgcaggtgagtgtgcaggtgagtggacaggtgagtggacaggtgagtgtgctggtgagtgtgcaggtgaatggacaggtgagtgtgcaggtgagtggacaggtgagtaggcaggtgatatgctggtgagtggacaggtgagtggacaggtgagtatgcaggtgatatgctggtgagtgggcaggtgagtatgcaggtgagtgtgcaggcgagtaggcaggtgagtgtgctggtgagtggaaaggtgagtaggcaggtgatatgctggtgagcggacaggtgagtaggcaggtgagtgtgcaggtgagtgtgctggtgagtgtgcaggtgagtgtgctgctgagtggaaaggtgagtaggcaagtgagtgtgcaggtgagtggacaggggagtgtgcaggtgagtggacaggtgagtgtgctggtgagtgtgcaggtgagtggacaggtgagtaggcaggtgagtgtgcaggtgagtggacaggtgagtgtgcaggtgagtgtgcaggcgagtaggcaggtgagtgtgctggtgagtgtgcaggtgagtgtacaagtgagtaggcaggtgagtatgcaggtgagtgtgctggtgagaaggcaggtgagtgtgaagatgagtgaacaggtgagcttgcaggtgcgtgtgcaggtgagtgggcacctgtttatctcaggtctctacagggctgagccaggcaggcatcaggcagctatgctgtgacgccaccagcatatagaagagggaagataaaaatggctgcaggaggctcttcaggaactgacggtgggtgccctttctcgtccatctgaatgactgtgagggtgtttgttttgttttgtagcatgttggtttgtatagaagagacaagtgcccaagtcttgtcattctcacttataaaatggaaggaccacctctgcgccatgctgggctgagtactgactgggtaggatgtgggcagaacttggcataatactgagccctcagtaaatagtagataaagaagaaaataaacacaaagctttgttaagagagagggctggggaagaagggcagtgaagaggaggtcactgagtgggaggatccagagagcaggtgctgcagcctgggctccccaggggccatcctgagccaggacttcccctgcgtggacatttgctgctggtgcttctgggcccccaaatgctcctagtgctcttctgcacccacgtacagcgtttccctgcttggctcactcacacaccctactgcagcactgtaggcaggtcttttcctgcagcggtgacctttctccacatccactgcccccgagtgctcatttacatggccagagtggccccagcctgtgagagggttggcttcagcagcccaggctcctgcaggccagcgagctctcagcagaggtggagctcagaacagggctttgggcttcagttcaggaggccagtaaatgaacagaggatgcatctgctgacgtttgtttggaggcagacagtggctctgtgtgcttgtctggggtgggcctgtccctgtcactgatggggatgaggggctcagtgagccaggggaccagggctctcagctgggaaaggacagcttggatgagccccggtggggctgtcaccggcactcaactgtgctcaggttgcaactccccaccccatgtgcaccagctgtcaatggctgctgcctgggataaaagggccttcccccatttctcctcatgtcacagaagagcttggggatgtgttgagtgtggagcggaaactggtgaggccgaagtacacagcagaaagtaaaggtgccatcagcagagagccaggccggtgcctccaacaccccaccctcactctcattccgtcccctgatgtccatttcttagagaaggtgaataaaatggatcatgcagtggccacggcggcctcccccttcccctcccaggcccaggcgcactctgcacctccttgcttaggcctgaggaagagctcagtgtccttgggaggttgaggaggaaaatgctggggttctcgttatgaggttttccatgcagcaggcacccagcaggacggtgctctacccagcccctcaaggcaagatgatgggggccaggactggggcaccctgggctgcaagctcaacggggtcttgtgaggccctcctgccgcccagtgagcccgctgcagccagctcctcaactggccatagaggtcagtgacacccagtaagatggccgctgggcaggacacaagacacgtcctgctaaccctccatctgtcatgaactacatctcttaaccttttggggcctttgtttcttacattaaaacaatgacaagacctccgtgatgtccctggcattttttgaagatcaaagtgtcttatatctgaaagacctttaggaaaaaaattagatacccacacagggaatcctgaggctgcaaatcatggaaggtggcgtccttccctcccgcctcccagctgagccgtctgctgagcgaggaggagccacaagtgatgtgggccgagagcacggaacggacagcctcttacacatgcacagcatgaaggaaacagccggtttgagggcattttctcagaggacatgagtcgaacctgcatagatgatgaggtgtcaggctgggacaagggctttgagttgaagattgagaaaccggtgctgaaagcagaggggacatggcgaaaggtggagttttaggaaagagaattgggcagacgacgggagccagaggacgggttagaagtggcacaagtcttcttagactttcctggaaagcaccacagagaacagacactcctgttcccagcgttttggaggctgggtgaacagacactcctgttcccagcgttttggaggctgggtgtccaaggtcaaggtgtcggcagggctggttcctcctaaggtccctgtccttatagaccctgctgtctccctgtgtcctcacggggtcctccctctgtgcatgtctgtgtcctaacgtctgcttttataaggacaccatgcagattggagtagggtccaccctaaagacctcattttatcttaattatctctgtaaagaccccacctccaaacccagtcaactgaggtcctgggggtcagacttcaacctgtgaattcgggggacacatacagcctggaagaggcagctatttcagttacctgacataaggcaggaggggctatgttggcagagtggagaggaaagaggatttgaggggtgatctcaggatgttgagtggcactgccaggagatccaggggcagcgattcaggggctgagttgacagaaaaacagaagtcaaaagagaaaccatgggcagcaacattgtaacaggtaacagggctgcaacattgtaataggtaactcaacttcctgactcccttgtacaggttattaagctgaattggttttgtgggtgaattaagattattgatggaccagaatgaatcaatagaagtaaaaccttaataagtagtgctaattaattcacccctcatggaacggcttgcttgtgattggattttatgaacagagcaattctactgtttttgtttcttaaaaaaaaattaaaactaatatattcccctggctgctaagaagctgctataaattaaaagccagtctgctcagctcattaaaaaggtagtggctggattctgtagtctcagtgctgattatttttctgggagggaaatgcatgcttgttctggcaactcacaggtggtgatcgtggagaataatgggtcttaaagatgccaaagcagcacatttcatagcagagacatgggagaaaagtaagcagatgggcatgcagcactcagcaccagcactgccgggtcagaggggccctggagccccttcctgtttgcacacactggagacacatgcgtgcagacgctgctctgaggggctctgtgcacagccaccctctctctccctcagtcctcagcctcctccccacctgctcctgcgcctctctggccctggggtggaggagggtgggaggttcagctgggggactctgtgggatccccctgtggtcaagctccatggtttccagatggggtcacagagaccgagagagcctggcggtttggctctggccttggggcagtgccagggtcgtttctgaatcagctcaacccagtccacctgcatccctcctccactgcacattgctcaggaaacccttcctgtcagagagcccatgaagcccctcaagtcagagaggggcacctatagctgcagagcacaaagcgcatgggaggggtactccggggccatgggagggggctcagggtcactaaagggaagttcaggatccatgggagggggcccagggccactcggcgggggggtcagggtcacaggagggggcccagggtcacaggagggggctcagggccacgggagggggctcagagtcacaggagggggcccagggtcacaagaggggggtccacggtcacaggaggggggttcagggtcacaggacaggtctcagggtcactggaggagctcagggtcacaggacaggtctcagggtcacaggaggtggcttagggtcactgtagggctcagggtcaaaggagggggctcaggatcactggaggggctcagggtcacaggatgggtctcagggtcacaggatgggtctcagggtcacaggaagtggcttagggtcacaggagggggctcagagtcacaggagggggctcaggatcactggaggggctcaggggccattgcaggagggctctccctgctggacttcctgcaaatacggtagcagcagttcatgctatggttctgtggtgctggcaggagccgagaggactgagggtcccgtgaactgcaggtgggaccccagggataagcagtgctaggtctgtgtctccatccagcgatcttcggtctcaagtgggtgaggggcactgtgcaacccccgtttggagacaggtgatcatcagtctgtagtgagcggaggggcgctgtgcaccctccagttggagatggagcagctgtgtttcctgaagctttgagccctgaaacccacatccccagggtctctcaaggaaaggcccttggggacaatggctgcaaaacacattgaaggtggaggatgaggaggggcgtgtggacttcgtcaagtgcgattcagtctgctgtgtggccctggggcagcagctgcttgccctctccaagcctcagttccccttctggtcttggaggcagtgaggtgtctccaaggggctggggctgggtgacagcgggcctcaggctctgggtaggttgctggcccggggaggctcagcaggtgcagtggttgctgtccccttgggttcccatggctgattgaacagattcagtgcagttctcacgaaggaccctccaactttctccaccttgtagagccctaggcctggggtggctcagacacagcaaggaaagaagcccaggtgcgctctggtgtaaggccatccagaagctgcagtgataccctcatgcacacaggtggtgggtggaaagaagctcaggtgcatcctggtgcaaagctgtcccggaaactgcagtaataccctcatgcacacagaaggtggatggaaagaagctcaggtgcatcctggtgtaaggccatccagaagctgcagtgataccctcatgcacacaggaggtggatggaaagaagctcaggtgcatcctggtgtaaggccatccagaagctgcagtgataccctcatgcacacagaaggtggatgttgtttattgaaattagaatctgatcaggtctcctttatttggtctggtgactctatccaaaagcagtggggcttgtccccagactagcactgacgtcattgagaccagggcctccgaccagggctggcagctgtgaacgtgccaggctgtacgaaggccttgtggctgtggctggtgagggtggtgcccaggggacggtgggaaaggacggtgggtggagcgaatgtgcagccccaccatccctgccgcacacgacacacagggagcagcccaatgtgctgcatgtgagctgtgtcccccaaagtcccatgctgaagccctaacccccaggacatcagacggtgactgtatttggagatcgggatcttcaaacaggtaattaagataaaatgagatcattaggatgggcacaaatccgatctgcctggtgtccttataaaaagaggagatgaggacacagacacaaccagagggacaaccctgtgaggacacagggagaagacagtggctgcaagccatgaagagaagccttaggcagagccagccctgtggacacgctgatctcagactccagcctccaggactgtggaagcaggaaagtcagttgctccagccaccccatctgcggggcttctttcagcagacccagcaaagcaaggcggtgtgtgctgtatatcatttatacctcttcaccaccccataggatggaaatttgaacgaggtgaacttaaggggttcccagcacttcccgcagcggaacagatggcacgtgcagaggcaggagggccaggcagcaaaaaagagcaggtgacaaagcatgaagtcacactcatccctgttttgaatacacatttaaaaatattgcgttactaaaattttcttatttttctttaatgagttcatgttaattgtgacatttttaaattaaaaatataaacaacttagtttcattttatcactgcaagcgactttgaaacctgcgtgaggctttatttctaggacagacttgagcttgaacaagtcactggcagtagtgagctgggagctgtgctggtgcaaaggcagccccgcctgtgagtgctcggcttcctggggcccttggcgtgggtctggaggctcccctggcagccgtgggtgctgtcgggccgggtacccaaatccttggctgaaccactgttctccatgagctcacactgtgtaccatgttaccccaaacacacacacacacagagagaagtgtgtgcacacacatgctcatgcacactcacacagactcaggcacacattcacgccgcacacaggtacctatgtttatacacacaggtactcgtttacagacatgtcccccccatatatgcacacacacgcatatacacacacctacaaacaccaccagcacccacaggcccacactcatgcattctccctggggccctgggagagcttccccatgcgcctggtgaggctgggcgctggggtctggggtgggacacagaggaaggatgccgcagccaggggcagaggtgggcagggaccagcaagcctggcccatcagggcaggaggcaggtggatagcgagcgggatggatcaggataccacgaggtgggagagccccaggtgcccacactgcctcagtttaccctgccttccagctctgataggctggcatcctcctagcacaccgctttatatcaagtacttagagtcaggcaggtgaagatgctcagcggtcacagacctgtcatctgggaatgtcggtcacctgttcgagggcaaatacactgtttcccatgaggcttagagccctggcaaaaccacacaatgaatagaaggcacaatttacatcctcctacgattgcctgcgttagactcagccacatggttatgtgtgccgctgaatcatgtaatttctgcattttttaaagaaagatgaaaatggagaaattatagtatgcacataacagcaagttaatcatcagttggtcggaatcaagagaattgttgactatgatttgagagattgtgactcagctgtaaagagtacatgaggaaacaggcgctcaatgaaagcgatccctttctgatttgacagtcaaggggtggaagggactctaaaatactctccagtgaggcagcatgtcacagacacagagcatctcacttttctaagtgaagcagaaatacttcctaaaaaataaaataaagactccaaatctgagctagttgatttaaatatgctagtttatcatgtgagaaagaggaaggacgaacttctcaacagaaggcgaattccttggccccaactgacacctctgaggttaccgctggtgacttctcatcccaaaccctcatcacacttggtctgacttctgagtggtccagacatcctgcacaggctggccatggatgcccaggtggcattctctccccgaatctccccagacatgcctggtgtctctagcagccgctcacctttcaggactcaggggctcccttttgaagtcttgtctgttcacccagtaaacattagttatccctgttcacgaaaacagtctccactcccccaggaatgtacaacttggacgaggcagacgagcgagtcaccagttgctgaacagtgcccccgaattgtctatgctgtgtgccagatttctttcttatttttaaaaaacctttatcatggtttcaggagtacatgtacgtgtttgttgcacaggtaaatcgcgtgttgccagggtacattggtgtacagattatttcaccacccagctcatatgcaaagtggctgatagatggtttttcaatccttgccctcctcctgccctccaccatcaagcagggtgtgtattggtccttctttgtgttcatgaagtctcaacatctagcccccacttataagtgagaaaatgtggtgtttggttttctgtcctgcattagttcgcttaggataatgctatgccatatttctaaaattgtgtatatatgttggtctggcattgtaacttatctcttcacgggtctttctttctgagatgagaaaatttgtcttaaggcttttttttttttagagatttcattttatttagagcagtttgtggttctcagcaaagaaggtagagagagctcccctgtacctcctccccacaaatgcacaaccaccccgttatcaagtccacagattaagctggggcttacgcttggtgttgaaccttctatgggcttggaccggtggagagtgtcttggatccacattggaacatcacacagagcagcgtccctgccctaaaaatccgccatgctccttctgttcctccctccttccccacaagccctggccaccactggtatgttttcatagctttatgttttcagaatatacaccttataaccatttcagactgcctcattcacgtagcaacgtgcacttaagattcctccaggttcttccatggcttgatcgctcatttctctctgtgctgaatcatgcaccatcgtgcggatgaagcccagtgcttattccctcacccactgaagggcatcttggttgcctcctattctgaataaagccgctataagcatctgtgtgcaggattttgtgtggacatgtttccagctcctttgggtaaatactcagcgtggagctgctggaatacgtggtgaaaatgtttacggccctctatatcctcgccaatacactgactagaagcagggatagaacctggtctgggagaagactgctgtggggccagcagtcctcaaacgatgttcaaggtgcggggaagaagcctggaactgttgtgaggcttaaacccatcagacgttccgctcgtgggagctttccctgtgacagctacctggaagcatacacccagttccactggagctgggtttctaggaaggtgctgcctctgctggtagagaaatgtcaccatctcccccgaggacaggagctcaggcggccacgtggcctcttcactcccagagcaggaggcgcaacagtggagcctgggccctggagccacctcctgagttcccagcctggctctactccttgttagctgccaccgtgaccaggtaatgagcctgtacgtaaacctgtagaatggaacaacagtaactaccacaggggtaggtctagagtatctgatactactcacctcatggataatttttgagtattaagtgtgtgtgtgtatacctatatacatacatgtgtgtgaacatacatctggatagagctagatatagacagagaatgtatacacagcacatacagatgagagaacacactcagagtcacctgcacatacatagacatagtgcatagagagagacacagatgcacccagataggcatagagatgacttagaaatagatgtgtgtgtgtgtgtgtgtgtgtgtgtgtgtgtgtgtgtgtgtgcagagaggccaagatctcagcacgctgcccacacatgctaagtacacagtggctgttttctctgccctggaacaggaaaccatctcctcccccagaggccacttccctactcactgcggtccactgagcttggttgacactcgagctgcataaacagcacttgacttgaggtccgagcagaccttcttaatctaatcagctctaaaatacttgctgtcgagggctaacagcctcttgaagaaacttgggaccattccacgtttcatttacatgatggatgagaggcagaaatggattaagtggtagatgagcaccttgggacacaggaaaccatttggagttggagttgtctctggcccagctacttcggcagcagtgggaagtgacgtgaccctgcgttacctgctggtggcagagggagggcctcgctgcctcccatgctcagtctcagggcccctatcagcagcagccctcactggggtctgcccagcactgacccacagctggtagatccctgcgtttgactccacattttatgccttaggaagcaaaatccatcctcgtgctgccctggtttccctggcagtgtcagaagaccagaaatggccttcgaagaataaatccatgcatttttttcttgatatattttccacctttactggagatgaatgacagtcatagctacagaacgatgaccacttccattgcaattgccaccatgtttgaatgcaatgggtgcaccaagcagcaccctcagccaaacagtcagtgccagtgcatgaactcaagccacatctgctggtgtctgtggctcgaccctaacactagtgcaaatgctactcttctcaggctgctcaagctcctctcaccctccataaattcccatgagttccatgtcacagggaagcatggttttcaggaagatcaatgtcagccaggccccattcagcaccctcctcgtagtgcccttcagcactgatttcataatcatggtgcctctgctcagacccaggggctataagagcccccagctctgatgagcgtgttaatgacactacagagcagtcatgggcctgtcttggaaagccctccctggtgcatgggctgagccacttgtgtctctgtattcccagatgcatccactttgtacttgttgtcaccaatattgctctttctcctggtgactgcgatttcatctatcatcacaaagtaattgttggattaaggacgaacaatttttcaggatttcagccattgggacttcatgccatagatcaacacttgacctattctgcctccacagaggtcacatttcaatatgcagtgttcaaaatttcaccttcccagagaaaagtaaaaaatgccacatgataagaggatggcaaggggtcactgtcataaaaacagttgtagaattgtatatactgacagggcccttaatgcaaatatgatcttgagaatctacagagctttgcattttacagatagctttcaagtctgatttatcatttggtctttgcaacagccctgtgcagtgtataaagcagaatttttaagatgaagtgatgcaggcctaaaggagatgaatggcttactaaaatagataattaggtcaacaaagaactcagcccacccccaagtcagatgcttaggtatgaatctaacgaatcatgtacaagatatgaggaaaactacgaaactcgaaagaaagaaattcaagaaccaaatgagagaaattccatgttcatggataggaagactcagtatttttaagatgtcacttcttcctcacttgatttgtagattcaatatattctcaatcaaaatctgagcaagtgatgttgtggatatcaccaaactcattctaaagtttatgtggagaggcaaaaggcccagagtagccaatacaatgctgaaggagaagcaccaactggtgaaagaaaggacaaatagatcagtggaacagaatagagaacccagaaatagacccacacaaatacagggttagggttaagggttgattgttgacagagcagcaaaggtgctataataattagacatccgcaagccaaaaaatgagtccagacacaaatctaacagcttttgtaaaaattaattcaaaatgaatcacagacctaaatgtaaaatgcaaagctataaaactcctacaagatgacataggagaaaatgtagatgaccttaggtatgatgctgactttttagatacgacacccaagaaacaatccataaaaacaaaatcaataaatgggacttaatttaaaaacttgtgcacggtagaacccaacatcaagaaaatgagaatgcataccatagattaggagaaaatatataaaggacagttaaaactcaacaatagaaaaacaaacaacccaattaaaaaatgcacctaagaccttaactgataccacgccaaagaagagatacagatggcaaatcaacctatgaaaagtcgccccgtatcatatgtcactagagaacgcagataaaaacaccaatgagatgccactacacccctaatagcatggccaaaatccagaacatggacaccctggatgctggtgaggatgtggagcagcaggaactcccatcattgctggtgggaatgcaaaatagcacagcttctgtggatgacagttccatggtttctaacaaaagtaaacattgtttggtcatatgatccagcaatcgtgcttcttggcatttactcaaaggagtttaaaacttatgtccacgcaaaaacctgcacttggatggttgtaggagctttatccataactgccaaaacttggagcgaccaagaggcccttcagtgggtgaatggatacatcgtctgtggttcatccagatcatggcatattatccagctattcagtgcttgaaagaaatgagctacaaagccacaaaaagacacgggggaaatgtaagtgcatattgctaactgaaagaagaaagaccatctgaaaaggctacatcctgtaggagtccatctctaggacattctggaaaaggtgaaaatttgcagacaatgaaaagatcaggggttgccagggtttggaggagggggaggtaaacaagtggagtacatgggatttgggacagaaaaatcaccctgtatggtgctgtatactgtaatggtggatacatgccattgtacatttgtctacacccacagaatgtacaatacattctgctatggtgaaccctaatgtaaactgtgaactctgggtgggtggtggtgattgtcaatgtaggttcatcgactacaacaaaaaccccctttgatgggcagtgcggacagtgggggaggctgcgactatactggggacaggggcatggggtaactctgtactcaccactcaattatgctgtgaaccccatgaaaggaaaataaatctcaggatccccaaatcgctaagccaaagggaaaagtcgagttgggaactgcatcggacaaacctgttttccatttggttcctaaataagatcgctacaaagataaaaaaaagctacatgcttccctcgtgatttgcccacaaggaaattccctgtggacaaaggacagacagaattcaaagtcatccccctgtgcacctgagacaaacatatatctaattgcttcctctgccctattgcttatgtaacaatgcagagtcactgagccagaccaaggcttacgtgatgattcctgctctaccctcctctcacatgggaattgtgtattcggtgaaaagctacctatgacctggaagcccctgctgacctcaagttgtcctacctttctagaccaactgatgtacattttacgcagactgatattgattgatgtctcaggtctccctgaaatctataaaaccaaactgtgtctgggtgcggtgtctcacacctgtaatctcagcactttgggaggccaaggtgggcagatcacgaggtcaggagatcgagaccatcctggctaacacggtgaaaccccgtctctactaaaaatacaaaaaactggctgggtggggtggcgggcggctgtagtcccagctacttgggaggctgaggcaggagaatggtgtgaacctgggaggcggagcttgcagtgagccaagatagcgccactgcactccagcctgggtgacagagcgagactccatctcaaacaaacaaacgaacaaaaaacaaaaaacaccccaaaaccaaactgtgacctgaccaccttgggcacacgtcatcaggacctactgaggctgtgtcatgggtgcatccttaaccttggcaaaataaattttctaaattgattgagacctgtctcaggtattttctgttcacaacccccaaattattaaagtctattaacaacaaacagccacaaaaagtccaacccagttcttctgaccccagtctttggctttctactcctgcagcaactacaagaattatgaggcagcaaagggtattggctgaaggaccccgagtgcttgatctgaaagccaccaaatccagaagatgaggcacctgagagcagctggcgggatggtcgggaatggctcagcccacattttcagatgcatttgacttcacttccggaatagagtgaagcctttcttgtgggaagatcaatgcaggctggcatttcaacatggtgccaaggtcaggatctcactttcctaagtgattacctgcatctctgccccgaggggatctgctcaccttactcaatcaggtgatggttagatctttctcaacacctttttctttcaagtaaatctcaagttgctttgcccagaaaacaaggaaaaccgactccttcctacacagagaatagattcctggattctctgcgattatttaatgtcagtggaaaaacattctcattactgtagctgggaagaaaaaaatgtgttgcacaagtgtgatttctattcaggacgtagtgtgggtttgtgagtagcataaagaaatatataaaacgcctcctttattaactcgttaaaatatgaaacaataaacagaaatgaaatacaatgtaatgaaatcaatatataagttagggttgtttttaattataacttaaattaaccagggtatctccattgtgcaagaatttatttccaaaactaaaatgaagtctataaacgtgcactcaattacaccggggaattgcaaattttctgtcttctggcattcaaaagatttttgtttcattaatggctaaaatgattataaccgcttgtatactcatttcctttaccaaaggtgcttatctcctttcctgagtacacatagtttgagagtaaaattaatttgtccctaaagaattattttgacctcaaaaacaaaacaacaaaacaaaacaaaaagaacaatgatttctgacatgaaggctccagagatgtaagtcgggttctgggcgtccgggggccctttagagaccctcaggggttcctccagcaaaggggaacggctgaggttccagtcctcatccagacagaagaactcagctttgttttaaatataggactttcttgcttcccttgaaaaatgaaaaaatgtttgaaaatcactccttcagcagggtgtatgatcatggtgtaggttcggtttcagacagaagaaggtggttctgtgtgaatatggttatgcatttggtctatttgttgttttgattttttttttcataagcacttacaaagcaatataggtaagtgtggggagatagcgtgggttcccgtgagaaataatactgatctctttcttgtgcctcagctgaacaatttgaaaccaagcattttatttttttctgtgctaaacaattgatatggtttgttgtgttcccacccaaatctcatcttgaattgtagctcccataattcccacgtgttgtgggagcgacctggtgggaggtaattgaatcatgggggcggttccccctgtactattctcacggtagtgagccttatgagatctaatgattttataaggggtttcccctttctcttggctctcattctctcttgactgccgccatgtaagatgtgcctttcatcctctgccatgattgtgaggcctccctagtctcatggaactgtgagtccattaagtgtctttttctttataaattacccagtctcggttgcgtctttatcaacagctgaaagcggactaatgcaacaatactatgacaaggggaaaatgacttggctccagtaaatctttgtttgacccaatcacaggctacacactgaggccaccctggctcaaggctcacttcaagacccaccttgcaggacaagcagttctaagctcacaggtcacaccctctccccaatccctccagttgctgccctgaaacactcaccttaaagctgcccagcccaggcctgaaaccctgaacgtatcttcctctattcccattttgagataccccggatgctatgtcaaggtggttttttatctgcagcgggtccaacaagcctggatttggtgatcaacaaagcccttccttgggtttttggagcatgagcaaccaatataaggaacttgataggccaaatgatgggaatttaatgtgcagattgtcttaaacagattcccccttggtagacagagctaggtaggccagacggtgctgctgttgggaggatttgctggtgaacaatcaaacgcagaaagatggcaccaagagtcacccttctgcggctggaacatcgcctggatgaaggcagagaaaacctttctatgcctgataccgagctcggaattttggcctaaggaggagaaagtgggttcgacagccagaagtcagggaacaaaggcaggaagacagcccgaccctggatggacgccagcccctgccttggggttcacactcaattctggaggcaatggggtgtgggatctgctttgacacaaattcatgagaaaaagatgtggagagcttcgcagatgacaagatcgatacagatcaagacagagctcctgacagaggcagcatggcctccgatgcttggaggagtcggcttgaggcctggctggctttgttctgatcaggcctatccagcccagaaccacagcacagcaccctcatccacattttaaaaagctcccaaatctaaaaccctgtggctgggagacgtaacctgaagcgacctaaggctctttgtcttcttgtgtacccctcttcctctgaatattcctgtgttctcatgcacaagttactggcatggctccatcagtccactggttattatttatgtgcaccgaattccttcctttcacatcggaaagaccctggttctgaattctgccacatttgtggcgaacagatggtgggcatttttaggactgatactttcatatgggaacctacccaccttcagcctgaccgccagcctccaggggagaacgtatggtggaaaggtgcggaccctgccacggtcagggcatccatggtcggggcatccacgatcagggcatccatggtagggtgtccactgttggggcatccatggtcaaggcatccacggaggggcgtctgcggtcagggcatccatggtcggggtgtccatggtcggggtgtccatggttggggtgtccacagtggggcatccatggtcaggacatccacggtcggggcgtccatggtccaggcgtccacagtctgggcatccagctccatcagaaccatgggccccgcctctttggcctatgcttgtccatggccacccctgagttagaagcctgctggcttctgtcctcggctgcttgtcccccatcccatgtttcaggaggtttttatttttatttttcatgtatgagatggagtctcgctctgtcgcccagtctggagtgcaatggcatgatctcagctcaccacaacctccgcttcctgagttcaagcaattctccagtctcagcctcctgagtagctgggattacaggtgcctgccaccatacccggctaatttttttgtttgtaggagacaggatttcaccatattagccaggctggtctcaaactcctgacctcaggtgatgcacccgccttggcctcccaaagtgtcaagtggtttttaaatggtccttctggcttcagcaggtgctcctctgggagccaggctgtgagctgtgggctggccttgctggatttggggaatgggcctgagagagtgtccaggcccctgtgggctgtgtgaggttggcctggcttgctggcagcatcgcctccatggttgctcccagcacctccatgtcttgggtgcccatgtggtatcatcgcaaggcatagtggcgctgagcctgcacaggtcagtggccttggtgacttccatctgtgctcattttcacattttggttgtggcacccagcccattaggagcctcagattgcttggccagactgggatcagctattaataccaggaattcaggttttaattaagcatgggtgaatcaggctcaagataatagctccatatgacgaagttcattccataacgttgctggttctaatgtgaatgggttctcgttgatttttattctaaatttcatttttatgaataatatatccacatggttaaataaaaagtggaaaacacataaaaataaggcagcagttccccctcctgcccagaggcattttctctggacctggttcctcatggaggcagcaccagtgtctgtcatcgtggttcccctctggccgttagacgagaggctctgcaatgctgaccggaaaaaaccatgtgcttttgtcaggcttggagatttgcagcagtcttttcatgtatttcatgtagaggttgtaaaagttggtagcatagtcaaactcatagaaacagagagcagaagggtggttgccagagccggagagtcgtgcagggggttgctggtgtgaggtggacggtggacggtttcagggatgggaggagtgccttctggagacctgatgctcagcacgggaaacgcagtcagtaaccgtgcgtcgtctgctgcaggagctgtgatgagagagtctccagggtgctcaggttactcagtaaaaggggaactgaccacctgaggccacaggcgtgctactgagcacagatgtggaaatcgtttcacaatgtacctgtccatctaatgccacgctgggctccgcaaacaggtgcaatttctatgtgtcgattatacctcagtgaaactgttctaagaatctgtgtccgaagcctttttaattcatcctttgtggttcctcagaagaggattcctcaaccttgcctgggctggggcctcaccgggagcctggtccccaggttatggactccgcctgagtttgatgggtgtgggtgggagaagccaccctgaatccagacgcagcaccagaggcagggctgctgctgtccctgcctcggccacactgcagggctgctcggaggctccgcgagggcgtgccatccccttccttctttcctccctctcaaaaatgccccttcgtacccccacccacagctcattcccactaagcactgttaaaagggttcgctgctgagggtctacagctgcattattggcgaatgcctggacccaaaggcatcgagacagtggggctgcatttgggggcaggggtcttcatgggagcccctgagttcattctgtgcccttttgggggttgggggactgctccctgtcttcagtgtctgtgcaattcagaaagtgctctctgggtgccacttccctccacattaaatggatctctagtttccctgtctctgaatctctcttacacacagaggcgtgcacgcacacacacacacacacacgcacacactcaccaggacccccccacctgccgccgtcttgttggacgaggtggcagattgtgttatgcttgtctgacatgattccacttatgcctcccatggaaaactccttagggcagggacttggttcagcacaatttcatctattattcagcaatctctgtgtagcgctggtatcttgtaagtgataaattattataatgaaagaaaatcttcttgccagttcatcttggaaaacacaagatcgacctccggccggcatccttcacctcacccaccagcctgtggacagcggctctcaggccctcctgggcaggggttccggctctacggctgaccctggtacatgggctttttacaaccctggttttccccggattctcctgtcagggtgggatccctttagagtgaattcaagatcttgtttaggaaggtttggaagaagatgctgagagcaccagacacccaggatgggataaaatgcttttgatgacaataataagctcagatgccctcgcaagtataacaaagcccagctcctcctccgtgccacatgatcccctctgtcacccagctcccctggcccaagccacactctgtaggtctcctctctggcatggtcccctctgtcacccagcttccctcgcccaagccaccctccataggtctcctctctggcatggtcccctctgtcacccagctcccttcgcccaagccaccctccataggtctcctctctggcatggtcccctctgtcacccagctaccctcgcccaagccaccctccataggtctcctctctggcatggtcccctctgtcacccagcttccctcgcccaagccaccctccataggtctcctctctggcatggtcccctctgtcacccagctcccttcgccaaagccaccctccataggtctcctctctggcatggtcccctctgtcacccagctaccctcgcccaagccaccctccataggtctcctctctggcatggtcccctctgtcacccagcttccctcgcccaagccaccctccataggtctcctctctggcatggtcccctctgtcacccagattcactcacccaagccaccctccataggtctcttctctggcatggtcccctctgtcacccagcttccctcgcccaagccaccctccataggtttcctctctggcatggtcccctctgtcacccagcttccctcacccaagccaccctccataggtctcctctctggcatggtcccctctgtcacccagcttccctcgcccaagccaccctccataggtctcctctctggcatggtcccctctgtcacccagcttccctcacccaagccaccctccataggtctcctctctggcatggtcccctctgtcacccagcttccctcgcccacgccaccctccataggtctcctctctggcatggtcccctctgtcacccagctcccttcacccaagccacgctccatcggtctcctctctggcatggtcccctctgtcacccagctcccttcgcccaagccaccctccataggtctcctctctggcatggtcccctctgtcacccagcttccctcacccaagccaccctccataggtctcctctctggcatggtcccctctgtcacccagctcccctggcccaaaccacactctgtaggtctcctctctggcatggtcccctctgtcacccagctccccttgccctagccatgctccataggtcgcctctctggtccaacagtgtcaggtgaccatgagtgcccaatactcttgagtttatttaaatcatatgaaacatcctttaggtgactggtaattagaaatacaagcaatgacaattttttaaaatttaaattcctcaagtatggtccactgtacaccatttctgcgaagtagtaataagtgcgggcttaaagaagcagagagttctgtagtctcaagagtttagaaaagtcttctttgaattaattaatttatgatttggtttgtttttgcttataactgtggctcctcagcaatattacttctaacgtgactgcatggacaaggttgatgatgggcaactttttccaagtttatttgacttttacccttctctctcttttttcctaatacagtgcttggtagaatggtttgggggaattttataagaatgagcccttgagagtagaatttgatgatatgtgaagtgcttctacatgacatcttctgcccggcccatctcatgggattcggagagctgcaggacccataagagccatccagtcagctgcggcttgtcctcctgatgtactgacttaaaaacaagtctgtgaggccgggtgcagtggctcatgcttgtaatcccagcactttgggaggccgaggctggtagatcacgaggtcaggagttcgggaccagcctggccaacatagtgaaaccctgtctctactaaaaatacaaaaattagccaggcatggtggcgggcgcctgtaatcccagctactcgggaggctgaggcaggagaatcgcttaaaatccaggaggcagaggttgcagggacctgagatcgtgccactgcactccagcctgggtgatagagcaagactccatctcaaaagaaaatcaaaaaacaaacaaaacaacaacaacaacaaaaaccacgtctgcgtgactgcctcccggggcgaggtagcatgcctcctgtccacatagctgtaggtttctctctccatttttctcctcaggtcttctgtggtggggccattttcacctcaagtctccaagagcagggcctttccacccagtctgttggaaaggattttggcgtgggtgtttgccgtgagcagatgttgctaactcaccatcaagcggcccaatctctctgagtgggctgagcaaacaccctggctccagcacagggcctcagacagaccctttgcagtggccttagcactgagagaaacgcccactcctcgttttcttggctaagcaaggggctccttttcagaattaacagttaaagcagcttaggctgctggagcaagatcaagagcctgtgctggaggacgcttaaagagcctccagtttttcagccagtggcatgatatcaggtcctgtaagtggagactcgcagaattgcacaatccgggctcccttcctcccaccacttcgttgtatcggggcagagcaaggcttgaagatgtgtggcatacctgtggtggggtgccatccacgcatccagcacacagccgctgagcgcccactgcctcccccatctctgctggggaccagggctgtgctgcaggatctgaggaagtgcaggaagcggtctttcctcaggggcttggtggctcattcctagacctgcccgcccagcacagacaatgcagggagccaggtggcacctggggcgtggcctgaatgtcatacggaagctgaggcttgggaacggtgcacttataacatagccgaggttcctccgcatggataatctttgagctggcttttggaaaataagtaaacatttgcaaggcacagaaaaagataaaaactttgccctcagagaacagatgatgattaaattcaagaaatgcgctgaagaacagcttgcctgcatggaattcctgtgttgagaagagagggtctcagagtacagcaacagggagaccagaaagaccaactgagcacccggcagtggcatcagacagtatggtatggaggctaggcctcaccccagggcactggctaaggacgttcagaaggatcaacacatcaatacagtcagatttgtattagaaaaaatagtgtggagggcggatgtggcaggggcatctgctggtcggaaccatggctgccatcagggtcagaggctgagggccgaggctcagctgtcaccatgaggccagaccctgggattcttccctgtcctcccagtccaatgccttttccctggagccccatgcaggcactgcttgttctgcacagaccccagagagaccagagagaagtattctgcatggtgcctgtcttcacaatttctacaattcagccgagagacaaaatcctcccaggtgaaccattttaaaaacatttgtgccggtcataatggacttcaaagttggtttgtggggatccacagagatcagagcagccctaggcccagcagctttggacatctacatgttggagcctatggggagaatgagctcacttccaggaaagtaaatgtgctgtgttccacagcccgctggcctcgctcatgccttctgcactctccaggtgtgtgcttcacagacaggctgctctgcctacggctttgtggtctgtttccacttgtggccaggtctcatggacaccccttcatgacttgttcacagaaagagtgaagggggctctcttcatgctggtaaccagccaggtgcaagagctggatgactggattttgtggactgctgggttgcatatatctttaggatgattgtcttctaagaactcatattcaaaaatgacaataacatagtttgaagtggtactcaatggcaatgacatttttgacaaggaaaacagtgatgggcatcaattggaacatcatgattgtttttcttatatcccatttacttgtggggaaaaaccaacaagtttatcttgtttaggagtaaaatggctcaagtataaagaaaatcttccatgaagagggatccttttggcctccctgtaagcattactgctctataaatgatttaataacactgataatgaccatcggcagctaggagaataaagtccggcaccgggagagaaatgtcacttaacaaatattcacgtgcaaccccctgcactaagagctgagtgaagccccctggagaggccccatcaggacagaggcttgcaggagagatgcttcctggcacaggccctgatccctgcaggggctggggaggtgccgaggatggacccgctggctgagtggctgagaccaggggagcactgctcagaataggatgagggaatcggtgtcacccggccatgagccccgggacacagagcacaaccggacagaagcacctccgggaaggcctgtggggtccgtggggtctagtggggaagatggcaatgttgacgaagtggcaaagcaagggtgtcccgcagcaggagggagagtgggagcaagccaggatttactggcacccggagggtttagtcttttattccatttcccgtcactggtgcccagagtcttcttgggcaaaagggaatgggggggcttcatcgccgacttctctccacggtgggtggcagtgtgtgattgttaaagggaaagtgagcctcctgcccaggagccacgagactcaagaaagttcactagaactaccgaccacagtattaaggaattatgattatataggcacagagcatggaataattatacattatgctgatggtgcctttcttttgaagagttgtaagccttcattaaaatcttgcaaatgacagtaatgaaatgaaaataaagcctttcaagtgaagccctctgggtgtttttcttttctcttttgggggagggggatatgtgtatatagcaaaaatgaagcagatatttaggtgactatgatttttatcatctttaaggcaattcccaattgacagagtaaacagacaacctacagaataggagaaatatttgcaaactttgcatctgacatagggtcaatacccagaatctacaaggagctcaaacaactcaacagaaaaaaaataacctcattaaaaagtgggcacaggacatgagcagacattttcaaaaagagacatatgaggggccaagaaacatatgaaaaaatgcttaaccatcatcactaaccatcagagaaatgcaaattaaaaccacaatgggacatcgtctcacaccagtcagaatggcagttattaaaaagtcaatgaacaacagatgctggtgagcttgtgaagcaaagggaatgctactatgctcttggtgagaatgtaaattagtatagcttctattgaaaacagcttggagattttgcaaagaactaaaaatagaactaccattcagtccagcaatcccactactggatatctacccaaagggaaagaaatcattgtataaaaaagatgcttgccttcctttgtttattgcagcactactcataatagcagagcatggaatcaacctaagtgtccatcagcaatgcactgaataaagacaatgtggtacatatacactgtggaatactatgcagccatgaaaaagaaagaagtcatatcttttacagcaacatggatagagctggagaccattgtcctaagaaaaataactcagagcatgtatcaaatgccacatgttctgacttgtaagtaagagctaaacagtgagtacccatggatacactgagtggaaaagtagacactggaggctccacaaggcagagggcagaggtgggggcatgagctgaaatgtcacctgctgggtgccctgtttacaattccggtggtgggtgcaccgagacattccctgctgggtgccctgctcacaattccagaggtgggtgcactgggacatcccctgctgggtgccctgctcacaattccagaggtgggtgcactgagacatcccctgctgggtgccctgctcacaattccagaggtgggtgcactaaacccagactccaccactatccaatatatgcatggaagaaatctgcagctatagcccccaaatctatagaaataaaataaatgaggatcataacttaaaataacaaaagcaagtccccaccacccagccttgctcagatgcccacagtagacaaatatccgtggagaaacgggtggcgatgtggcccattgcttggaccgaaacgggtcggggatgtggcccattgcttggagtcctgatgctgagctacacacaattccggaagatcctgacagcaagcccctgagaggagaggaggaaggatccctgggcaggaggagcccacagaagatgcagaaggccccaggagagctggcgtggggacacgaaggagctggctgtctggggagctctgggtcaaagcttaagcaagccagggagagccctggccctctggtcaggaggcagactggaatccgcagacagaagcgaagggatctcccaggcagggatctcacagcctgcggcacccaggcaggaaggagtgaagcccaggggagggagcggatgcccatgaggttcccaaccggaagcccagggccgcggtgcacacctgctgtgtggctggacagaggcgcagctgccggtgtgtggtggccccaggccctcagctgttaccatgcagcccagtattgtagctcacaaccaagagtgccatgttaacgggaggactcaaaagaaatcttaattgataaattgagaaagtgtgtatgtgttttgtgagctaccagtgtatctcagacgtaaaattccagcttcccagtttatgattggcacgggccatcctccctgcagcgttgactcgcttgacaaagagtttcaggggctgagggggtggaaacaaagatggaaaggccgtggagaatctcactgttctatgaccagggactgacccagaggcttctgtttgctgagctgcaaaatgaggatgatgacgggtgaaattcatacaagaactgtacagattaagtgagaaacatgtaaagtgtgtgtcactttgacctgcaagcatgcagtgacgaccggtagctgtgaatactgccactgtcatcactatcatcatttccacgaccatctcacattatgatcctgtgtacagggaagcacgtattggaaatatgggtttggggagggtgtagtcctgaagagccgttaattaatattttaatacacattcatggtaccagaaaggacactaaatttatgtggaagatgcaaccctcccagttggactttaaatcacaacagaaagacagattgtgaagtgggtcagtgaggggtttaggaaaaaattcgcacctggcctcttaagtatcccttcctctgtctggaagcctttgtgaaactttgttttttttctctttttgagacagggtgctgctctgttgccgaggctggagtagagtacagtggtgctatcacagctcactggaacctctgcctccctaggctcaagtgattctcctacctcagcctcccaagtagctaggactccaggcatgcatcaccacacctaatttttgtattttttttctagaaatggagtttcaccatgttgccctggctggtctcaaacacttgggctccagagatctgagcacctaggcctcccaaagtgctgggattacagacatgtgccactgtgcccggcctgtgaaataatttgatgacaacaattgcttctactttttaaaaagtcatgaggactccacgtgacaatgccaggttcacctgagggtaggccacatgtggtataaatagtgcagaaatgggagtggtgggaaaagcaaatctgctggcagggagaagctgcagcctcagatgggcccattaggtgtttgcctgggatggggtgctgaggcctggctacacttagggaaactggcattggcaataccttatcccagaaactgctggccttcattgcccgggtccaatcctattgttaacacctgatagaggatggatattaagattcaagcaggaggccgggcacagtggctcacgcctataatcccaacactttgggaagctgagatggggggatcatctgaggtcaggagtttgagaccagcctggtcaacatggcgaaagccccgtctctactaaaaatacaaaaagtagctgggcgtggtggtgcgcccctgtaatcccagctactccgaagtccgagtcatgaggatcacttgaactcaggaggcggaggctgcaatgagccgaaattgcatcactgcaccccagcctgggcaacagagtgagactctgtctcaaaaaaaaaaaaaaaaaaaaaaagattcagtgttaccagaaaggacactaatttattatgtaatagctgctccgactagaaggagtcccattgatttccactctcccattcttcctatttggcagggaacttaacaacagcacatgtttgggcaaatctatgattctctgaggcccctgttccatggtgatgctaaatccctcctcccaggtgcatgtgaaaatggcattctatggtggagaggaagcagccagcacgcagctcctcaaggcagattagctggtgggagcgatgatgacggcggccgcagaagcagtgactcttgcagcagggccttgctcagtctcagaggctgatgctacgtctaattcatgagaggaagtgagctctgagtgtgaagagcctgcagtactcagacacaagttcagacaggtttgcattggccacagaccggctgctcagaacagaaagccagtttgcctgttcccgtcctctttggaacacccaactcataaagtcacagagacaccacgtgtggctcagagactcagtgggagcttccctaggtttttgtgaagcctgtgagtggtcactggagcccaggcgtcaatgaccaagtggaagataggccaggtgggcccccactggtggccatcggacagaatccaggttcggctctgcagtgtgggtctaagttaactttagtccagttttcttgccagcatgcccttctcacagtaaacggtttcctgtgccctgaaggaatctccccatctcagccttgccaaatgcattcaattttcctgtaacaacatgatttaaagcctactttaaaaaataaacaccgatcttagctattgtgtcttagccagagagctggcctcacaggaaaaaggctcatgtctgttccttttgcatgaaacttggcatgctgtacacacgttagaaacatgtgctgagctgatgagcagctcaccaaaaagaaccacaaagctgatcggtgtccaaggaacgttggtgggagagacgatgtgctcctgacgacagccacctgctcccccgaaagccagcatcagccgctgcggtctgtgctccggggtacttccatgcatctttcaaagaaatctttaggaacagttgtcactgcaatccttgtgggtcacagtgagaaaagttcagtttcaatagaaaactaagccacagataaaacaaagcaaaagcaaaagcattgaatgtgagggggtcccattccctttgtggaaacccaggactcagcagaattcatggacgttcttagtagagtcagccatcactacagcaagttctccctcagagatggactcttggaagccactggcaggagggctcatgggaaccggtgcgtgttgggtgctgtgtgcaaacggagcagggacaggctcagagggcctgaagctggcggggaagtcgctaccctaccacccagcgatggctggctgtcctgcagtgggttctgctgactccacacgggggactgactcccagagaccctgatgtggactttcaaactggcacctgctgaatgcacaccacgggtggtcaggccagtagggtggaggagccgcttcccgaggttccttctgtgcctgcagaggcctgagagccaggtccactctgctttcaatgccacttttgagcgcgttgtgttttcccagcgtctccctccccacatcagcaattcctcacaccacgctgagggaagaatggctcccgatgacaggcctcccaaggaatggaggaggggaagcgtgatttttctcctttcctcatccctccggcatccatcgactctccatgataaatgaggagggcacgacttcttttgtcattggagaaactgactccacattgcacagccagggagaggctatcctggctatttcctcaagaatgaaccttgatggtggctgtgcagatacacacacacatccacatacatatgcacacacacctgtacatacacatccacacacatatgcacacacacctgtacatacacacatccacacacatatgcacacacacctgtacatacagacacacaacacacacacacctgtacatacacacacatccacatacatccacacacatatgcatacacacctgtacatccacacacatatgcacatctgtacatacacacacctctacatacacacatacacatatcaacacacacacacttgtacatacacatatgaacacacacctgtatatacatagatgcacatcatgcgcacacctgtacacacatgcacacacagacacacatcaacacgtgcacacacaccaacacacacaactgtacacacacatacacacatcaatataaacacacacgcacacacacctatacatacacacaacacagacacctgtacacacatacacacatcaacacacacacctatacacacacacctatacacacataaacacacacacacctgtacacacattaacacacacacacctgtacacacattcacacatgtggccggggtggagctgggatgaggaagatggattcttcggacaattggtaggcagcacccccggatgacagcagggctgtgtcagggacggccatggctatggctcttcctggtgccgcattgacaagggccaggaagcagcaccggcttggagcccgaccctggtagtcgctccgctctaaggacctttgcacctcgaggtcctgagtagggccagccctgctacctggacagagatgaggatcacaggactgaagatttctgcttgtgaaaaggatgtcccctaacctcctacccatagcgtctgaaatcaccctgattagaacgatttccttggccgaaggaaggcctgagtgtcaccgagagagcacgaggtgcccagtgccatggaggttctctctacgctgccagttgcacttttgtggtttatgtgacagctcacagtatgtacagtggtcataagtcacagtcacatacaattttagagctgtgatcttttttttttttttaccattttcaaattttatcgtaaaaaatggagtcctaaaaatttgataatttgcttaggcacaaactgtagtattaatatacagtcatatatattttatttatttatttattttgagacagagttttactctgtctccaggctgtaatgcagtggtgtgatctcagctcactgcaacctctctgcctcctgggttcaagcgattctcctgcctcagcctcctgagtagctgggattacaggtgcacaccatcatgcctgactaatttttgtatttttagtaaagatggggtttcactatgttggccaggctggtctcaaactcctgacctcaagtgatccacccacctcggcctcccaaagtgctgggattacaggcatgagccactgcctctggccaatattttatatctatctatctatctagtcaatactcagtcatcaatcagcatttactatgaatttttcagaaaaatatatttttttcagctactacagaacccagataaattctagctctcaaggaatggccttataaagtataaacaataaacagtattttctccagaagttagtgaatgtcagagccttttttgcattatctcattttaatctttacaagaattatttgatgtcgacccgacgttgactgtttctagaagaaactgatgttgaaggcgtgggtgtggcttccctgtgatctccaggctgggaacaggcaggaagattcgacccagatccctagagccctgggtcagcccttcctggaaagggagagggagtggatggagaattactccagggagaggccaggcactgttttgtttgcactgccacggtttacgttttcacaccacaatcagaaatactgtagcacaatttaggggtaaaatacaaagagcctggttttgtagtgttttgaatcttacatctgctgtatattctctttactgttaacaccaaaaggaaagagctgctgtgaatctattacctgtaaccggtccttgtctcctctaagcctgttcctcctcaacgcatgagaacgttacaatgagttcatgcatcaactatagtgtctggtgtattttatttggttctagattcaaggggcacccaaccacttctcgtggtaagtttggtgaggacgtctgtgtgcatgaagctctgagcaatactacaagtgtctcccaattttatcatttctgctatgacggagatgcatactatagccaaaactcagaaaagagataaaaagggcaaactcttatggtcagagaactcaaaaggcacattttccatgcaattatttttgtaacagcagaataaacccatttatctaatagagttatagtaataaatagtatattcaatttttcgtagggatgatggaaatgtcatctacataaagccagaccgaaaaagctgttttcaaacagaccctcagggcagaatccatggttcaggtgagtcctcccttccttctcttcttctggctggcaagccatgccttctctttgtggcctcagtgggtccctgagcgcctcgttccttcagcctggggtttacagggaacccctgagggtttgctggtcactgatgcaatcaggttcttgtgattccacgcagctcttactgtgacaatgtcaccttcccgtctctcagaggcattgcccagggagcgaggtgggcctggagaccactggtgcccttctttccttgccaatctctgattctggattgaatgggtatgaatggtctcctctgagaagcctggatttaggattcagtaaaaagtccagggtgaccatttcctactgcacttgcacttataattctacttgtaacttatttttaatatatgtagtttctattgggataaggaaaatgcacttacttattcaagtcctagtaagttgctttttataactattttcttaaaaagtaagtacccaacctacagctactattgcctgaggaggcaaaacattttggatatataaagagggcccttacctttgaaaagaaatgaaatttctgctttagatgtctcaataacaggaagagtgatgcaaaagggcttcaacgtatattggcttagaatatgaatttatggacaacttagagaacgttaagaggactagcagcccattatctggcaaatgaatgtctaaagtcaatgattggaatgaaataaaatattgattttcatgacaaaatgtccatagaacaatcagtttgggtgaacagctgcacagttctggaatttaaacattcaaacagtctagtgatcacgatgtttaccaatcaatttgttagtgatttagtttaaaggatggcatttacaatatgtatatttctttcacgtgaaaattacacgcaattcaagatcattcccgttggtgattcctgggctgggtttcaggttctccatgtctcttcccccgctccttcctttcctgttgcccaagtttgggcatgcagctggtgtcccagcacctttctgggggcctacagtcttcaccctatggcactagttctcgaagttctcctcacatggggcttagaagtgcaaagtcaagccccagcccagactctctgagctggaaacctgagcgggggggagcatcctggctgtgcctggcaagctcccaggtaaccctggacacacctggtgaggagtgtgaaagaatgctctctacgcaagcaggtgagagccctgcttcacagcccaaggaagggacgtgggaaaggtttagggcctgcaagagacaatatgcctttcagacagaggctgattggcaaaacatgcaatgagatgaatccatcaagcctgtgtccatcccaagtccgaaggagaccacgagagagccagctagagtcccacaggtggtcaagagggaagaaaaggtgcagggaagggatgatttctttctggccggaagttctttctctaagcaagcaggtttagcggtagtagaagggactctatgggagtgtgggttggggcacttggagagctgacaggctcctgcacagactgaacaggagacacactgggctggtacctgcttcctgcacggggaacagaagccattgaagccagggcccattgagtcaacaacaagtgtgtgtcaggcaaactaaacctgaggttcacattaccccagtgaaacggcctgtgctgttgtgccattttgtactgattttgtccatccatgacagaatgtggggcaaatagaccagtaattcaggcaaagaatgaagaattccaccatctacttaaactgccaaaaggagtgaggatttttaacaacaacaaaaacaaagcaaaaaatataatgtctaatctggacaggtaacaatatacacgttttgaaatgtctataattcaacaacaaatatgaaatgtaatccatttcagttaggccttttaactttgataaataaaatgaaactttgaattttcttctcgcaagtggctgatccctaactctggtgggcagaagttgggcttcccctggccgaggtctccgagggctgagctgcccctcttcctccattcatgaacgattcaccacgtccatcagaggctagagaggacccggttctctgtcacttgttagtaatgctaggccatttaggctgggacagaggtctgaaggaccctgaaactctggagtcacagaaatatagtccacgctctgtgtcccaagacctaacctcggctctgaagtttctcatcacctaatgctgtgatctgcagctgagacacacgtttgagccacaggctgctgtcctgcttgagaaatgatgatgaccacatcccagacaccaggcaccagctaccgaagccctattcacctgcagacatggagggacgccctgacccaggagctctgcatcagtgccattcactcctccagtaaagtacgagagctcgttgatgctgacacgatgggaaccctagggaccctgcccgcagcgacatgcatagaatcatgactccaggcaggggacgtcacacggctgacttctgactccaggaggcatccgcccagtgcctctggacctgcctggggctccagccatcacccacactggacatgacgcggctgacctctgtgggcttagggcatggtcctccaggcctcgcatgaactttaagtggaaaagtggcttctaataggtaagtagtggttgtttttaacatggctcccagcttgataatttcagagactgctgtctacccatcacaccccacacaacagtgtgcaagggcaatgcaatatagccctgtcccatggggggccaagaccacagcatccactggaaactgacgtaggtttcagggggattctgaaagaagggtaaaacacaacttctggcatcatctatttatcatcttgttcatgaaacaagatccatgcaaatggaaagtgatttgacatagtataaaagtctgtgccaacgtctggagcggggtttggaaagtccataagatattaaaggaggaaaaggtattttgagatgaccttttgcatttgcctcacagtttatttcctggatttatgctcaccgggtccctcagtcccagaggtcatggagacgcagcgtgcctgtgctgctgctgagatgtttgtccaagagaatttaaatcgtcaccagcggcaggaaatagtgagtgtgcagtgcatgaaagaactctaccactctatcttcggggaccattgacagacgggaggaaggaaggggatgagaggagggaaggaaggaaaaaaggaagaaaaggggaaaagaagggagaaagagaaggaaggagaatggaggaaggaaagtgggaaggaagagaaagaaagacagaaggagggaaggagagaggaaggaaaaaaggaatgaggaaggaagaaaggaagaaaaaagagaaatgaagggagggagggaaggagggaggacgagaaggaagaaaaaatggaaggaggaggaaaaagtaagaaagaaaaaggaaggaaggaaagaaaaaagtaagaaagaaagagaagaaagaaggaaggaaggaaagaaagagaaagagaaagaaagaaagaaagaaagaaaagcaagggagggaggaggaaggaaggagagaaggaagtctgggagggaggggagatgggggtagggacagcatttccctccgcattgccggccctctgtcttgagcccctgcagggtgccggatggccatgccctattgtgcgtccctcttgcagcaacaccacattaaaccgtggcatcctcttgaggctgcccctgcggattgcacggctaatgcagaaggctagaaagaaggacccgaaacgcccaccaaactataaattaaggcgaagatctcaggagcaatgtgcctggtgcccggcgtcgctggcctttggtcccctttcagggagcctgaccctgctcccagagacgcttttcggattcgctcagctcacaggcgggatgggaatgtgccgcagggctgctgcctcacacgtccgggtttaatagacttttttccactgataaaagaccactaatgagttcattttcaagctattaaacgggctataatagctagttctcctgatgattgcacagagacccgctggtcacagcgggtttgtctccctgattaactctttgctgccctggtgccaggaggctgcgtgcctgggaaggcggcacccccacctgccagccctgtctgcccctgtctcctgctttcaggttctcagggccaagaagcctcctggcccgaggacccacaaatctgctctcctgcatgcatccaacagctgccatctcttcccttatgagaaaccttcggtcctaagccagggcatcagctgactggttgcacagagggtgtttcaatattcacatttcacatgagggactgcgtgctctcttaactgtgtgtctgtaatcctgaaagaacaccctaggaagacgcttcccttggggacactcttttatcaacacagggagcacatgggcggggctttaacccacacactgggctctactgggcccgggtgagctgtgtggctgcaaagagtgtgtcgccctgtgtctgtggtcatgaccacgcgtagcgttagcaaatcacctctccaggtgtctggtttaaacacccttctccagcatcggagggcaggtgatgaatagcagggcgctgacagtccccgtctgccctcttcattaggattgcagcaggccgacttcagatgcttctgcttagcataattttgttttcagctatttaagcaaaggtgcccagagaccttcaagcttgggcagccaccagctgaattggattgctgcatttttttttttattattactgcctgttttcctttttaagattgttttattatgagaggcccaataggtcagagatgttaaattgcacagtgataaatgctcctaggccccctccagcctgttctcaggatccttccagaatcaccgtgggctccctgcctccctgcagccccagggcccctacacgggcagttctgctgctcgcctccagcctctgcacaaggtgctggctgggaacccaggtgcagtctcaacgatacgatatgtccacaggcccctttctcctagcccagaccccaagttaagggccagaaacaggctttgctcccctctgtccccacactcagtgatgaacattgcatctatgtctttgcaaagacagaaaaagggataattttcagtaactagcactacttttctgggtaaaacaagtggacagaaagaaaagcactaggcactggggcctgtaaacctgagtcattgatgtggggtcgggacaggtgcctgccggggtcctcatccagcaccagctgctgagccgggaataaggggcttcctcgtcagagccctcgtctagggacttgctgggccacagatgcctctccatccggggtcttttagtttgtgtcccggcatttcacaaggtcataaggccaagcaagaatgctttaagcaggactgttcatggagatgggcaggcgcacacacacacacacacacacatgcacagacacacatgtgcacaggcacatgcacacatacagacacatacagacacagacatgcacacacaaagactcgcagacacacccatacatacacatacaaacacacatagacatgtaaatgcacacacacagactcacacacacacatgaggtgggggctttaactcatgaattttggggacctattcagcccataaaatgtccaccaaattgtacattagtggtaggaaatacatatggtccatacgacgacatcaacgttacaagcctttactttccagtcactggtgccgcgtgtctgcaagtagtcctaaacctccccaaacatacaaagggcaagggagggggaggaaaccttccccgtggacccggctttccccagaaaggctgaggagtgtcacaggctgagggctgggggctctctcaggcccgttttggaggcgcggagtgaatgcatcttccagcggccgatctttcttcttctcctggaccttcagtgtgcccaaggcccataaatcagcgtgtgctgctgaaatctgtaatactcagttcctctctcaacttactctcagaacaaataatttaagacactaagacagtggcagtatatctgatccaagggggaaattcactctcatttcgttggaaagcagctgcctggatgaaattctctctccaataattgattttctccctcttgctgcttcactcgctggagctccccattccccaaatgctggggaggtggggggtctcgtgggatgagaactcggctctccccctccactcacatccttaatgcatcttggcctcttcctccctccttgggaacagggcacggtgcccccattgatgttcctaatacgggaacatgacacatacattaggctgaaggaaaggaggaaaaaacatttttgccttgttgtaatttcagcccagaagtagcggattcatttcacacgaccttagctcaaggtgacttgatatatcgtcccagcgatgagattttttttgtgtctctcttatccacccatctccttctgaaggaaactcttgcagcagtgaaaaaagatggacagacagagccctgggcaaccctggaccatgcaccccagatgcgtggtgcctgggggtgcagctggggcctcttcccgcccccacctgcccttgtctgtttctttctgtttcaccccgtgtgagcaaggagaccggtcttcagaatcacaaggaattaggcagaactcatctcccagcgctggggggcacgatgaggtgggttcgggccgaccagggagattggaggggatctttccagctggcaggtcctgtgactcggttcctccccagggctgagccgagggggccgcctctcccacagctcatcagccattaagagaaattcagaagaggctggggtcctcgtctttttctgagttgtgaggaggggccgcgtccttgtgcttctgcaccaagcacgaatctgccctgcaggagggaatgggcgtgttcctcaaatagaacacgggaagccaggaggaaagagcagagcggccatggccgccctccccagccaggacccgaggcctgagctccagagggaggggctggacataaggaggcggtcacaacgccggtgggtcaagcctattagaaagcagcaggtggtcatgaaatgttgttgaaacagaggctaagacagggctagcaattgttctgtagatagtacacattcctaatattactcatcttcccaactctgaggcagcctctattattgtccttgtttataggtgagaaaattagggttgaaagtcattaaataacgtgtccaaatcacctgccagtgatagagccaatatcgcagccctgtgtgttgcctgaggctcttctcttgaaccagaggtcagcaaactatggcccttgagctggatccagccagcagcctgcatatcttgttatttatttgtttatttggcatccatgaggtaacaatggtttttatttataagggctacgttgtataagcaggtacataatatcctcgttttgcctcttgctctgcaaaacctaagctactcactatctgatcttgaggataagtgtgcagagccctatcttaaactattgggttgtagtgattagtagctgaaataaatgttattttaaattatagtgtctgaagttttgatgaaagctgttgataatgggttgtgaacaagttaacacttccgtttacttctagagttacagcccacatgaattgaatgacttctagtgggcgtaacagagcttcagaattgtaaaggctctgatggacagctccccggcatctgtctgacagagataaaagtaaactttactgttaccctaacgtctccagagtaagatctgtggaaggagaaatgtacaaagaaaggcgtttacttacaggaagcaacatggttctcagaatgcctttggggcaaaacaagcattagccatgcctgaaatgtgtgtcttgtgtggtcagttgaatgtcttcaaacccattccatgaaaagattttttttaagcaaaaatataaatatcatgattcttcaatggcatgtctttataatttttcctactacttcttgtcgttaccatttcaaggacaacatccatgagacattcttcagtcctcaggattacctgtgatttcaaagcgaatttgaaaatccaccccagcagcagggtggggtaactgtgcagagtttccagcaactcatgcagccacccaaaacaaaaggagtatacagcagatgctcattttcgtgaatgcagagctgagtaaactattagcacgtcagtgtatccaggtttacatgctgtaatcgtgttcacccatgagctgggattttcctggaagttatcttttggtagagtcttcaaaggtggagttgaatagacatgtttcttattagctggtttctgctactttatgattagaacacgatgcctttatgtacaaagctaataatggagataaggctggatggtgagccgaaagcccgcagctctgcacctgagagcagcaagccagtggttaaatgtgcgcgggaagcacggggaaattcaaggagtttatttctccaggctttccaatttgattactatagagtacaaagctattaaaaatatgacctttgtattttttataccttggcaaaaagccagataataactttgtttgacttggttagtgtgatagagtgcttattcagatggaaataaaatgacttttctttactggaaattataccttgaagtctaaatgtccatcactgatacaacacacagacagcctgaaaaccaccgaggctgttaaagagaagaatgcagcatttccattttctcaaaggaaaaatttatatttttgtacagatgtcatcaacttaacatggtaaaaggtaaatctattgtttcaatacaaaagttaaaaaaattgattacattaacagaacatcaatgtttattacagctttaaaaagcaaaatagatactgttctctccttaaaacattgttttctcattggaacttttaaactaggcaaagcaaaaacatttggctacatcagcctgggttttaatttgaattttaaagaatacagaaaaagcaatgattttatttatctaaattaaggatcaatttctgaaagttcaccaaacatgggagatgttgctctcagggtttataacgagtgaaataaaaagcagattttgttgatgagttcccatcccatacagaaaaataggttccctcaatgagtattagcagagagagggtgtgtctgtttcaggacttagtaagaattttagaaaaaaatgccctttttggctgggcatggtggcttacgcctgtcatcccagcactttgggaggccgaggcgggcggatcacgagttcaggagattgagaccatcctggctaacacggtgaaaccccgtctctactaaagatacaaaaaattagccgggtgtggtggcgggcacctgtagtcccagctactcgggaggctgaggcaggagaatggcgtgaacctgggaggcggagcttgcagtgagctgagatcgcgccagtgcactccagtatgggtgacagagcgagactctgactcaaaaaaaaataataaaatgccctttttgttttgggtttaggaacataaactggtctcaggggtttatggctctttcttctcattgttggggaggagctcatgggccctgggtacacctcggtctactgagaagtgtatgtgttggattggtaaaaaacagcaaacaaagttacttctgtctgaggcctgaagttttaaatttttatttttttgctattagaaaataatgacaaaaattacaatagtgagaacagggtatgaaggaaagttctagaatggtcagcaggtgcactgcttagtggtctgtctgcctccaggttcactctccactgcctgccccaccttggagccaatgccatggccttgccttcccgccctgccatgctgtgctcacagcagccttccagattgaagtgtgcctgcccctccccagagaagctgggcatcccctccagcccatgctggggaggcagcacagccctggatgtggcccaggactcactgccatcgccagttacccaccacccagaggcccaggatgcgcggtatggtggatgtgtcagggtgcacagctgtccgggtggggcattgtccacccgggagagtgtgtcttacaccaagtccgatgcatgccatttccctcagtcagaaggcacagaacgcacagactcgaatgggaattgggctctcccactgacaacctcactggaaggatgtgtttcttccacccccaggacttgggtatgctggatttggagatgtagtgagcaaaggaggttttcctctactggagaagatggccatgcttctgtaagaaggaggctgaggctgttcccaggacactttcacctctccagtgttgacaccacttggcagggcagggactgttgtcctgaataccacagtccctcccttcggaaagtgggtgctcctacccagtggggcagcaacactgtgttgtaaacacgccgaattcaccagcctatgatgttcattgcatttgtcaatgggaaactgtgacccctaaataaggagaaagccactgaaaattggattctactagaaggcagattcagatcaccccacctgtcaaaccagcagaggagatggcaaagtggatcatccattttacaatgctggtggcagggggaggctggaattctatatttaggctttgtgccctccttcagaagtgaggaatatggcagctgtgttttatgttgactaattatactttttctcccatttttcttgccaccacataggaagggcattgatggtggcttgcatttctatagagggtcccagtgggagtgtaactggattgaaatcatcattcaaaactactgctgctagaactttgtatttctcttctgttgggaacttgaatgtttcatcgagaaaaaaaagaaaaacgaggatcagaaccagcaagtagtgctagatgtctgtgtgcccctccagacacactctaccctgagctgctgagctctgcatcctgggaactggcctcagagggttgcattctgtcgctagatgtttgtgtgcccgtccagacacactccacaccaccctgctgagctctgcatcctgggaactggcctcagagggttgcattctgtcgctagatgtttgtgtgcccgtccagacacactccgcaccaccctgctgtgctctgcatcctgggaactggcctcagagggttgcattctgtcgctagatgtttgtgtgcccgtccagacacactccgcaccaccctgctgagctctgcatcctgggaactggcctcagagggctgcattctgttgctagatgtttgtgtgcccgtccagacacactccacactgccctgctgagctctgcatcctgggaactggcctcagagggctgcattctgttgctagatgtttgtgtgcctctccagacacactccacaccgccctgctgtgctctgcatcctgggaactggcctcagacggttgcattctgttgctagatgtttgtgtgcccgtccagacacactccgcaccaccctgctgtgctctgcatcctgggaactgacctcagagggttacattctgtcgctagatgtttgtgtgcccgtccagacacactccacaccgccctgctgtgctctgcctcctgggaactgacctcagagggttacattctgtcgctagatgtttgtgtgcccgtcctgcccgtccagacacactctgcactgccctgctgagctctgcatcctgggaactggcctcagagggctgcattctgttgctagatgtttgtgtgcccgtccagacacactccacaccgccctgctgtgctctgcatcctgggaactggcctcagagggctgcattctgttgctagatgtttgtgtgcccgtccagacacactccacaccgccctgctgagctctgcatcctgggaaccggcctcagagggctgcattctgtcgctagatgtttgtgtgcccgtccagacacactccgcaccaccctgctgagctctgcctcatgggaactgacctcagagggttgcattctgtcgctagatgtttgtgtgcccgtccagacacactccacaccgccctgctgtgctctgcctcctgggaactgacctcagagggttacattctgtcgctagatgtttgtgtgcctctccagacacactctgcactgccctgctgagctctgcatcctgggaactggcgtcagagggctgcattctgttgctagatgtttgtgtgcccgtccagacacactccacaccgccctgctgtgctctgcatcctgggaactggcctcagagggttgcattctgtcgctagatgtttgtttgcctgtgcagacacactccacaccaccctgctgagctctgcatcctgggaactggcctcagagggttttgcattctgttggtttcagtgatagggagggaggctcaagggttagttttccttccagtctgtttgacagttgctgtgtttctcttaagctcaaaacttttgttggacggctcttcccctccaactacagatttccctgagttcagtgaattgctgtccacttttttcccctaaggctgcatctccccgggagcttcatcatgccctttagtttctgtgacattctctgcacctttaagacgacttcctttattaaatttcttacttaaccctctgagtgtgccatctgctgcctgcccaaacaggtgtacctaagttccagcctttactctaacagaatgcctttaggtgagtcacagaattgctctgtaaattagaagagcaggcttgtttatgaacttttcttatttaagatcctataagtccagctttactttaaaaaatccaccaccatgactataacctctttactgccattcaacaaccccaaattataactgtttagtggatattgtaaaagtatgtatagcttatcacctttttaataagtccaataatgcttcaaacttaagatgaatgagaagattctaccaaccctgaaaattcacatacctatagaaaattctgattattcaaccataagacacttcataataatttgcaaaagtaatttttactttcaacaagtcattttttttgttcaagtacagtgtcactaggtttaaaaatcagatttttttttgagagagggtcttgcacttcacatatgctggagtgcagtggcccaatattggctgactgcaacctccatccctggggctcaggtgatgctcccctctcaggctcccaaaagtcagatcttaagtggtgccacctagcaagtttgaggtagttaaaaatctgtgacgtggtaatcgacagtttctcaatgaattaaatacaaataaaagagtattgttttgttggagagatcattgtggcaggctcaacaacaaaaacattaaagccactaaaaacaaatcacaggcgagatttccagcaatggccatttgaagagaaaattaaaccctctcctccaaaagcaactatacagctgaaacccctgccccctgcagcttgtagaagttctgtcagattaaggcaggctgcgaaggaactgtagcttcttggctgcaattaatggatcacctggcttggaggaatgaatggtgtaaaataatcaacagaggagttaaagtgatacactcagttattcaggaagagattgagaaggcgagagacatgtggaaaataaattgcaaaatggtaaatgtaaatccagccatatcattagttgcattaaatatgaatggtctaaacacccaaataaaaagagcagagatcatcagattagataaataagtaagatttagctacatgctgtctacaagatacattttagaatcaaagacacaaatacattgaaagtaaaaaaaaaaaaaaaaaaagaaaaaatacgcaccatacaatgactctaaaaaaactacatttgctgtattatttattgatagaacaattaggtggaaaattaaatgacagtattaatcaactcaatctatttaacaaaaataagcacttcatgtaataactgcagaacatgtatttttgttttttcagagtctcgctctgtcaccaggctggagtgcagtggtgcgatcttggctcactgcaacctccacctcccaggttcaagcaattctcctgtctcagcctcccaagtagctgggattacaggggtatgccaccatgcccagctaatttttatatttttagtagagatggggtttcaccatgttggccaggagggtctcaatatcttgacctagagatctgcccatattggcctcccaaagtgctgggattacaggcatgagccaccattccctgcccacatattgtttttaaggacaagaaacattttacgaatagataatatgctagattagaaaaaaaatcaatacatttaatagaactggcatcatataatgatgtttttgaccacaatgaaagtaaatcagaattgaacaacagaaagaaatctggaaaatctgcaaatatttagaaattaaacaatatacttctaaataacccatggatcaataaaggaaaaacaagaaaaataagaaaaaaatttaactgcactaaaacaaaattatattaaaatttatggggtgcaactaagacagtagagggaaatttatagctttaaacacctatatcagaaagaaaggaagatctcaaatcaatattctaagcttccatgtgaatatagtagaaaaataagagcaaactaaaatcaaagtaagacataataaagattagagcaaaaatccatgaaatagaaaaccaaaaaaatcaacaaattgacatatttagattgaccgaccagtaataaaagacagaagacacaaattatgaaaattagaaatgaaagaagaaacattatcaccaatctacaaaaattaaaggggtcataagcacatgttatgggcaactttatggcccaaatgaggcaacttagatgagatgggggaaattactggaaatgcgcagatttccaaaaatgactaaagaggaaataaaaaaactacaaaaataacaattaagaaaattaaactaacaattagagatccctttacacaagaaaaggcccaggcccaaatggtgtcactggtgaatttgttaaataaagaaaaaatactaacaatcttttacaaactgttctagaaaatgcagaaggggagacgactctccattcattcagttgttctaatattatattgatagcaagcacaaaaatatcacaaaaagtatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttctttttctttttctttctttctttttttttttttgagacagggtctcactctgccacttgggctggagagcagtggcatgatcacagctcactgcagcctcggcctcccaggctcgagtggttctcctgcctcagcctctggaattgctgggacagcaggcacatgccaccacatccagctagtttttgtattacttgtagagatgagttttcactgtgttaggaacacacttaacagcaacaacaacaacagtgaaatgcaagacttgtgtactgaaaactacaaaacattactgaaagaaatcaaaggagacctaagtaaatagggagaaattccatgtttctggatttaaagactcagtaatgtcaagatgtcaagataacaattcatcccaaattatccatggattcaatgcaatctctgccaaatctcaaatcccaggattttttttgtagagaatgtcaagctcctcttaaaatatgtatgaaaataaaatgcaaaggatctaatagtaaaaaacaattttgcaaaaaaataaagaaagaaaaaggttggaaaacttatactagctgatttcaaaatttactaccaaggtaaggtaatctagataaattgaacagagttgagggttcatgaattaatgcttacatccatgggcaactaattcctccaaaggtactaagaaatttcaatggggaaaggatactcttttcaagaaatggttctggttctactgtatactcacattcaaagaaatgaatatacaccattaccttacactatacacaaaacgcacaatgaaccacagacctaaagaccctagctaaaattttaaaactcctagaagaaaacaggaaaaaatctttattagcttgaatttggcaaataattcttagacacaacataaaaggcacaattcattaaggaaatatcaaaaagttggacttcatcaacttttaaaactttgagcttcaaaacacatctttaatgaaaaaataaatcttatacaggttgaaaatatttgcaagttatatatctgataaagaacttttatctagaatatatatataaagaatcctacaactcagtaatgacaagaatccagtaaaaaggagtaaaattttgaacagtcatgccactaaagaggacatgtagaaaacaaaaacttaaaaagatgtataccgtcattagtaattagggaaatgtaaatgaaaccacaatgagatacagctatataccctctagaatagctctaattaaaaagacagaaaataccaagtgttggatgaactatgaaaagaggcgattcctcatgcgtggctgctcagcatttagaatgcaacagctactttggaaaattgtttgtttgtttcttaaatagctaaacatatacccgccatataacagagtacttcagcacctaggcacccacctcggaggaatgaaaacacgtccacgcaaaggcatgtcagggaatgctcacgtggcttcattcataacaagcaagagctgatgacaccacaaacgtccatcaacagagagggggagaaacaacaggaactctatccaaaccttagaatagcattccgtaggccaaaggtgcaaactacggacacgcgccccaacacagatgagcctcaaaaacattgtgctgagcaggagttggaaggaagacgtgacgtatggcatgattctatttatacaaaatctccaaaagaggaaaatatttagagatggggcatccattagtggttgcccagggctgggggtgggattggattgttgcaaaaacatcattaaataaatgaaaaaataagcttccttctgcacacacatccatgaagcccacattctcaagaggacgtgaggcgcatcccaggtggtcatgcagctcaacactgtagatgtgtgaaaatgattgaattgtgcacgggcaaagtctattgaatggaagcatgtcagtaatgctgcaacaaatacatgaactgcaaactacagtagtttctactgtatagctagaatggcacttacttgattacacttgagtaagaatataaactgttgttttgggaaaatttttgttagaaaactagatttcacacagcccatagaatttttgtcactacccatagaattccattgtcagcgcctacacccgcctctggccgccttcccaggcatggtccaccgtgagccgtaactgctttgaactccttgtctgtcccgttgtaccgtcatcaccttctctgtcatcagtgcgattgcacacgcatggattccctgccttattgaagacattggagacctccctcccgcctacaggaccaggggccttcaccctcaggaatgcccagtacgagggctgagtttgcagtcaaatagttaatgttcatagagcttattagagacccacagcatttaatcctcaaacagccccttcagtaggcactattattatcatcatttgttcatggggccactgaggcacagcaagatgaaatgatttggccaaggtagctcagctggtgaaagagattcagggtaagaatcaaggctggtgcagtgactcacacgtatgatctagcgatttgggaggctgaggcggatcgatcacttaagcccaagagtttgagaccagcctgggcaacatggcaaaaccccatctctactaaaaacatgaaaaattagcctggcatggtggcacgcacctgtggtcccagctatttgggaggctgaggtgggggtatcacctgagcccaggaggctgagaccccagtgggctttgaaggcatcactccactcctgcctgggtgacagagtgaaatcctgtctcggaaaaaacaaaacaaaacaaaacaaaaacaaacaaaaaccaaagaaaaaaagaaagagaataagaatccagactgcctccattttaaaccactaaagacgatttggggttctcctcgtattatctgatgcaactccaggctccagcgagcatgccgtcctgcctggtctcctacccgtggctccgagcacagccccacagctgggagccgagcacgccctcccaccttgcctccccaccggctggggaccatggtgtgcacttccagatgctactgtcatttcctgcgacaacagaacacacacatctgtgaagtctataatcacaaactgagcgaaactcacgaggttatgacaatttcccacctctgaaaataacattgatggatatgtttttaagagactgacacatgtaactctttattaaaaaaattattaaataactccttgaaataaaaaggcagtcatgtaattaatagttatgtactacttgacagcataattactcattaccaatatgcaggaacaaaatgacttctaattttatcttcagagtctttaaaggtaaaaaagtacttgaaaggaagtaaactagaaagagaagatggcttttgtgagtgcttgagattcttcttgacttggaattaaaaaaaactaaaggttaaattacagatgatgttatgctgcatttactgaagcaggtgaatcatgaaaaccacttgtatatctcaataaaaataaattaaacatatatatatatgtagaaggcagtctaacacaggtttctcctactgttgtgttagctaaagatttttcttttaactgtctggggaaatgtgaatttatctgcatctgttcagaattggccaaacacctccacaagttgttcagaattattgacgagtcctgagagctaaaccccaagagacatttttccagcctgttttctgtggtgcagaaaggagcgtggtgtgcgggagcagaggctgctctcagctcatgtgctgagtccaggcctgtgcggagcctgaggctgaactcgccatctttacactcctttaagggaaaatacccctttttccagggaaaactgggagacagacagtcgacgtgggttgcaatcccaatgccggttgcagtgctgagggctggcccatcaggggcagcttacagggactgaggtttgcaccttggcgctggtggggtgtttagtgccctggatggaaacaatgctgggatcccagtgaacagacggcagggaatgttcctcggagggaaaaacaggcctctggaggtgcagggcttggttttggaatctaagctccacaggtggaggccacagaacagctttctcgggagtccccactggctttgtgaagagcagggaaggcatggtgagtgtccaagtgtcatcacattaatacagaattgacacatgtccactgaccatcagacagcagacatgccctggaatgacagcctccacagatccagcccgtgggacccagccccaggttgctaagtgtccccagcgaggcctgcccgacccctctcacccttctcctgctgagctgtggccttcccatgtcctcatcacccagcacagccatgcctcctgctcctgccctctgtgtgcacctgcctggctgccccacttctcacgcctctgcctgaccctgcgctctctcctgcatggacacaggcctccagtggacctcggatgctaaccccacgtctgcccacgctcgctccagcatggacacaggcctccactggacctcagctcctgcatggacacaggcctccactggacctcggacactaaccccacatctgcccacgctctctcttgcatagacacaggcctccactggacctcagacactaaccccacgtctgcccatgctctctcctgcatggacacaggcctccactggacctcggacgctaaccccacatctgcccacgctcgctcctgcatggacacaggcctccactggacctcagacgctaaccccacatctgcccatgctctctcctgcatggacacaggcctccactggacctcggacgctaaccccacgtctgcccatgctctctcctgcatggacacaggcctccactggacctcggatgctaaccccatgtctgcccacgctctctcctgcatggacacaggcctccactggatctcggacgctaaccccacgtctgcccacgcctcaggcacctcttgaactccggggcttcctctgctcagcagccgaggtcttttccgcaggtgctgcctggccctcctcccgtggctgtgaactcccctgcacgtgtcatgggagttcccaggccatccgtgaggcagactggctcctctcaaactcccacgacggcctgtcctcagtgatatttccgggctgcccccacactcgacatggaagaacgtgaatgacttgccagggccatgggcagagggaaggtggctacacacgtcccggcttgtcgctcaccacctgttaacagccacgcacaaagcaacccgcacggtctgaagtggcccgattgttacatgttgtattatatatagtttactatatatttaaaaaatgcaaaaaccacagttacttttgcaccaacctaatataaacatgtatcggtttctgctgtggttatgcatctcctgccttccctcatcagcacccaccctgtgccttcctcctaagaatccctctctgtggggtcctgctgccctctccttgcctgacccactcaggtcccaccttttccccgggccccggcgcacccgctagcaccgctttctgcccaccctggcctggacgcctctccctccccacaggctcacacatcagtcacccactcgaactggagccgggccctcgggtgaatcgttagctcctcgagcaccgagactgagacttatacattttaataacttgggacgtgcacaagaaggggcttgacgagcctcggattgatttattgatttagaggttgcttttctagccaaggcaactgaagattagactcctgatcacggacacttgactccattcggagagcagggcccatctgtgcatgcaagatcgcctcccacaaaggagagaaattctcctccattctttctcttgattgcctttctatcttaattttttttctctctctctcatcaccttcttacatctgttgcaggttaaagggcacagttcaatgtctatcaggtgaactttgactttaaacttaaatctcagtccttgcacagaccccataatcaaagtagaaaaccataagctgtgaaaacttcatgtagaagtttgcccacagctacacagccatggccatgacatctaacgttcctagatttctaatggaattaacttctactggtttgtcataagaaatggagatgcagaagcactggctgttttacagattacactagaaagagacataggggttttctctggcttttctctctctacagcagctgtctgtactgctctctcccagagtgatttctttccttttaattgatcacccattctctaatatacaaaatcaaataaaaccgagacacagcctcgtagagatcacctgtctctttggtcatgtttgtcctcaaggtgccagcacttgaagaggtggagctggagggcatcagccatggagaaggtgtgactccccccagcatcacccctcctccactcacactgcagacaggtctgccccgtctgaaatcagcttgaccctccatcctggaaaactgccggctgatgtgggctttcgcccatccctctgtgactggcctgagctctgcccttgtccacgcgtgggtagatcagaggcaggaaagacacatctaccctggagcaccctggcagcaggtgcctgaggggctgagagcaaacgggcggcgatgcattgcctgcagcctcctctggcctccctggcatgcttagggggaaaagtcgcttctgtgcacattgtcaaggagcgagggggcctcatcagtactttatgataacagcacacaaccctgctagccgtgggtagtgcctgtgattacttgctttctaccgatgttaggctgcgttacgatcggcattcactgttcagcgcttgctaggctgttaattattgttgtgtggctctaagtgatgctttcaaaacattttagaattttgttactgtgaaggcaccgggaggaacttaataagccaagattctacatgagaatgacacagatattaaaacaatgaaaatagtttaatcacggccttttcttccacagctatggctgataaaaatgtgtttctgacacttggccgaatgtcactagagactcagctgtctagggtccctgtttcattctgtacaagaaacctccatgggtgtggaagtaagtcagtttcaaggaaaagaatttgaatcctgagctattttagcatggatctctacgttttaaatgaaatccttcttttcagcgaactgggagaaatacaaagactttcctggtgtgtctttctcttctggaaactatggagaaaaatgaaaccagtcccgccatttgctcacggcggcctccggccaggccctggtcccacttccaggccagcgaatcacggctgcccagtgtcgtgaccactggaggggcctccctggtgtccgttgggttctgactcaagatcggtctgtgcttcttccctgtagctcctgcgagggctggacagctggccgggtttcatttgcctcatgaggggcttggagacattgatgagaagacagagagaggggagtgctgagaccctcagtgaggacaggcgtgaaactggctcaagctgttcgccagggtgtcccctagcaacacagagtccacgagtaacatgttccttggaagtttaggttattattttttaattttgagaggtttgtggttacttgatttactctttctcctttgtttagacaagaaaactaaggcccagggaattggactccctggtgagtgatgagccagggcacagtttctacctgccagtttgcagttggtaaaaatcagtttctgagacaagtgtgggtttactcctagccatgctgtcccctgggattggtggagacctcctcatcgtgatggtcaggacttcacagtgacattctaattcacttcccccattacctcctgctcccatggagctaaagcctcagcgctcaagcaccccgccagcgcccaaccccgccctgcgcccaacctccccactgcgcccaacaccacccagtgcccaagtccccccagtactcaaacccccccagcacccaacccccccagcactcaagcccctcaggtcgtcacaaaggccgggtgcttccgctctgggtctgtccccattgcctgggcacctgcagatcctgcaagtccagctcacccccggcccttcacaaactcccccaaactgccatccctgacaagacacgttgtctctcttcactaaacccctacagcttgtaacctgagacaaaatttgcctgtgacccttgtgtggcctctaggggttacacaacagccttgcacatgccattccgagaatggctgctaagtaaaacagcattaacacaaagtgacctggacacaaagacagggagcgagacacagagaatgcgggggaagggagcgtgaggagggaggaacctgacaaaaccaacccccgtcattccttcatctacttgcccaacaccatctgccgagcccttgctcaccccagcagtcacccagccacacccacttggcacttcatggccacctagacaggagcctctagccttgcttgctagagctgcagttgatttatgagataacccagcaatggcaccaggtcctttggctttgagtgtttcatcttagaaataggagataattatttctttatacatttagcaaacattcatgaagggtccactgtggccagagaccattctgggtccatgaatgggacagactagagcttggccctcccgacacttatgttctcgtgaggatgggagaagatgacactcgtgcaggtaacaggataatttcagatggtgatcaacgcagtacagaagcaaggcagggcataaaggggtggggagggcttcctacccagcggtgacacccttccctgggtaccagcctgttctcagggagggggcggaggaaagtggcttaccctgtgccctggttacagtaaactctctatcagaagccacgagtcatttacatttcagtctctaccctcgctcagctcttgggtctcccatggtgacagtgactctgggcagggcagagggggtgtgtgctggatccagaggctgaagtttcaggcagagaaatggcgactctatgaatgcctcagtgcatttttccacatggtggtttattaaaggtctatgtgcattttagatttctggattacagaaatatgaaggaacactttgggaggccgaggtgggcagatcatgaggtcaagagattgagaccagcctggtcaacatggtggaaccccgtctctactaaaagtaccaaaattagccaggtgtggtggtgggcgtctgtagtcccagatactcaggaggctgaggcaggggaatcacttgaacccaggagatggaggttgcagtgagccgagatcatgccattgcactccagcctgggtgacagagcgagactccttctcaaaaacaaacaaacaaacaaacaaacaaacaaacaaacaaataaatgaaagaaagaaaaaaagaaaagaattatgagggaaatacttatttctcagtagagccaccacccgcggtgaagtgtgggaagagtggcctgtgaaccagtgccccaacagtgagttcctagcttccctggaacaagaaaaaagggtgtgcaacacgttcgatgtgccaggtgcctccacgtggggtcccgacgccatccatgaacgtccacctccaccctttctaccctgtcttccttctttactttcttccttcctccattccattcaatgaggcctgtagagcacccaccactacctggcaccgagacaggctggacgcggcagggaacagctcacccagctttagccagcggggacctgacaaaggctgcctcgggttccactgtgaggtcccgttcctggtgactgggcaggctcgggctcagggccagctggtgtcatgccagggcgtatcaccttcccatgcccgatgtcagagcgcaaaaaatatgcttaacaggaaacccaaatgaacagcagtgcttccgtcactctttgatgcctgggaaggacttctacatccaggaagtgctaggtcaccctttgaacgtcagttacagttgcagtgaggtggctggcagatgaatgggtctggtgatttgatggtgtctgtctactggagatcttgggtaaaggacgacgctgtgtgggctgcagtgcaggaccaagcttccattctcctcctgctgccagatctaggaaaatgtggctcggttcacagttaggaaggaaaatatgtattttttaaatggtaatttgtaaaaacaatgtgagaattttatcagattattgtagttattctggaaatgtatagtgtcatagaaattctaaacaacaacttttctctctgttaaaattctcaccttcttcttctgaaactgctacccagaggtgtggataagcgtgatcttagagaggagcttgccatgcactgccttaggagaatgtgtccgctcttcacagggaaaaacaacatggcagtgggaggactgagacattttaataaaatgctgttgattttcaaaggtatacatcttagaaacatccttgtttttagctaatatttaagctgttcctagggccataaaataatctaaactggataaattcatcattatactaaatatctcatgaagaaaaacaacatagatcttaaacatccaacttcataaacacacttgtgcaggcatgtgcacattacacacacatgccacatgcatgcatacactacacacacatatgcacacactacacacatgcgcacacacacaggcacacaatactcacgtgcacacacatgcacacacagtacacgtatactcacacaggcttgcaaacacaagcatgcacaatatgcatctgcatacacattatacatgggcacacaagtgcttgcacacacatgcacactacacatgtgcacacacatgcacacacactggatactcacagcactagccttgtgaccatgcacctgcccatgtggctgggcctatggcgaggctgtgggctgagttgtggccctcaccccagagacagtgtccatgacggttctccaagtctggtgagactagaggggaaataactgccctaaagccctgagaagtcaaggactgatggcagatcctcacaccagtgtcctcctcccactcactgtgggactgcatgaagtggcattgaatagacagagacctcacagcccagcagtcacgaagaaccactcccatctgcacactcgttccaagttagcgtgacatgctgtaaaggctcatcttatgtggcaacttgactgggcttggggctgcccagggggctggtcaactgttatttctgggtgtatctgggaggatgtttctggaagagaccagcatttgaaatggtaaactgagtcaagaagctctgcccttgtccatgtgggtgggtgcatccagtccacagagggccaaatggaatggaagctgggggcagggtggatcgcctctgctggagtgggcctccctctccccagggcctcagactcccgtgctcctgcttcctctcctgcttttcctgcttctcctcctgcttctcctgcttcttctgcctctggactcaggctagggctacactgttggctcccctggttctgagccctttgggcttggactgaactatgtcactgatttcctggttcaccagtgcccaagcagggattgagggacgtcttagcctccatgatcacatgagccagttcccataataaacctccccatacacaggttgagtgtccctaatcaaaaaatccaaaatccgcaatgctccatagttcaaaactttttcagtgccaacaggaatttcaaaggaaatgctcaccagaatatttcagatcttggattttcagagtgtggacgctgaactgatgagtgtattgaaaatattccaaaatctgaaaaaacccaaatcccaagtgaacatctcaggtaagggatactcaatgagtgagtctgtctgtctgtctgtctatctatcatctatctatctatctatctatctatctatctatctatctatctatctatctatctatctatccctctatgtaatctatctatccatccatctatcatactggttctgtttctctggagaaccctggctagtgcacacactatcttatattgaataatgctgagtagtttccaaaatattttcacatgaaattttgtcagttgactctccgagctggtgttcaggggacaggctgtcctgggctctccctgagggtttgagcaggcccagggactcagtccaggcccccgactctgacccctcctctagtgtggagcagcctgaagcccgagggagtgtcctgtgccagcaccatgtgaacccgcatgtccaggcgacccgccatcctacatggcacctcacgagccccatggagctccttgccagcacagagggacacagagctcctcgtctccaccctctcttcacacctcccttgatctgcacatttctgctgccggctgtgctgtggctcctggggcccctctcccaccctcgcctgctcccacctgccctctgcgcctgtccccacgggtgtgtttcctcctccctcaacaccgggaggaccctggggccacacccgctccagagtcagattcaagtaagcaggtccttcagccgaaagtggactcaatggcccaagacctaacccatctgtgagaacactggacatgggcatttgtattttgcaatcaggccacagacacagcacacagaggtgatgtttcctaaagaaaaccacagcggttgttttcccaggactctccaggtgtccagcctaggcaagggcaaggtgacctcagaactggctgttctcaacgctgctccttggaaacgtggacccccagggaccatctgagctgagaggaggggcggccggctggccctgggctctggaagctccttcctccaggcactccttcctacctggaaggatgtgtttcttctggagtttgcaggttagggtcactccaggtgtacaagtgtttggaaatgaacctgccaagtattgtcatatacttggcaagattcctgcactgaattcatgtttattataatatgtcgcatgacctcaaaactttagaagcacacaatatccatataatctttccagttgatacactctgaagagttatatgtatgtgtaataaaaatattttaattgaattcaattcattaccagaacaaccaacactggttaactgaaagcaatataaaagtgcaaatattcattaatagtccatttttaacaagctctaataagcttttcataaaaccagtagttactttccagaacaaacattttttaatttttctgatctattctcattctagtcgattcttggtcacagctggatgtggttaagcaaaccaatctgtatttgtaaaagctggttttcatttcaaccctggaaagctggcataaacttaaatatttctctggatccaatacatattaactaaagtaagtgtatttgtgaaattgaaaagattataatgtacactgaaagagtctatggcatttttacaattccaaatgtatcttacgtagaggagtgcctttaaaaaatatcaaccatgggtgccacagtttaaaaacacacaattttaataggttaccttgagaatgatcaccttccttcattatttagatcatttctagagtgaaatgttcccatgttaatttattcaatagagtttttggagtcaagctctgtgcaaagtgctgggcctggagtggtgaactcggcaggctgagcagtcctggcaggtgcacgtcctatgtaacttagaatacgtctgcaagatcttcatctaagacggtatgagccttgagaccacagcgctgtgcttgctgaaagcattagtgtcaaattttcccttggagaagaccaaacccaacaggtccccttgagatgtggctctgcctagtgttgcgttgaaatctccggatgatgaaacctccctgctttgtgggtgattgccccgcccactctgagcttccctccgtcgggacagcctcacgttggattaggttcaaagctctcccactgtcttcatctcccttccctccctgtgaacggaactggctggccacatttctcttagagaattttaaatcattactcagttactcttcatttatctcagacacatgttgagcgattctggtcccttttatcttcactcatttcgttccttgcaataggctttggctatctctggacacctcctcactctatccctggacagttgctggtgtggctgtcaaagcccctccactgacccagaggcctcttatctagcaacagggctctctggaacactgtgcagaaaacctgatgttaaaacaaactaacaaagaaacgaagagacataaaccacggctggataggtaaacccagccgtgacgaagtccacatgggacatcagtgttgggctcccaggtgtggctctgaggcacgtttttggaggtcgggtgctcccttgttaaagctgactttataccgggaactggtttccagtacacagaagatgagaaatagctcaacggagcgagttgaggggggtgcaagacataaagcaaggctgggagaaaaaccaaaactggtctaggcagactgactttcttaaaaagtactaaagagccaggtgcagtggctcacgcctgtaatcccaatactttgggaggctgaagcaggcggatcacttgagcccaggagtttgagaccagcctgggctacaaagaaaagtcccatctctataaaaaatataaaaattaaccagacatggtagtgtgagcctgtagtcccagctactcaggaggctgaggcaggaggattgtttgagcctcagaggttgaggctgcagtgagctgtgattgcaccattgcactctagcctgggggacagtgagaaaccctgtaaaaaaccaaaagaaatggtgcctatgtaatgtggggggaggctccgcacagaccagcagttgcaagagataccacagttcatgccaccagtaatgccaacaagaatgttggtaagaacactttgttgatataaatcttgtacttattcaatttttatatatatgtagatagatatctatctatctacatatatcaatatatagatatttgatatataccgatatgatgtataatatacatcatatcaatatacaatatatgaaatatatcaatattatatgacatatataatattgttatatatgtcatatattatataacatatatcacaaattataaaacatataatattgatatgtaatatatataatattgatatatatatctatttctatgtagaatatatataatatctctctctatatataaaatttccaaccaacacttttgggtcacctttgtttaacttttggcacttacaataacagtctttcttttttttctgaaaagtgccctcatgatttaatactcattcatgattgaaaggctgttgcttaaatcttacagaattaaaggtgtccgcaacacaacagatgtagacacactgaaggaatacttctgcctgagccattttattttaaattactgagatttcttttaccacaagtggctctgctctagctaacatcagatacttggcagtttatatttctgccgtgatgatgtaaatcctgtttccacagaatcctttaaattccacaccttgccagctcggagtgggaaggaaggagcagcgttgcctgtcaccagcttcattctttaattatggcattcttccttgattagagctataatcacatagcaatccccaaatcttgattactggtggaaaatgcaagtctaatgaaacccattatactcttgaaaagcaaatacactttcttttagaagatggcaagggtttttgtcttaaatgattaccctcaatgcagaatttcagggtgttgaggttttcaaataattttccctaaaataacgtatttgttccttgatcctaagaagttacaatccatggcaacatgtagggaaagtattgtaaggtgaattcttgtcctctaacagtatgattcttctgattagatttctatcccatccctataaaatatcaataacttaaatgtgttgccactcttaaactgcagtttcatacgatgatgtattaatcgctcgcaataatttgcctcgtcaccaagttaatgtgtctgcgtggctcctgtttatgagcaaagcaaacctcctactgctccgggctgcctcctaacgccacttctgcgatttccctacagacactagtatcaggggtgctgaatggaaaagtagaaattaaaatggaaaagttctttgtctggcattgaaagaaaccgccaatatttttatgtgagaatgaacagttggagctgcttccaccagaagacagaaaagagaggtttgggggaaaatgggtcttgggtggctgggaggagatgctccaggctgttttccacatggaggaaacttggcaataatgaaagttccttttctagctctcattagttgcctctgtatttcctgaattaccctgtcacattcaatacccaatataaatgaagcaacttttaatcattccaggagagatggaggacagatgcagatattacacttcaatatatggaagtagtctcaaaatgtcattaactcgtgaattaacaatgagctttgattgttgaaaaaagatgacatatttccccatttagagtttgggacaagaagttaatttaaatgctaaaagtacatatatttgactaacttgatgtcacatatatctcttagcattaatacagaaatggcatttataaaagccataatgcatgtagctcaaggcaagctttcttaaacagtttgactcaattgagaccttataaagctttggtctattgttccactttcatgaggtttttttttttggtcaggccaattatagcgaaggatacatatttcaggtgaacctttattgagtgctgactgctagccagacatcgttctctgagcctcgtgtgcattacacagtttcttacaacaagccgatgaggcagataattttatcaccatcattttccaggtgagtagaatgagatttaggattaagtgttttttttgtaaggttgctcatctaataaatggtggttcccactgcagccagtcctctccatgtctgcgagatgacacagctggacccgacgagctgggagaaaaggcaaaatcaccactcatcactcatcttctatttgcttaaaatggtgtgtcgggggctcacatacttctcatccgtgctccctccatgcaggtgacacaagtcacacaggtctttttcttaaaggaggtggagaggctgccttgcctgcactcacacggacttccagtggggaagaagccgtcttggcgagtgtcttggtttgagatcatcagggccataccctcatcatggtacaagtgtttgtgcagtcagggtggaaacagcagggagcagacatgctgtggccatctcctaaagctggagcacttcaggagaatgggagggccatggtcccatgggcatgagtgctctcctgctgcctgccaagcctgtcctggaactgagccaggaggctgactgcatccaggaagctgaccgcatccaggaggctgaccgcatccaggaggttgaccgcatccaggaggctgactgcatggttcttcctagagcagggcttagagcctgctctgtggtcagtcatgtggccctggaagagaagtccccagagccttcaggaatgtcccagggtcttggaatcagagaagaccaagaaacgccaccagctttggaactgggtgagctttatctgggtgtttctccctggctggcccacagtaccagaccattcacgagcagcctgatgatcacagctgatccttaccctaagaaagctttgggctccaacatgacttcccgttcttataaaacacaaagagggccgggcgcagtggctcacgcctgtcatcccagcactttgggaggccaaggcgagaagatcatgaggtcaggagttcgagaccatcctgaccaacatggtgaaacctgtctctactaaaatacaaaaaattagctgggtgtggtggcgggcgcctgtagtcccagctactcaggaggctgaggcaggggaatcacttgaacccaggaggcggaggttgcagcgagcggagatcatgccactgcactccagcctggatgacagagtgagactcctctgtctcaaacaaaacaaaacaaagcaaaacaaaacaaacaaacaaacaaacaaacaaaaacatgaagagggctcaggccaagccgcaaagccatgacctgcccttctaacaggcacagtggttctttgtggaaccactcagaaaaaaacttcaggccttaatggggtgttggcgggaagatctgaagtgtgttttaatcccacagcccgtaaacactggatgccatcgatgagggagcatggcggctatacttacatacctctagtgatggggaactcactatctcctgagggtgtttttctgtttctcccaaggaaatttactccatccttagccagtttgttagagattgtaccgttgtaaaattcagtttagaagtctcgttttccttggacaattatagtcttactccttaagtggaaggggttgagttcaagctctccttctgaacgcctgcttctttaatagggacacactagggagggaggggtagatatcatggttcctgtccagtatgagaatcactagtgttgttgaaagaaagtgacaaataaacagaactaattctaccttttttaaagcaggttaaaagcaagtgtcagagcttgcagtttgctgccattagaggggctccaggggcccatttacattttgacataaaatatgaggaaaacacaattgagacagaaatcataaaaatggcggatgctctaaactaaacccacaagttaagctgaacatcttaagcattttccagataacaaactacgtaggtgaatcctgttgttgcctgggagacacacacacacacaaaaacacacacacagacacaaaaacatgcacacacataaatgtctatacactataaatatttttatggacaatcttctgaaacactattaaactatgaagtattttgtttgttttgtatatcatttgaaaaatatattagtgagaagatagacgtctcaaaaggagaccaatggtaaatggtgaattttagtaacagaaagtaaaggatataagaagaaagcttagggtgagatggtgaggtgaatgtaacgcatcccggctggacaaagctgccctgtggtctcacttggctacaattgcaagatccgaaattcactcttagctaacgtcagtgaacccatgaaaagcttagattctagcgaaaaagtattcattgttttgtcttcattcttagttatctttgctaaaaggaaaggttagctaaatctaaaaaacattttcataaactacaaatatatattaaaaatatctgtaatggatatgaacaccatgtgttaccaagggtggatctcattatattatttagcacccgatataaaataattcaataaaaagtctctgggcatttaaatctgaatctagcattgacaaagcatggattagctccaaaagggtctaaaagctgataagctccaatcaaagcaacagcacgaagtggtgtgtttccactttgacctgccacgtgctgacctatcataactgaagtcagctgctttattataatttcataaaaacaaatgatgtgaacaacccaatatcaggtctaaaaaccacataggctgttgtttaaaccacagcattttttgaaggaaataaaaggtctgtatttatttctagaacacagaagctactggggttttagccagaaactcatctgtagttaaaagagcagcagaaagctgattctttaaggtcttagggagcacctgtttcactgcgtctttgctgcgagagtgtggctgggagactctggcccctcctccatctgcacgtcttaccagcatctgctagcgttctgctttccaagttagtccgttaagattatttccttataaatcttttttaaaaaatgtgttcctggctgggcgtggcggctcacacctgtcatcccagcactttaggaggccaaggtgggtggatcacctgaggtcaggagtttgagaccagcctggccaacacgatgaaaccctgtctctactaaaaatacaaaaattagtcaggtgtggtggcgggcgcctgtaatcccagctacctgggaggctgaggcaggagaatcacttgaaaccaggagctggaggttgaagtgagccgagatggtgccactgcactccagcctgggctacagagcgagactccatttaaaaaaaaaagtgttcctgttataactaatttacattttacctcagtgcaaatatttgacatttattatgatttctttttattttttagaccaaaaagtctcattctgtgtatttgtgccattaatgacttcttttgaaaatttgacccaaaagctcagaaatcaaaaccagaacttgtgtgaggtcataaacttcaaaagcacacggattttggctaccttatatcaaaaatactcaaagcattgcttgccacattgtcggtgctcaatgattacttgttgaatgaacaatccacccaaatcctttaacttcaaatcttcctgaaacccgtgaacttggccctgcagaaagggatgcaggcacttcagttcccctatcttcctgggatgagttaagtattagtaaacatcgtcaacagcagaggcagccacatgcacgttttggaaaatttatgtcagtatttattacaattaagtatttcccagttgttatggctcaaataacatattatagccaatcagatcatttgatcagaaaaaaccaccacattggtataatttatataaaataaaagcaagataaagaaggagctactagagttgacctgctaccaataagtatcactcaccacagggctttcaaaatagcgaattagctcaaggccatctcaccatagacactcacacactcacacactcacactcacacatttacccacaaactcacatccacactcacatgcacacacactcacactccctcactcacacacccactcacactcagtattcagacacacatccacactcacactcacacacactcgccccttggctgtgaactgcaggcaggtatgttctgggtgaagcgggagaggcagacggcctgcacactgacccctctaagtctaggaaacctccaccccgcggccccctcctaattagcaatgacatcagcatgaacggattcccactgtgtgcaagcgcagggccaagaggcctgggtgtttattcaggtaatgcaactaataaacaggaggtaggcacacatctccactttacacctggggaaactgaggcacagacacccaaaggccatgggactggtgagcagcaaaactggaatttaaaactcatctctaatggactctactctgccttccctatttacggtgctacattaaataagacatgccatcaaacacagaaaaaacagatttctgcctaaagggtgttaatgatgttttacatgaaagggctggaatttcccttttgcagcgttttcagtacaaagtctctgcacctataaacttagccacctgcagatggaaggtgaatgactcatttttccccgcactcactttcataccagatgaggcaacttccagttacacttgacgtgttacattttcccagactggagggctagaggccactcttaggtcagggtcacctggagggtggctgatggtggggggctagggttacttcatgatttcatcccccaaaaaacaaaagcaacagtgacgtcagcttcaccagtatggggaagtgagtgaataaggtggaagagggagctgccatgacctgggagaggccaggaagaactcaagtcctgctgcgaagcgcgtcagaaccacggacagctcctggttccctatcccttagggtgcctgggcttcatgaccacaaaggtcccttccagcctccgcatgcagctccaaaatcaagtttttttcttttttttctgtacagaggcattggggctaatttgctgtctctgcagaaacccaatcccagatctctaattccaatcctgagaatgattggagcctgcggagtgacagtgacaaggtgcctggtggattaggctggtccctagaaaagtggatgctacattaggtcagtaatgtgaaagtagggcggtgtgatctcctctccccaggcttcctcatggagagcttcattaccgaatcgcacgcagcccacacggctgtctcccggccccactcggcccaaggtaaataaaactccaggttatctcaaaggcaggagtggaagcagctaatgcggggagatggggcattcattatgccatttacacgagctgaggataaatgatcaaattccctctgtcaaccacaaagagctcaaggataatttttaaatgcaggaagtattcctccagggcttttgtattttcttcctccaggctgcagccgcatttgcgagtgtgccaagctacgccactactgatttactgcgctgggaacagcactccatcaatgtccccgagctgccattgccaccaagctccccctgtccccgggcgtctttcttacagaagaaaattattcacttgcttgtatgttacatgcaaaacaaactatttttagctgcctacatctgtcacctccctttgctatccaagctcggtcgggggagcagggagaaggagaaggacaaaggagaggggaattctcaaatgttctttaaaaaagcaaaacgtgcacatgctggtggtgacacaggttatcatcggtggtgacagagaaatgtgcaggctgttcccattgctgtcacatgagctttgtcttgtcctgccaggcgcctacgcggagtggacagtcaatgatgctggcggagcacaagcaatttttcttgtctgtacaagaaaggctccatggagtctcctgctgctgatgcctctcacacttgtaaggagggtgggaagcctttcaaatgacttttctgaccgaatgagagattgcattggcactgaattcctcttcttgaggttctggattttcactttgttttgttaatgtttaaatttatgactcgagatttcactctcaaatagtgatggctaggggctcttccagtgtgactttgtcacactaattttcgcaagcagttttaagagtgcgtgtcacgcctatacaaacacacaaaaaagaggtcaaggtagactgtagaatgccagcgtttggctaaggagggtgtttatgtggtcagtgtatataaaaggaatgttattttgcaaaaatgccaacgcatggaaaactggtgtcagagaggagaatcagtgggtcctgggattctggcaggggatctggccccctttgcaggcgatgtgggatgacacagggaccaaggttctgagcacttaagacgcttcagtcagattagccaatagcacgattcgctccatgctcattgttgcattgcttacgcatgcatggctatggtacagcccactggatgggctctaaagccttaggtgtggcagaatccaaaaagactgattctatatgtccctactgggaggttagatggaccagggtagagatgcatgccagcccatcgacctggagcctgcacagctatggaactcccactgcccctgcagtgccattgcctagcagaagtaagggggatgcaaccactttgttacttccacataaagcctctaacttgacttcttgaagtttgcaagaagcagcatccacttaaagtccaactctgattgtgacagcttcctcacctggtctaaggatgcctcagtcacacaaaaccaaaactcacaccgtcagtgtatttaaacgtacatctaagcactcctcagaccggttggagactctgtcacatctaacccagctctgagtccatccctggcacttgactgcctcccacctccctgccatctacacctcatctccatcacgaaactctgcaatgttgagctgccccctctgcctctcctcctggagttcactttaacgcctatactccaatgcttgggatctcttcttttgctcaagacatccctttttcatccgtcattcttcttcatttatcaggtttattcattcataaactcaatcagtcattccagcacagggaaggtgcgctgtgaggtgctgtctgtccctgcctggtggagctcaccatcctgcagacatgaaacagataatgacaaatcacaaccagagtggtgttaggagacgtgtcccagggacacatgaggatggcacccagtctgatgcagagaggtccaggaaaggctcccagagggaagatccccatgtggactctacaaggtgcacacaggtgagttaggggcagcttaaaacccctgagggatttccattaggacacacccaggtctatccacatggcccaagtgctctgaaaacgatgtgtcctggggtccagcctagctcgtgacagttccctttactgctgccatcttagccatgctgggctttgtcaagcagcaaaatggcatgaaagctcaagcccccatgcacacccagaccatgtgcatcttgagggactattttctagcctgggctctctctctctgcatgttcttggcatcctttgaatccacaaacaatgaacagtggtctcattgaataggaagagagcaaatcagacattgaaagaaaaactaatggtgtgtgggtcttgatgactattgggaagggcagcggctttagccgctggtgggcgtggctgcacggtgaactcacactgctgccaatgcagtcacagaagacagtcaggttgaccccactggcagcaaaatgccagtctttccatcaagatgagagcagggctctggactcaaatccgaacttgcaacagtcccttctagtcctaaattctctgctcttcaccattttgctatagctcagacaactctctccctttttgttcatttgttttcacatgtgggagggggtgtgtgatgtgctatttgaggtgctgatgaactcagcaaagaccctggagatacactgagtgtgattgctgtgtgctcaccacaagacaccagcaactgagcatgcacccttggtgcagtcttgccagtgcctgcgtgcctgcgaccagcatgcaagagttcctctggatcctagaaataaggtggctgtcagtgagggaggccagtgtaaaaatggaaaggccccaccatttttgggaggataaaatccaaaggagaaaactgtgtgccgtgttgccaccaacactcgcacgagttccgtcctcactgccagtgttattcattacagtgcctgctgctctggaggcataatttaaaaagatgcattactgcagagaccctccccaagataagtcagtactctgaggctctttcacttcaaagtctttttccaggaacgttagaaagaagaaagtgctttagagttctttgtagaaacatagacaattgcaggattgcatgagtcactattttctgttagctgtgatttcttctaccattggctccttatgaaaaaaaagtgtgtgtgcatatatgtgtgcatgtatatatgtgtgtgtgcacacgtgtgtctatatatgtatgcgtatacatgtgcatacatgtgtgtgcatatatgtgtatacatatgtgtatacctgtgtatatacatttaaatatgtgtatatgtacgtgtgtatacttgtgtatatacatgtgtatatatatgcctgcatatatgcatgcatgtgtgtttatgtgagtatacatgtgtatatatatatctgcatgtatgtgtgtgtatagtgtgtgtatatatgtctgtgtggggatatgtatttatatgtgtgtggatatatatgtgtgggggtatatgagtatatatgtgtatgtgtgtatacatgtgtgtatgtgtgcatatatgtgtgtatatgcatgtatgtgcatgcatatgtgtatatatgtatgtgtgtatatgttgtgtatgtgtggtgtgtgtatatatgtgtatgcatgtgtatatgtgtgtgtgtatgcatgtgtgtatatgtgtatatatgcatgtgtgtatatgtgtatgtgtgtgtatgtgtggtgtgtctatatatgtatgtgtgtatgtattatatatacaatttttaaatttagggtatatctcgaactggaggctccagtttatgagcctgaaatgccattaaactggtgtgataaattctaattgagtggatacatgtcttctctgagagggataatttagggaaatccaagaagactgcagtttaaagccacatagacatgttagcagaaagtttaggaaactgaaaacacatttttatagttttaaaaagcttctgttttcttttttctgaagtgtaacatttctctggcttctgaacttctgcaggtgattacatgaagtttacactgtatctgtgctgcactttcccctttgcttcctaaaataattcatcttccatagtaacagtctcttcaaagcaggatttatctcgaaccctttcacacacaaccaggcacaaagtcacgttctttaccttgaagctgggacacaggaagagccgtgggcttgatttccagcctcctcctcaagcatccccaggacccttcataaacggaatgaactcgagctggctcaactgcttgttttaaaagtgtgttttttaggaaatacttgttctgccatctcccccatagttttacaaagtaaatcacgttgtgcttggaatcgtccctgcctacgctcgagaactgttcacttagaaaataaacatgtgggtaagcattggtccatacgtataagcgatcaagagaccctggcccccgtggaaacatgttttcaggcaatccagctctggtactctttgagctgcctttctattttacggcatgttcagaagatgaatctaccattacgctgactaacgaagtctagtcatagcgatagcggtgtcttagcagcagaagtgatggttggttaactgagcgtgttttagacgccatctgcattacaaagtatcttccatggggtaggccatggagtcagcaccactgttctcgaggggcagtctctagctcctcatcttacaagggcaactgacgctgacattcaacaactggtgcaatgtcagctgcaggcgagtaggtggagcaggacctactcagcaccaggcgggctgcccctccacagtttgcggtgataataaggcactttacagaggatgctaccatacttggtatagaaatcttgaaaaagtggatgctccggtgaagctcagagaggctgtgtggggtacccggggtgcacaggcacggacctcagacgcaaactcaacacattcatgcccatctttccatttatgtttggttggatcagcctaatttgcttgtatggaatgaaattcagaaaaaaaagaaggatgatttatttttacagcctttgaaatgtccttagtcatgtacttgtacttggtttgaaatcgtatcataaattggaatcagggaatttgaagggaattttcaaagtcccttgtgactctacatgtgcaatcttcagcatcgagtattccccaattttccacaggggatacacttttctatcatgatctgggcccctgtcctgcccttcagccacagttcatctttcctgaccattctgtcctatgataacgtctccctttaattttctccgtggctcatttgacagctaacctgtgtccacttttctgttttaacagctagcttctttacacaaggtatgggtgtctcaaatgtttaggcacatatgtgaaattctaattggttgattgctttgccagaaatgaccctataacctgggccagattaccagatgtgccagagtgtgctccagtcggtgggatatgcccctgggccagccagggtgtatctcagccagacagccacaagatgcagtgctggacaccccagtcctgagttgatggagctgctgactttctgggtttcagctgtatcatcagtaagagtgctgtatctattcaggcagaggagatggtctctccagctccactagagatcttagatctgtgatgcacaggtaattactcctaaaattacctgagacgatttctgaaatcatgagggagtggcttcctgaggagcgatgattacacaaacccgggaggacctggaggtcctgcttctgtcactggctgggctgcgtatcataccttttcataactacaaaccctccctgaaggtcttcccaaggtgaaatatccaagaacaagtagactgtatttgctcttgctgttgttccccatggtggacgcttgccataaatatggtggtggtgtctgcaagactggctacgttcatgactgctctcacatgcttttctgaagcatagattaagtggcagctctacaaagagtgagatttatagcctagtttatgttttttgggggtaagaaattcttcagtgtttctagaagctacttaaccttggttgatgtcacttaaaggagaggaaaattctgggtttgcaaggggagcctcctggtgttttgagtaggtcagcatccacattaccagatggtaaagacactttgctaggacctttgacaagctaagtactcgaggggctgtgatactgaagggggtggagaatggaggtggctcataaataatgtggtgctggtaggctgcagcccagacatgaccacagcgcagggaaacgcacctccgccagtcttggcgaacttcacagcaccttcccatacaaaagtggcagatactgatctaactgcatcagaagtccttgctatcggtccgtgaaaggtctaagttaatctgtcccttactatcttaaattaaacgggcacatgactccaccgaccgtccacgaggtctttcctggagtgaagctttaattctctgtccgcccactgcagtcccggataggggagtaagaaggtctgacagttaatgacacttgaggaagatgtgcgtgcctggagcttctcagcagtgggacatttgcccctagcagagggtcgagggacactggcaaatgctgacgtggatgtagcacggtcaccaaaaccccgcgtgtccgagatggtggagcagcttttcccggctcatgtgagggctggccagccacacagcaccaggctgactttagcagcttggtctcccaagccgaggctatctgaaggacaccagagagctgcgtttctccttctgtgccaaggtgaacacacaacgcttcagatgttccgctctcccctcgtgagacagacggcccggcttctgtgtggctttggggatgggagtgccagtcactggccacagaatgacaaattgcctccctgccaatatcagagcagggacagttctcgccacagcgtcctccagatgggcccaattaaactattagccaatgagcaaggtctgatggctccattaggaaccaccctgtgcttaaataaacagctcagaatacatagtttctccatcgagccctggctcggcgaaggccccatctgggcaaggtctccaaggttggccctggcgagccccagggggtgttggggtggctggggcaggccgccctccctggttctcagggtcctgcaagccacaccgcagtgggtgatgtgagagagggggcagcacccccacctgccatggccagggccaagttctccaccagctgcacccctttgcttgtgcacgcctagacaaccacactccctgactggatggaacttccagaaccagcccctgacctcagcacactagtcccttgccagctgtctttcccacatacagaaatttcaggcccgtgctgtttggctgttcatcatttgtaattactgccaagcaaggggcacatttcgtgcagaataaatgaagacagcagacagcgaagcggggccttactgcctgagcgtggtgggcgtgactctcggggggagcgggggctgcctgcttatgggtgctgctttctctctgcccgtgaaggtgaccatcacacaggcccagggcccctcagggctcttctcacccccacacgacccagggttggttcccagtgggagcagagcctgcccaggagagaccgctatctccactggtccagcttacacaaagatccatcgaaaagcatcagttcttgagaaaaacgacactataaataaaatggttttcaatacagagagctgggctccatcaaccctgctgagatccttggggacggggctgcgcctttctctttgtgattatggtcactgtattccagtaatttgggtgaactctgattggccatccaatatctttgatgttctaggaggtcacacactgcaaaaagcaaagcgggtctgtcccctgcttgcttctattgggaggggccacctcacgccctgcagcacagccctggccagtgacagctcagcatggctgcccagtctcagcttttaactggggcatctgttctgcaaatgctcctgagcacccactgtgcaccggccctgctagggacgtagcagtgaccaggactgccaaggcccctactgggtttaattcattccgtgtaatctcaggctgctgccagctcccgggaagaccaagccatctgtgctcctcccgggagcatcccacttcctttccagagctcggggctcaccttttggattctgtcctcctaccactgacatctgctcttaggggaggaagagaaacttcctcggggggcaaatgagaaatagctaatttgtgcggtgtgcaaaagaaagtcattgcttgctagaattgttgctatgatttttccttattcattaatttccttttgctactgggtagcatattgttgttcttggtttgtgttgaccttttcagtcctcatgaaaacaagccgtcctgaggcaggccttctttgcacaggtcagcatcagcaaggaaggctcattacccatttttaatgcagttagatggtgctgaacttgactgtgtgctttcactccaagatttgccctcttatcaccccccaagactaaggtcttggcctaggactgataaacaaaccagccgatccgtgacagtgatggaagggtgcgtgtgtgcagagttggggggcatgcacgctttctctgctctactcctcttctgccaaggccagtgtcctccctgagatgccaagcccctcagacgatggaggcctcctcccccctgggatcctgatgacaaccatctcaggcacccaatcacagagtgcttggaaatggccacttagagcttccctgcaaaagggtggctgatcccaatgtgaggctgttgttgtctccaagggccaccttcccacggaggtgacttgcacgagggtgtcagcgtccaggggaaatatggggctgctgccacagcctagagacagacaggagatggcgaggagggagactggtgcccaggcgctggcttgcctggggtcccagtcatggcagaaggacttggggagacagcatggaacaggaatccctgctcagagctgctgttgagacacagaaagaacctcccttgctggtgtctggcagagggtgttgatgacagtccaggggcatgaagaggctggggtttgaggctgctgtaggctctgtggggtcccaggaatgttggggggcccaggaatgtgcccactttcaatcttggtcagcgctctccacccgacgccttgtgtgcctgcagagccgcagtctccaccagacgcctcgtgtgcctgcagagccacagtctccaccccacgcctcatgtgcctgcagagccacagtctccacccaacgccttctgtgcctgcagagccgcagtgtccacccaacaccttctgtgcctgcagagccgcagggtctgggttttgtggcaccacatgttcggtctcatctcctcccaaatcctgttaaatttccctgaatttaggaccaggcccaatgccatggacacagtagaccctcaataaatgagtaatcaaattgatggtgaagaactgattttttttcctgttaaccctccctagcagggtttttattaatggggttttcagcagcttgcgattgaaaggccgccttgccccagggtacaatgaagtcaggacccccaggagggaggctccgtgtggctgggggaggggagtaacagaatgagcataaaatcgcagggagatgccccacagctgccccgggggtcctgggggctggctctgtggaggtagaggagcagaggtgccttcagcatccgatgctcctgcctgtgtctgggtctcctctccacgcctgctccttccccatcaccctgttctctgtggccattgcaggtgttgtaagccacatcaaatccacttgaaatggggtgaaatgaatctaccaatacctgaatcagtcagtagcaacctgaggtgatcatgtagttttctggttgcctgaggcttgcatttcaggctcagcttcaacaggttccagtggccatggggacaggaagtgcacgcctcccccgagggtcttagctcacccaaggctgcagtgtgagggccacatttcctgggggccaccccatggcactggctaccccaggggtgctgagacaggcctgttcctggagaccacctagaccctccaatatcacctgcttctgtctaagctctgaaatccccttccggcgtggtggtgcctcccctgtgcagccccacccagaacccctctttccacctgtgcagtgtgccccagcttccccgcagggtggcagttcagggctcactccccagcttcccacttactgcccacctacccctctagacagaggttctgccagggcggggctttcctgtttcctttggttctgtcagatcccagcatggaccgatcccgaagtgcagtccctcagagggtggagtgggcatttatgtgggctatttggtaatggcagcaatgtcgcctctccctgacgactctaccaggttggccctgcatgcttctgtgtgctgcaggtgagcttggctcatggctgctgatcactgcagccccttcccagccacacgccaggcccaaggtgatgcatgctgggccatgccaggcacctgtgatgaaatgctcagttgtgtgaaggtgctggccagcccacgagagctggaatgccagagtcacattcagttacaaggtggagccatcagcacagcaggcaggcgtgagggtgaggacgcggtcgggaggaatctcacttcccctgcagacccttgggagagatgcaggggacacagggcgaggactgggaggtgaggttccagcaggggcagggttagccctgcatggggcctttccttgaggtttctctgtagggtgtcccctgagccctgaggccacaccccttggctgctgaacctgcctgtgctatgacagttcattgtcctggacaataaggcactagaacagagggggtgttgataattaagccaagctccatgctgtggaaagcgggtgcccactcaacaccccaggtctaaggggacgtggcaggtttcactcccagactggccctaatgcagaagagaagggagaaaccaccaggttcccacattgccatccaggcatcttttccgggctgagttttctgcaaggcttgtcgggtccatcagaggtaaaaactgcaacgcacacctaattatacctaatttgctattgattaactatttattctaacagaaccactgtaaaactgtcctgtgtgtttaactatcaaaataaaggagtgctggcaccttctgcattttcaaacattctatgctctaggtcaaagttcagcatttttattgactctaaacaggagatggaaaaccacattagaaaaagtggaattaaaaaaaaaaagaaaactggaaatgcctttttattagaaaatggcctcatgggcatggctggctttcaggagtaagttcatggaggatcccttttgatgtgtcagtactggaacaagcgaggttttgagtattttcagtagcatctttgttcaaagttaatcttgtggatatcaaaccacctcttggaaggaggaagaatatctattttcatgtttacattacaaaagagcttataaattagtgggtttcactaaaagttgtattgaagtaagctgtgggttttgtgtgaggtgtgaggtgtgcccacacacctatatatctcgtttatctagcttcatccagacaaaacagtgttcacatttaatttttcagataactgaaataaagctgtctaagagtaaagtctttataaaattgtaagcacttttattaatgcacttctgggatatttttcttactccccctgcttttgaaaacagaaactacatcataacgtaatcttttaaaggtactacatcgccaaaatgggcatcaattaaaaccctggaaagtaactttgaaataatcccccttgtgttagtagaacaatgtatgctcatctggggcctcagatgacgtcgaacctagggactcatggcgtctcctccaccaggaatccctgccagcctcccagggtccacgtgtaattctacttttctcttctgccatgactcctagcccaaagacaaatacttctttgcaatctcatattgtgctaattttacaacatctgatatttttggggtggtattagatagcttcactttcatactggttgagaggttgggggaaagagagagagggaaagagagaaaaagggagagagagagagagagagctgctaataatatacaactctattcctctagtgcgtggtcttgtgaatgacgcacacttgttgcataaaaggcctttctcttcatattggggtgttggctatgacttgagatttgggactctcacgcgtcttcatgtgggatgtgccagctttgactctgtgactagaactgacttctttaggccaatgtgctcaaagataataatggtaattaatctttttttaatgtgcctattatatatgggaaggttatcttaaaattaaaattatcttcaaggcttatttatcctgttgcccagagaatgctgtggattttttttccatgccatgaagtagaggcattaggatgggccagaaaaaaacaaagcaaattccttcaaagataagatactttaagttgaaaaatcaaggaactctctcttcctaaagcagtggtacccatctagtgttttgtgtgtgtgtgtgtgtgtgtgtgtgtggtgtttaacaaaagttctcataaaacttagggtttctgattaactcagtgatgccaaattctattttttttttccacaacgtacaccatagaaagcatgcagccttgtgaaaagttcgaaaagaggtcttcagattcagagtctccaggtggccaatttcttctgatctagattttcaaaaaagtatgaaagcagcaaaaagttattaagcaaagctcaatggcacagctcaacttcagtacgttgcttcttgtagtactgcaaattctaattaatggcttgctcattgcacacaggaagtgagatttagcctagggaaaagaaagcaaggagtaactcaaggaatttgataaatcatatttttttatgtttaaaattccttctttttaaaagcggtgaaaatgtaacactttctcttcctcttactggaaattttcaaataattttgtctttcctcctctcttggcctcagacagattatggagataatgcactcaccatctctctcccctctgaagccacggtttcctgaaggtctcccatttctggagtctctcgaggcctccaacagaaggcagcatctcctgtgctgcaggcggttaccaagtaacagacctcagaagccttccaaggtccaaggatgtaaatgcagtatgtcctctaagccgagcgcagggtgctggaatccgagagccaggggccatggtgagagcttcctttgctgggaggcatggatgggatgaactccctggaggtggaagggcagcctccctcccggtctttctctcctgtctctccctctctatctctgtctctgattctctctctttctctctgctctcagtttctctctggttctgtttctccccgtctctgtctctctttatctgattctctgtctctctttatctgattctctgtctgtgtctgcctcagtctctctctatctcagtctctctctctctttctgtgtctctctgtctcttatctgatcctgtgtgtgtctgtgtatctcttctgtctctactgtctctctctgtgtctctgtgtctctctgtctgattctctctctctgtctctatctgattctgtctgatgctgtctctctctctctctgtatcttattctccctgtctctctctgtgtctctctatctctatctgattgtctttttctgtctctctctgtctctatctgattctctctctctctgtatgtctctctgtctgattctctctgtttttctctgtctctctctctatgtagctcttctgtctctctctatctgattctgtctctctctgtctctatctgattctctgattctctctgtttttctctgtctctctgtgtatctcttgtctttctctgtctctatctgatactgtctctgtctgattctctctgtttttctctctctgtgtatctcttttctctctctgtctctgtctgattctgtctgtctctttttctgtctctatctgattctgcctgattcgcgtctctctctgtctctgattctctctgtctctctatctctctctcactccattggcatcagcacaggacccagtggtgcaggggaagctcccagccatacaggacaagcctctgtcacgacagcccttgctggtgtctgcatcaggaggtctccttggcgatgaggtctaaggagcaactggcatcagaacagagcctccaacctgccttaggtcgtcaagactttgaagcaagagcctcagatgcaattagcaggacctgcctttgtgtcgtgtgctctgagctagtctcgcggaggctgctattgtttggggttcagctgtcagtattgttatcctgcaaaatctctgaatttccacttctctgtccaagtgccatgaagccagccaagtggggagaaagggttcttctgagattgattttttcccagacactgtggttctgttcaattgaattcactcaagttgtggttaacataagcactacggagagtatgacatgtcaaattagcagctttgcaaatctcctgttaattgtcagcctaattaaaaaattgctaattataatgtttataacttcaaataactgctcagctataaagtaggcctgtcaggtgtaacacaggggactggagggaaaaagtcaatcgacatctgttaatttatcagcggcagtataccaaattgaaaaatagattgcctattgcactgtaaatctgcattacaatgaaaagaccgaatcattccacacctgctaaataaacggggatgggagtccttcctggcctgccccgggctcctctgctgctcacatccccgtcctgtctatgagctgggggaaggccggagccaggcacagggacagaaaatgggggtccccacgcgacatctaaaaaacgaaaaaaccaaactgactaaaacgtgcacagaaacacgattcagacagtgggagcggggtgatccctcttccctggaaggagcctggagccccactgccggccccggtcactttagtctgaattctcagcgcgtctccagctgcagaacgatgaggctggaatacaacgcctttgtctctaagatccgggcaatcccagcccaactttcagagcctggtgaactcgcctatgcccacatctgcaggggtagctcctgctgggccctgccccatctgggcaacccatcatgctgcttccagtagttcctccgcctgccttccctcctctcctccagtgtcctgtgagactccggggcaggggctgtctccaccctcttcctccattgcctgccctgcctgggcgacccatcatgctgcttctgggttcatctgcctgccttccctcctctcctccagtgtcctgtgagactccggggcaggggctgtctccaccctcttcctccattgcctgccctgcctgggcgacccatcatgctgcttctgggttcatctgcctgccttccttcctctcctccactgtcctgtgagaccccggggcaggggctgtctccaccctcttcctccattgcctgccctgcctgggcaacccatcatgcagcttcctggttcatccgcctgccttccttgctctcctccagtatcctgtgtccaccctcctcctccatcgcccccttccagtctggggagtggagcatgcagaatagaagctccctgtgaccgagcctgtgctcacaaagcactggctacttcctggaggataatcatcaatccccttctgcaggtgcactaacagcacttgggtgttgtttagtttggttcaacaaacatttattgagcatttcactctgtgtcagaaattattaattattaatatattcagatgagggaagcaaagtcggtcgtaaggtcccacctttgggaagtttacagatgagtgtgactatgtatgttggattaaactggggtggaatggtggccagtcatgtcagccacaggtaactgcatgtaatgaggggtaaagaaggaacgaatagctccagtatctggggctccagagcccctgggattttgccctgtcaaccagaacacgtaaggcccaagaccccagaaaaagggtggatttgtcttataattgtgcccctctgatgtttcctgttgggaccccgtgtatcaggtgagcagtagcagagttggatccagtgtcggggtatccatggacacctgcccatccccagccctgcaccttggccccaaagtctctgaacttttgatccgcactgtgtcagtatacgtctggccttgccttcattccactgcatgtttaaccacattctgatagagcaggagcatcaccatcttggacaaacgccaccattttaagttctccttgattaaaaaccacctaaatccagccccaaaacatcagcctaatggctaatgtcagcatgaccagaaacattccaaccctgagataaaccccccctctgaccagaaacatgccaaccctgagataacctcgtctccaaacagaggcattccaaccctgcaataaactttccctcacacagaaacattccgagcctgcgataagctcccctccctaaacccttaaatacccttagtctgtaagagagtgctcctgaccgaaatcagccagaagcccctctcaggtttattttccaaaataaacctgtctttgactgtgaagccacttttcatgtttcctttcttctttctttaactcttacacattccccaggccctgtccccgtcgtcactttctctgggtcataattgggtacattcccagtggttttgtgtaccttagctagagggagggtgggtttccacggtttcctgagtcacagatggcctatgtctcacaggttatccctttcttccccacccaaacgtcctctcatctcatctcccaatagaggagaaagagaattagaaagcttcactgccttgggccaggtttctttccttcatggtctttattttacaggatgccttggaagttgtctgtctgaagaggcagctagggttgggggagggccccggcaagcacctagagtgcagacaagttaagcagagggtgggctttagccagggaagcagagccagggtggggagtacagaaccagcccagagcagagacagagggagggcaccatgtgagggtcggcattcaccgagcagacaggaaccagcagtcacactgcccaggatcctcttccaaacctgcctcagataatgtcacaatcactcccattgcacagacagatacttcaggcactgactttcacacacttgccctaaatttcccaagtgcaaagggacggggagaatcaggcactcaagtctctgggcagcttcaccgtcttccctctacggaaccgcactgctgctggggagggaaaggggctaggagctataaatcaggctgaagaaagggaaatgcaggcactgaggcagcggcagacgctctgacagatgaacctgcactgcagctgctcctctcagggcatgtgcattgagcccaggagtccccagggaggtccacaccctaagcccgggacccagacatgttacttttcagcgttgaaggtgctttaaggatgtggttaaggttactgaccctgcagtgggaggatgtcccagactattcttggaagggttattggcccaatccaataacccttcaaagcagagaactttctcccactaaaatcagagaggtttggaggtgaggggagcccggtccacgggtttgaggaggaattcatccaggcagcctccaggagcccaggctggccccagcggagaggagatgggcctccatcctcggcctcaggaactgaattcagccagcgccctgattgaaccggggcagggccctcggagccccctgcagagcttccccatggaccccttcccccacccagagcctgacctgcctgctcttggttccggccttgcaagggtttttcagaggactcagtgcagccacgtgggcccagacttctgactcacggaaccatgaggtaacaaatggcatggttttatgctgcttagtttgtggtaattttaccacagctattaaaaactagagcgagtttatttcctgttccagaactgtcaaatctgggtgaggctagggtctgcagtgaactacggcccctcgaaacccatggcttccagcaggccagagacagaggacagcagggaggagtccgcaggctccggttgcaacaattcacatcatttccgctcctgctgtgaccacgccgggtgcccagggtgctgggcaggaagttggggcgacgtctcccagcagtgcccctctaggggaagaagcactggctcctgacgggcagcggccacctctgctctggtttctacggaccagacatttgtacacatgtggcctgggagcatcagcagaacgccagggtgtgacccagagaactgccaatcaaccagacgcggaacacgacatcaccaggcagacacaggacaaagctaaatttaagtccagtggatgtgattagctgcaatgttcaattgaattatttggtaaactcagttaataaattttataaattcaatatattttatagtgtgcaattaaagtattttaaaagtgatcaactattttagagcagttttcggtttacagaaaagttgagcagaaagtacagagacttcccatacatgccgcctccttgtacacagtttgtcctactattaacatcttgcatccatgtgcgcattgattacgactgatgaagcagtattgatgcattattattggctctatttacatctgggttactctgcgtggtgcggctctgagaattgcgacaagtgcatctccccgccgtggctgctacagagcgctgctacagagcgctgccactcccgaaacgccctccgtgctccgcctgctcatccctccctccccgccacccctggaaaccatgaatctttttactgtccgcgtagtttcgctcttttcagaacatcatagagttgaaatcacatagtttgtaacctttgcagatgggcttctttcacttaataatgtgcatttaagctttctctatgtgtcttcatgacttgacaaatgaatttttttttttttctttgagacagagtctcgctctgtcacccaggctagagtgcagtgacgtgatctcggctcactgcaatctctgcctcctgggttcaagtgattcttctgccttagcctcccaagtatctgggactacaggcacatgctaccatgcctggctaatttttgtatttttagtagacagggtttcgccatcttgaccaggctggtctggaactcctggcttcaggtgatctgcttgcctcggactcccaaagtgctgggattgcaggtgtgagccaccacgcctggccaggtcatttctttttagcatgaaatatcattccctggtctgaacgtgctactgtttatccattcacccactgaaggacatctggctgctgccgagttttggcaatgatgaatagtgtggctgtaaacagctgtttctgtgcagtttctgtgtgcctgtgttttcacgcctgtgggtcagtgtgcgggtttgtgtgtgtccgcgtttccatgcctgttggtcagtatgtgggtttctgtgtgcccgtgtttctgtgcctgtgggtcagtatgtgggtttctgtgtgtccgtgtttccatgcctgttggtcagtgtgtgggtttctgtgtgcccgtgtttccatgcctgctggtcagtgtgtgggtttctgtgtgcctgtgtttccatgcctgtgggtcagtatcaaggtatgcacttgctgaatcgtatgaacagagtgtgttcagctttgcaggaaacttccagaccactctccacagtggctgcaccatcctgcactcccaccagcaatgaatgagggtttctgttgctccacatccttcaaagacctgacctaacgacccacaaatgctgctgtcacggcttctttctaagaggcttcacggtccagagaaatgcatttcacgaatggcctttagcagttggtaagaagaattgctgtttacggcgagcaggctgtgtgctgggcatctctcatgttcatcatctcatttcatcatctcggtcgtctggtaggagtgcactagcctccctcaatttctgacaagtagctgaagactggggagatgaagtaacttctcaaagatcacagtcagcagacggcaaggggaacgtgggactcccatgcggctgactctgggggccctgccatccccagcctagggcgctgtgtgctgcatcctcatcgctctgttgccaaatggctcctcaagactgccagagttcttctgtgccccactgagttgcgtgggcttaattgcttagaatgagatggcagaagaaatgttgagaagggaaatcaagaaaacagatggcattcaggaggccacagaaccgaaagaaagaacaccagggacccatgagattcaaggtgagtcatgccgacaccttgaccaggggcaagggggaaggagcccccgtattttgtcattaaaatctctagagttgccagaacttcttgtattaagtttcacttttcccacaggaagtactggaatcataattaaaggaaaaaaaagcttaggtcactgctaacttccaacttcaacatctttaattttagttatttcccctggctccctggcttattgccctagatctttccttaatatttaagacttcatataacaattaatataaaagcttcaccgccgtttccagctcattggaaatgcacgtgagtgggcgttgtgcgcagacactgagcgtggctgggggagacgccacagaaacagaggacgcaccccgacgtggggaactcgcatccacccagggaacggcacacatctgcctccactgccaatgcaggagcactgggcccacccgagaggacctccacgaatgccttctgcatgcggggcacccgaggcccagagagggaatccccaggcaccccacccaggcggtgcatagacagtgctaggccctgcatgccggggtccagcccagggctgtggcctgtgccaaatgccaagaagcaatcgtctactgggaggggaaatgtcagccattctgaggcagctcagggaaatccaactcctcggtcctgaggacatcaagagaaaaaggagtgatggcacaggccggggtccgggggaagggaggggcatttctctgggaagcccctggagatgacacttccctgggggccttgtgtcccccagagaaggcctcaggccagtggcatggatgcttcgaaggcttcttgggtttgcagcatctcagggctcaccagaggcctccaggcccacagtaaatgagggtgcggcacgggggcgtcagaggacggacaaggatagcacagcaacgaagcactccaagggcttagcccgacattcagggacccacagagtggcctgcagggagctggggcccagccacagtcctgccaggtggaaggaccgggcatggaggctccaggctgagaccagcattggatagggtgggtgggcagggattacttaggtgccaataacccaggagtagaggagatggcaccgctataaaatgccacgagaggtgcgcacaagggttcagggctgcatagaaccgggagggagaggaagaccccgctggagcaagtgccagggtgacagagccagaggactttctgagatagcacagccccgagggtcggcagggcactgagggccacctgccctgcctgccccgccagggcgagcatctgaatccacattctcctgggccgcagctcatctgcgagtcggagcctccgaaggggggccagtagcacatgtcccagcctctctcgcccaggtgatcctcatgaccagacgcggctttgctacaagacagctcagactgtgttcccccaatcgtgttcccgcaggaaagctgcccgaggatttttgtcatgcacacgccgctgccagcccattagctctccctgcttcccatggtctgccgcatctggggtatccagcgtcctcctgcagccgagggggaattctgaatgttttgctagaaaccgtctcatcaacattcagtttcctaacattggttccaatcctgatttttagcttcattttttttgaggggcgagggcatctgggcactggaaatgcgggaacccacacgcagctcatccacccataggctctgacatgtttaacttatatctgaaagactctgagactcgagatggccaatgtttaacggcatcagctttgaccagcacagttgcaattatttgacatgatgtgttcaacccatcaaagttgaccaagggttttgtagacccatttgctcagggtaacataagatcttttgacaaacatgtctgtttacgtactttcagaatttgtgtagactctgaaaagacccctgatgtaatctactaaaaacatagagggtttttaagttattgttatgtaattaacatctgtaacggcagttgacttaaggaaatgtctttgcacttacagtaagtacatttgtgtgaggaattatttgcgtaaattgtcccaaatagaatttaatttaaaagcatagattttatgatcttgctcatgaaaagctgagaatgatgaatcaaacattaagttaaatgtcacatgataattagtcagatattgcgagcttacaactaggatctttctgattctctgtctcttctttaggcatcaggactgaatcatatgttttatgaggcctataaaacatgcaaacctctgatttagctatttttaaggactgtagagacactcaaatttggtgtatttaagttgaactcacatataggatatgtaaaattgcatacaaaattgcaaatggggttctctgtaaatatgtttgctaatgagaatattttaatttcatagatcataccaggaagataaatcatccatttacaaacagcagttgcttaaaagatgtggactaggcaatttttccatctccagtggaactgagaggtccttgttttcacagctgaatattcaaaggggtgtttaccataattggaggatgcttgacagtttatgcagcccacacttagcaggcttcaaaatacatcctgaattatttgttgcaaacccctagataaacaagcaagaaatgctgctcaattgtcctaaaaagccacaaattagaggtattttgggttactcatagtgatttctgaatgcagtggtaaaattctgatttccatttgtattaattctctttgtgaactttaaaagaactatctttcaagtttaataacctttctgaaaaaaatcataactgtagatattaacctgaaacacaagaaaatggatcaggtggggcatcacctgtgaagccttgttgggaatatgttgggtgagaacattaggtcacttctctctgacaaggacaccctccttggctaaaggctggttgggtcctgtgagccctccctggatgaggcgttagcaggaatcccgctgagatagtgggctggacgctcaccctcacccttagtgatattaaccgagggcctctgtgattttctctccaggccctcgccccaccactcggctgtcatccccactggccgctggtgcatttggacttgggttcagtctctctctccggttgcaatagttttgagtgaagtcttccttctttgcttaactggtgtcatacaatttttcttttgcatgtgttacaactcattagaacccagtcatgtgacatactgctccctctaggaatgaggcacaaaggacattggaacagtcaaaatacacttctcaaactttaggcactgacatgtgtgctgttagtgcagtggaaaacccctcagatatgaattcagagacagtttgccaatattttagttaagcatctacaaagcttggattcgtgtgtggttttccaagtcccagggcatgcaaatgagccaattagaagcagtggtggggctgatcggctcactggaggtcaggaaaagtggtgtgaatcacccacgttcaggtcaagaactcaaacagcaaatagcaattagggctgaacactgaagggaccaacactgtcaccatctcaagaggccccgtgtgcactgttctgcggcactttatgagaaccaattttcataatgataagccctggtccccaaggaaagattgatttatgtttcacatatttattaatggaaggagaagggcattctaatctgttcgagagctttctttctaaataaaacagtcctcccgttgtgctgctcacaggctgcttctgttacatccaggaggaccatcttctgtgagctcctggtggcaaaggtgttattatgtgtgacagagcctggttaggtggcaccagccctgtaggaaggaccagtgcagtagctagtttattttcaccttgggctggttggccgtgaccgtctccccttggcccctggggctggcctgaggacaacactggggaattacaaatggagaggacattttatgcagcaagccaagccctagcctactgcctgcctaatgtcacagtgagatgagaagcccaggtctgcagggtgaggtggtacctcccaggtgccctacaggtgagagtcctcatcagggcttcaccaggatccctcagctccacgaagagctgtgcagggctagtgaggcctgaggagatgataccacgcgtgtctcccaggggggttgacaccaacccctagaagggaacagaggtctcagagtcagccgatcccgaggacttgaaagtcaggctccctggaagctaccaccacccacctgccttgtgtgaaagcagcacacacataacacatagagacacacacagacacacacacagacacatgcagacacacaaacagggagacacaaacacagacacagacacacacacactcacagggagacacagctagacacacagacacactcacagagaaaaacacaggcacactcagagagacacacacagacacaaacacacagactcactcacaaacacagacacactcatacagagacacacagacacaaacacacacagacacatgcagatacacacacagggagacacaaacacacacagacacatgcagacacacacacccacagggagacacacctagacacacacagacacacagagacaaacacagacacactcatagagaaaaacacacagacacaaacacacagacacagtcacagagacaaacacagacacatagactcacagacacacaaacagacacactcatagagacacacagacacaaatacacacagacacactcaccaagacaaacacagacacacccatagagagatgcacacagacacaaacacacacagacacatgcagacacacagacacatgcagacttgcacatgggaagaaaccattcacgtgtgggtacagggcgtctgtgagtctcacacttgaccgtgtctccagtctggagcctcaggccttcatgaagcctcccaggttcctagggggaagacatagcctctgtggaaccctacactaaacattttgaatatttggaaagatatctttataatccagccaatatcaaaccttcactttccttctgttagcagccaatatgtttgcgtataattttcatactagtttgtgtcatagtaagttaaagagatagtatttggaaggttttgcatcaagatttccttcctagcacatggaatttcagaaataatatttattacatttcccaaagtttgaacaggggtccttagaggactgaacccagcagcagatggattttacttagggcacattatttcaaaacattcagatgattcatcagcttataaactgagatttgttccagtaagattttggctattggcttcccttgaaacaccaggagctcctgcttccttgaaactgagttaccactgggagcagttgtcagatgctgaccggcagccacccctctcccagtggccccggccctgccacacataccagcagccctgccacacttgactcattcctggaaggaacctggtgcctggacacctgagtgtgcagcgccactgaagctcaacgcttactgtcgctcagggcctcgaggctcagaaagtgtgtgacttaaacacgtcacggaggccgggcacacagtggggccaacactacggcttcctgagctgtccagcaggtttctgcttctcaacgcggccctgcctggttctgtaagagcaggagcaggagcaggtgattaggacgtctgcgcaggagccgtggcaaaaacgcttccagacaatggggaactcagacgtctggaagggacgggggcagaacgtcagcgccacagacaaatgtgaatcaggcttattacacatctattgagtgagtcagctgcacacctcaagccttttcctgattctgatttttaaatggaatttcaaattctttctttgaaaagaaaaggaaaggtcaaatacaggtaatttcatctccgtgccgcgcatgcacatttcaaatacaatcttccagcttgctgcctgttctcacacctcccggttacttctcctcttcccagggacccagacggggagagggtgctgggcgccggcaagccacagcgtctgctctcatgatctcgcccccacccgccttgggcccccagaggtctgtgctccgctcctcttcctcctcagaactttctattcattacatcccagcagagcacctcaccacggttgccccaggaaaggatgcatgtgtggttttgctgtgctttttgtttacaaaactgatcatgttggttaactccagcccagatgttgcagaggttaagtctgctatcaacctggagatgttcggaaggagacagccatcaccacccgtcacacctgctttgctgcttctggtaacatgcatttgcctgcaggctcagggcacgtggaaggaggtgtgagatagaatcgggacagggccaacttgcccatggaggtggcatctccctcgtgcttctctggattctgtcacctgttccagtcctgggaatgggctgacaattcatctcctcgttctgtgcctataacattgcattcccagagcatcggtgccacctttccagctgcgacagtgtaccctgtgtaccacatccagtaacctgcaataagagacgctccatacgctgcgtcaaattgaggaacatgcagcgaatctgccacagacactgacaccacgtcgcaccgagatgcccaggaaatcaggagttaaggagacgtcgctgcttcccttttcccttctcacttgcactgggggggagtggggtgtctgtacctaaaagccctttctcactggctgtctttcggcaacatacttgctcttgattcacatgcccctgttcatgcacacttcggggggcggaggggcagagccctaccccatccccgagagtcagtgtgtgaggtgggcatcaagcagagccctaccccatccccgagagtcagtgtgtgaggtgggcatcaagcagagccctaccccatccccgagagtcagtatgtggggtgggtgtggacagcgggtgtggacagcctgccatcgttttcctctctctctgtctccacgggcactgccaacgccccgtctttcaacctcctttgcagcttggggctcctgtggactgcgggctgcccagggatgtgctgtgggttcctgggaagggcgctggggtgtcgagcaccttggccatcctaaacttaaacaccacgcgggctcgtaattaatccttcttgaaggaacgctgctgattccctcgacattaccaacaatctgcggttgaactacagacatacacccaagcgggcatactgagaaggaaaacaaaatccctccgccaggaaggtccacctctgacggatgccgcctccaggccgcacttctccaagagcccgccttttcctctctgcaggcctcgcgcagctcctgcctccccccatgcacgcgcttcgccttcctccctccaagccccgcgcctgcctccctccatggacacactttcccctcctccttgcaggccccgcaaggctcctgcctccctccacgcacgcacttccctttcctccttccaggccccccgcctgcctcctccacgcaccgcaaggctcctgcctccctccctccacgcacacacttccccttcctccctccctctaacacatatccagcaacctccacgtctggttttcctgatggagtaagttactgaggacaaatcattttacaaatgagacaactaagagctagaaatggagagtaattactcagggtactgcacaaatccataggagggaaacacacttttaacctacgggtttcatccagggcttctcaaatgccactgcacttagtttccagagacaccaacagcccggaggggaccagggggatgaactgaggcgtctgtttctgcctcagacacacagttgtcggctggaccaaatgggcttcacctcattccttttggtgtagcctctcccagggccagtaatactgacctgagagttgatggataacttgaaaagtctgttattctggcattgggaagacttccaactcacattgtaaaaacatgaattttattataataaaaagtaaatatcgttcagtgaatatacatgtatatgtataatagatcatatatatttcagatgcgtaacaagtgatttgtagatttcattttatgtgtgtgtgtgtgtgtgtgtgtgtgtgtatgtgtgtgtatttagaggcactttgtaagtgggcaacttatggtcaaagtctgggacttaaaatatcctaaatgaacgttcataattttttttaagggaaatattgatgaagccctgtcgttgaaacaaaaagtttgtaaggataaatcttgcaaaatgatttctttactttctagtagtagtcacagaaacaaagaaacacgtcgcttagaccttattgaagtagctgcgtgggagacacttgattattccaggaaagacacatggcaggatgagagtgtgaaaaatgaacactgagcactacgggaacgtcggatcataacgatgacgaaggaaagggcgaatccctccaatggagtctgctgcatggacagggctcaggacggggaacaggagccttcagggctgaggccgtgcagccactgccaccgctcactgccaggcaggccttgctgggcataccaggaggggcagctgggctgtgtgcccactcagccacttccgggatgggatcctaggccggttaccgacttctccctgccttcatcctttcataaaatagaagcagcaatcatatctgcttcatattaaagaaaggttattgggcagatgttagaacagccaacataaatgtgttaaatgtgcaaaactgagaataacaaccaaataatgtgttaataatcagagagaggttctacaggagaaggtttagctgctgcaatcccctgaagtcgatgtcagacctgagggctgcaaggaggccactgggaacggccccgtcggccgggggcccaggaatcagccctgtgcagagtgcattccgtaatgtgtgcaccttctctacttcagaaaaaaatattctttgaaagatccattttttaaagcctccaacccccttgtgagaaaattggcaactgtgggggcccccgcagcctcaaatttaccagtcctacgggtgtgacttgagagggagtttcctgctggatttcaatgaatggctgcgtatgttggcactggctgcacttggcttcctggacttccttggtcggcattttggaagctttgggtggcactgagattttcaataggagctatttgttataatatgggcttgaccaatattgatctggcttgtagtaaaaagtcagaataaaaagcgtatacagcctagcatgaagtagtcacgatcgtgatttgataaactgtgcagatatcgttggccaaaaacctcaagttactcctgtcaagccctttggttgtgttgcggttgggaggtcacagggtccggttttgatttctagcctttagatcaccgtgtgatgcatctcctctacctgaccggtcccggaggtcaccttccactcactcatcaactgtaagtgagtaaaagtggcgaaaatcatcatggggaagtccaaaacctaaaataaaaaaactggggaaagtttaagtcattcaagtcggaaagcccctgaagaccttttctgctgtctgcaagatttcagaagcaatgggccttgttcaggaggtttgggttcaaggatgcatggatgttctggaggtttgggttcagggatgcatggatgttctggaggtttgggtttgggggtacacggatattctggaggtttgggtttggggggtacatggatattctggaggtttgggtttgggggtacatggatgttctggaggtttgggtttgggggtacatggatgttctggaggtttgggttaagggatgtgtggatgttctggaggtttgggttgcggggtacatggatgttctggaggtttaggttcagggatgcatggaagttctggaggtttgggttcagggatgcatggaagttctggaggtttgggttcagggatgcatggatgttctggaggtttgggttcagggatgcatggatgttctggaggtttgggttcagggatgcatggatgttctggaggtttgggttcggggatgcatgaatgttctggaggtttgggtttgggggtgcatggatgttctggaggtttgggttcagggatgcatggatgttctggaggtttgggttaagggatccgtggatgttctggaggtttgggttggaggtgcatggatgttctggaggtttgggtttgggggtacatggatgttctggaggtttgggtttggggatgcgtggatgttcaggaggtttgggtttgggggtacatggatgttctggaggtttgggttcagggatgcacggaagttctggaggcttgggttggggggtacatggatgttctggaggtttgggttcagggatgcgtgaatgttctggaggtttgggtttgggggttcatggatgttctggaggtttgggttcagggatgcatggatgttctggctgacagcctggagacctagggctagttactcagtctctgagctggtgatgtctcatctgtaacaggtgagataacaagggaggcctttgcagggagtgaagggaagccgtgtctctgatccctgcaggagggcagaggccagcctcagctctgagtggcagctcagaggaaggggctgcagaggtccgcgtgggtcagagttgaatctgctcagacttggagcccagttagatgaagatgtggagtaagggctgcatcccacccacccccgactttggtaagaggctgtgagtcagggcgcgtttctaactcttgacctgagcccctgtgcacaggtgcttctgagtccaggatccatccctgaaggtttgcaggcatattaggacaaaattgccattttgggtcttggcaaatgtgcaatatgaaattaagtgagttaatcggtagttgggaaattattagagaggctcaaagtcccacttctgctgcagaagaaaataagagtccctgttttctcagatctgtccaaaactttctgtgagtgcagctcacagacccaagggcctctagacgcccccacccagaactgctgagtgaatggtcaaggcttccttagatagtcctggcttgtgaaccattgacttgtatagacttagatattttatacattatttaaagttcatgaaggcaccatgtttgaagcatatttagacattgcttttaaagaaaaatagctttaatggtgcacctgagagtgacataagcataaccatattatcttttaaatggaattttcccccttcatttttatttttgagataggatcttgcaatattctccagactggggacctctgggctcaagcaatcctcctacctcggcctctggagtagctgggactacaggcaccaccatgcctggcttccctgtcatttttatctcaattgtttagaagtttaatgggaatgaaagaagagggtcttagaaatatttaggtgattgtttaaaaacttccaaagaccctacttccacggacactcgtattattcattttaattttttttaagatggaaagagtgtttcaaggaagtgaagtgatggtcacaggggaagcatgaagaggatggagagaaggtgggtgaggcccagtgagtgtcagaaactcagacctcatgggtcactgtggagtggagggcccacacatttcttcagcaccaatcctgttttcagggagaccctctatctggggaggagcccccctgacctgcctgttctggaaaacaaggacccttcacacttatcaggcagcttacacatccgcttcaccccagcactaaggagcaaggctcagggcctgaggccatttcatcaacatgcttagtttaatttaaagaataataaaggagcaggcttggagtggaaaacctgcacatgaaggttcagaccaagataactgtttccttccgaaggctcaatttctgtttgtagctgtgtttgtttagtgcctttggaggaattcctcactagagtccttaaactgaagctgccgactcggaccactctatgcttcagcagcaggacttgttttaggcttgcaagatggaaacaggtgcaaaaggtttgtttaaagggagcctcccctaaatgatagaacatgctggtactgggtggggctgggctggtgctgcctggttgggcggaggtgaacatctgcccaggaaggggtgtgcagggctgtcagccacactgaagggggtcccagatgagaggagccctggggaggggcaacaatgggacctcctaggaagaaggcaggagtgtcctagccgggacccaaagccacattcctgccaggtggagctcctcctggcctgctggtgcatcatggatttggagctcaagaaggcggctgtctacctgttgttggattcactttttaccttttagatccacactacagctatgtatttgcataactcagctttggctgtcacagaggggagcagctgtgcccatggctcctgcacctgccctggtcgcaacacacacaggctgaactcggcaaggctgctctgtctctgcagatccaggctctgtcccacctcctgctgagggacagccggcaggccaggcttccctcactctccctaggaagccaggtcagttgctcttttagcatgtattttgtattcagtaaataaggctttatgtcttttcacagatagcagagaacgaccacatggttacaagcatgctttttcctccaattcttccctgtaaacttggattctgacatccaggagacaccaagggaacaaactggataattggaactacaccacaggcctagtggttttaaaggccaatttctgtggcttcaaattccaaaggaatgggtgagtgcagatggcaggggcttggctgaggggtcggtcacccagcaaatgcccagggcaatgccacaggacctcagggtgagtggcctcagggtgagcgacctcagggtgagtgtcctcggggtgagcatcctcagggtgagggacctcggggtgagcgtcctcggggtgagcatcctcagggtgagcgtcttcagggtgaacatcctcggggtgagggacctcggagtgagtgacctcggggtgagcatcctcgggctgagtgtccttggggtgagcgtctgcgcaccttccctttcagcactcaggacagtaacgaacacagggtcacactcaaggtcaccgagaactttggggcatgcaggggggctgcctgggcttgcatctccttctcacctgctggctctctccttttcaagtcgctttttatcctctacaatatcttgaaagctcagagcttgaaaagacttgggggtgctttaccctccctggagtcccttttacgggtctggtatggttagcaagctgccgtagttcacagccaggggcccagttctttttaggagagcacctttgcttgcaggtaactccactgtggagtttgcccgaggtgcagctgggcagtaagtgtggccccttcccttccacatctcggctgttccaacaccgagaagctgctttcgtttctccaccaagccccctctcccgggcacttgtccctcctggaccctgctgcctggggttgtcttgcccaccaggtaagacatgtcctagcacagaggaggagagagtacaggtgcccacgtggctagaggtggtgctggctccctcacgggcattcaggccaatgcccactggatgcagacatgagcgagtgagttctcctgtcctttcccatcagcttccatcagtcacgatttggggcaattctcacaataagaagtgcaggccctgggccccatttccagagaggcagctttaaacagcaaatatggggcagttggtgtttcatctttccgaagataacccagctgtggagagagaaaaggcatcgaggagctgccctctccttcatccttggaggggcgaccacacattccagcagctggggactatcctggcctcattattaatagtgccctctctcacttttccgagtgtcctggtttgggtgataaataatgtgggcaccctatttagaggagatcctgtgccgggcaccacaatagccaaggagtctctatttccctccctgaattgtctcatcagacacatatctttccaagcagagctaattagaattttgcataaatggaattagtaatgagagatttacccttgtgctattattttggcttgaaatctgtcctggaccgaatggctgatttcagtcaaggtgatcgggtgccacttggtgcaactcctgggcccttaaaatctcatttcatgtgacctggctaattgaggtgtttttatgttaatgcctcattatggccatggtgggaagagctccagttacaggatgaagagcactgtcccccaggagcactccggtttccagagtgtacagctgcagactgttctgacacacacgcggcgtctaagccactgtgccacgatctgtcgttgaatgaggagatgttccaacgactggatcgcttgggctcaacacggaaactgagtgcaggggatgcctgctgcctggacgactggaaaagcccgttcctccttagtctgtgggttgtcactcttaacattgctgacattcctttggcacgctgcactttctcccccttagaaatgttcaaaggcaggaagctcccttcccacagactccagtcaacagcaggcccagagcagccttagccacttaacctgccaggcagtgctccagtgccgtggccagcgaccccactcccccaggcctccccagcctgtttgcttggcacccattcccctacatattctttcctgtgtaacccgccactcatacaaactgccctacatattctttcctgtgtaacccgccactcatacaaactgccctacatattctttcctgtgtaatccgccactcatacaaactgccctacctattctttcctgtgtaatccaccactcatacaaactgcttggtgttctggccaattctgaagcattctctcatcatccatactctgttcctgagctcctccttttcctctcctgcttgaaataacctttgggtcctccctcatctgcttccatctttgcccatcaacacccttctccacccacatacatacagggggcagtacagtgtcctccgtaaagactgctgatcgtcttagccagggctggtccccatcacctgccaggactcccgggccatgcacttcccacaggctgcattatctgtgtgtgtgggcgcttttggaagtggagacagagcctagggtattttcccacagtgttctccaccaaagagtcccaagaacagggcatccactgagggactgaaggagcgagtgaagatatttacagctttattagagaaaggctcatctgtcatttattacctcctcccaaatcttcaggacagttttgctttaataattcactgtgagtgtgcttggggaaaatgtctgatgctggcttctggctagaggtaactcaacgtaacaggcatgtttgggtcatgccagaccctggggtgagttttcaggacacacacatacacttgaaaaataaaaactctccttttatagtctacgaaggctgcagcaggggactgaatcctcatcagatcccataataatcttaattgttctggccagaaatgggcaactccgtagtagaacacagtattctcacgccaatagtgacggatgtgtgtctataaacaaggggttagggacccccctggagtcatgacttaaatgggcctgagagaagtgggaagcgtcaggtttgaaggcagcccctggacaggaataatgtaaggacgcagcaacctcatcttaggaatgaagtgtagtcttctcgttacagaagctacctccgcctgcagacacacctccaactcttttttagctgatttattttgctcagggagaaaaagtttaccttgtagtagcaatgaaataatttttatgtccaagccatgcagagcagaatgcatttctctcaaattcatttcctcgaagcagtctattctaaaccagaacacatgtggtatggttcttaatgtcctttttcccaacaacttgtggaagaaagttctcaaagaaaatattgttaggcctgttatgactccatttcttcctgtgacgagaaagtctagaacttaaagaggcaaactaatatagcttaaaaaatattaaaaaaaaaaaccctaaaccaggaattaggccacctagattctggtcctggctctgcaatgaattatccatgtgactctggcaaattgtttggcctcagggtcatggttttcccacctgtaaaatgaggtgatcgcagggcatggtcctgtggtttctaagagctccactattctgcaatcctccagtgagcagagctctcagagaccctgtggctgcacacagggctactgctactctcaagcagcccagtccaacttcacaatggggcctgataacatgcattttacatgcaatcaaataccgtcacccagtgaggcccgggtgtttggtgtggctccctgcgagcaatcctcccagccacagagtcgtaggtgaaagtgcagcacactccgcagagactcaagggtgtgagggtgcatctatgcagggagtgagggcacctgagtgtggacaggtggggcaacagcagggcatggcaaaatgaaattcccgagcttcggtgctgtcagccagaatacaacattctttctttaacagacgcatatttatgtgccatgcagaccctgggtgctggcacaaagagatatttaaaattgctttgaaatctattttcttaaacagaatcacttaacctgactcatgaagggaagagttgcagtcagtcaggtgcaaaaatcatgaatgagagctccacaaagatggaagaacatggaggaataagagagcactgggcgtcgaagacccagaggcctcagcacgaagccagcagctcatccacaagctcagatgcaaaggaaggaccagtgtctgtgcccctcccgggtttcctcccatgcttctgcagagccactgagggtctcgcctagaggaatggcagccagatgatctgccaaatgaagaaagctgcctgggaagccatttgcactttaaggaaaccagtatcccctgaaagtcggtcttagaaaccaaccaaccaagcaaaaatgaccccaaaccagagacccgaaaggaccacgggtattgggtagtctctttgcttcatcccctcggttggccattcttttctgtgcaacctgggattaagccgggttcagggtgtaatttccgaatggcaactgcatctcccactgcagttagcgtcactcaactgcttctcagggttcaaacgcattgtgtcactcacagcctccgttagcaagaccagagagcagaggggtcccccaacaccgtggccaggcgtgtcctgggaaggggttgagaacattacggtgactgtaagaaatttaaattgcacatatttacagaaacagaataatatttaaatcagtatgtaatgcagacggccaggggcagatgggttctcatggcattcagtaccattgtggcaagggctgcagatgagagagtgagaggccgcaaagcccatgaggccaacacctgatacagctctttaaacacagcccgaatgccggcggtaacacagcaccgcggaggtgggctaagaagcacgtggttatcgaacgttgtcattcatcacagcttcatttgcgtggaagcagagatgactatgctgctgcagacaatgttttgtgtgcttttcatgctttacttatgggatagacatgatttctcattcacagaggagaacagtgggatatttgtgtgagttcacatagggagaaacaaatagcgctagcattcctaccgagataggtctgaccccagatgcaattcacttttccgaggatttgggcatctcttggttctaaattaaatcttatttctgagaactttaaaaatgtgcttcataaggaatccaactgacctgattgagcacatttcggggaacatgactctagaaggatgaagcgaggtatggaaagaagaaaaccaaacaaactcacatgaaaaacttcttaatttattcgaaaggcagaagaagtagtgagctcgaaagattttgcagtgatgaaaagttcagaaactcccagtttctgggtgaactccttgaaggctgcaatgcacagggtcaaggggtccgaagcagggagtggagtctgtttgccctcagatccgcttgggtctttgtgcccagaatggatgctggtggagaaacacttggtgtttttgtaccagactcaccaggtaactgtcgccgagtcagagcgggtcatggcaaatgtttagtgggtcagccttacacacagatcttattttgagataccaagatggatagaaaggagagaaaaagacatcatgactgtttctgaagaaattgtagcttggaaatgatagcttggtttggatgagcagagaaacgcaggcaaggaaaagaatcacataagaaggcggtggggctgagtccgaggccggatgtgaggggtggactctgtaaacggagcctccctgagtcagaggagactgcaccgaaaggtgccctctcaaaaggactgtgcaaagggtggctccggtgtgcgtgaaagaccaccgccaaagagccgggatcccacactagtgtggatgcctgtgcgctgtgatcacaatgagacaatgataagaccctcttcagggagtgaagtgcgtttcaaaagcacatcttaacgaatttaaataggagaagcaaactatggagtgatccttcaaagcacagaagaaaactccatctatagactccaaggtgttaagtccaaaataacgttcctctgaaatccatgacagaaaaacagacttctttcttagagaagttttctgagaagatggtggaaaaactaaagacatctttcttagctactaaatgttttcttaatgcattcaaacttccagggcctgtacgaaaacctaaaaacacttttttttcagaactcagagaaacatagaatgtgaagtgtttgttataagattcaaagttaaaactttgtggtgaaaaatgtatttctgtatgcacacacacacatatatattctctatatctggaataacataataatagtccctggaacttttcaaacagaaagaatgaatggggcacttttcttaagatatttctgtctaactggattgtagaaagttctagatttcctttttctcttgtcccttaactaaaggtttatatgtctcaccaaatggcaatagtgttttaaccactttttagccactctgagcccttcattttgattattttgtaaaccccaaactgttgttttatttttaattattaaatggtgctgagacaggtcaggttctggcaaacgggaaaagctgatttcaccaaaagattttgcagtttgaaaagttgcgatggaaatgcttcataaatgggcagcagagcaaacccagaagctcaggaatgcgtgagttctgagtgtgggttcttatccttgtctgtgctcacaggtgggaagtcagagaggacctggaagccaaggatagtgcaagttccgagtgggggcctcatccatgctcatgagtgggtggtcagagtggacccagaagccaaggatagtgtgagttctgagtgtgggttgtcatccttgctcatgggtgggtggggactgtgggatgaggaggagggagaagaccggacaggaccatgtcgagtctggagggccagcagtaatgcagtttaaggaatgaagccagattctctttctatgagcagggcatgtctgccagccagcagcccggggtgcgagctgtgtgagcatgtgtgttggtgagtgcgtgagtgtgtgtgtgagtttgtgtgaatgtgtgcctgtgaggaagatagagacagagaaagaaggacagagacacagcggccacctgaatgagcacaccaagatcaacttgactccctgggtgacaaagtcaatcctcagcaccgagcaacacgaatgactccatacatgcgatttcatgggtacagcttcacctttcccccttcttctctttcctgtgccttgtacctgacacatggaattctaaataacaggcaggtaccgaatccatcacagagtgaaataatatatttgtaaaggtgctgaatccttgggaaaatttagaattttctctggaacaaaattctataaattctcattccctcataaaatggaatgtaagaaataactcaaagccattgttaggtttttgcttactacattaaaatgtggactgacctttctcactttgcatacagcacaaagtcaacagagaaaagggaggcgacgcaggagggactcagatgtttctcagcacgtctttaaagaaatgaagacaccccaagggtcctgcccagacctctcctggctggaatcaaggtcctgatggagatcatcatggaaaatgcagccagcacttgtgccccatggggctgggctgggggaacaaggacttcagccctccagtgggggaggctgagtatgtgcagggcggacgtggctgggtggcctctgcccgggacggatgggctgcaatgtggactctgcctggcttggacactcccacacccactccagtggctcagccttcccggactggcttctgttaatctgtttcccattcttttccttttaaattgaatcaggcctgagaggataaacacttccaagtgaaataaatcttggtatttgagggctattaggcttttcacctgcttcttcaaaaagtctctacaaaaacaaaaacagaaacccatggaggctggttaggggaagcagcactttaatttcagggcggtgctgatagctgggccatcgatctgcaggggcaggggatgggccaaggcctcggcgggggttctctgtggcttgggccggcggttaaatgaaatgaatggctcggtcataaactggttggaatgaatcaattgagtcgaacaaggacaggatcatgtgctgggagagtgagaaccaaataggtttgaaggaagcataccttgaaaactacagctgccgcaagctcttgcaatcaggaaactgatgagcagttaatttgtgtgaaagtaggggaaggtctaatggtggttgcgtgataagaaacaaggctgtggattgctgatggagcccatcaatcttccaggagtagccgaacgttccctcgtcacatgagtaaggaaacgtacgggactgtgaacccgctgggcttccggcacacaattagctgatgccatggtgcaccctggcttgtctctctctgcaagcattattttgctaattaagttgtagacactttaaggtcaaaggctctgtcttagaccgttttatgtggtgggcacaagaataatatgatatcacttatgttaattaaggatactattataagtatcatattaacattaacaaatgtttattgttgatttctctagcaaatgatcattccaaacaataaatatgttgaactttgacacgtgaaagtttcagctaactaattgtgatcaaagtctaaaatgaagaaattacattttttttaacacgttatttgtatcctatggcctacttcccagctgcagtcagcacactgagagcctgagtccctcttgcctcccatgggtcatgacattgccttttttttttttttttttgacaagtctcgctctgtcacccaggctggagtgcagtggcatgatctcctctcattgcaacctctgcctcctgggttcaagcgattctcctgcctcagcctccctagtagctgggattcaggtatgtgccaacacacctagctgatttttgtatttttagcagaaacggagtttcaccatgttgtccaggctggtctcaaactcctgaactcaagtgatccacccacctcagcctcccaaagtgctgggattacagctgtgagccaccacgcccaggcgtgacatttctgtcacagggactccagaggtggcttctcctccctgcctaagtaaaggaagagtttcctgaattgtgagtcatctcgtaaatatggccactatttgcatattcttacacagctatctttgggacttgattggatctcaaagctaacataataataaagctgcgatccaaaattctcagacttaaactttggcaccaccaagacagcctcattattctctttgattgattttataagagattaaagttatgcattagattcaaaaataaatttttaatagtgcaaacgcattaaattatttaaataatcatatttttttctgcaaaaaaaaaaaattgaggacaaggattttcctgccaagagtataaagacccccgggtccaaggctggagacagctcagccgtgaattgtgatgaggattcagggccgggcaggagggggctcaggtgccacaggagtcacacccttgctggccgggggggaaaaccacccaccatgtgcctccactcctttccagattaatgaagcttgaagaggaaaatattaaagttgccagtgcgtatacagtgacagttctaaacggagcagttgaaatgtttgcttgtcacatatgccgttggattcacagcctacttttaaaggctctgagcagatggcactttgcttataatatcatttctcctcaaatatagggtaaaggaatgcctcaaaacacaattattttaagtaaaacaatataaccaaaaagaagccttcgtgttgtcccattgtctgggcagcaggatgtgagggagtcactgtgctgattcgtatttttggacataaacagccagtggggacctggggggttgagtcccagtgaagcctgtgggctcttctgaccaccctgtcccactgtcagcctcacacctcatggtgcactcagcctggctgcacccttggccagggctgggaccccagtgggagctgcagccttgggcatgggtgggcagagttggggacatcctcgttgctgccctgacctcccctgctgttccctgacccggttcatgtgggtcccattccaagctccagaccttgggatgggcagtgaagggctggagaccctgagctgccatattcccccagacaacactcagggatggctccgagggcaggtgcatttctcactgagatctgcaccaatggaaatggaaggtacattggtggcttgaaaacatcactgtggcaggaaagcagcagcccagcggggtccctccccgccccccgcctggccttctgactgtcatgtcacacacactcaacatctcatccaaccccctcctgcaaaaaataaaaagataactgagggtgattgctcattaaacgtaaagggaactcctactgtactggctcagtttgagaggggaatggtgacttacgttagcgctgactcaaccctgaccctgtctcatcactgacatcacaaagcctttttatacaccttcttggtttttctacttctgttacctaagctgagagacagagagctctttccaaacattttaacgtaaaaaagtagtaatgattacaaaccaaaaaacattttcacaaagaatacaattatatatattggaaaataagtcatgttacttcctcagtacattttgcaggtgatcagtgactatctgaggctggtgatgcaggggtaagaagaatttcccaagacaggtgccagcaaagaaaggcagatttgttagagaaagtaggaaaatatgctgcaagaaagcaatgggcagggcagcaagagaggaactggctgccaggagatgaaggcttgctggggattttataggatggtgcttgtgctggagagggaagtactgataatgcccaggttgcagtgagctaacttgcatttttctatcagctgaggcatttgatgagacgttgaattgtttgatgataaattaggcacaggaagattgtaggtgagttacctgcacaggagggctacgtgccctggaccatgaagagaggcagacttagagcttatctgcttcctctgtttcttttccttggtcctgccaacctgacttgttttccctaattaggactccacagtaccccttcacccagacccaagttcaataatgtctgtgtgtccctctctggggttctttacacacataggggcatctgtattcatgcgatatttgaataaacagacatcaccacaataccctcaacaacacttcctagagagcatcccacctcatagacctgcctattgttttgtgtggacataaaatattccattgtgatggtgccctgcagttcacctaacttgatgggtgttcaggctgtccacagcaggcttttgctctcaagaaatactgcaataaacatccttattcaaaatctaatttgctgcctatacgcatatgtgtgcaaatatatgagccatttgctaagatggacttgttgggctagagatacatggatttcagattttgatgatgttagattgctcgccaaataacagtcccctctacagttacgtaggggtctctattttcatctctgagaaatttaaaaaatcgtacaattgatgactccactattaaagaaacaatgatttcagaaagaaagaaatgtggggtttttttgtttttgttttttgtttgtttttgtttgtttttgccaagactgctcaccgaagtctttgctaacatcaataaattgctatgggaagaaaagaaagcattgcacattaaggtgatagctattcttggtcaaaagccactataaaaaagccaagtgaaatgagagattaatttccattgcgaatttgcagctaatgccacagggctgtgcagcttgtttctcagctcgtaggagcacatgctcagctgaagtttaatgatattttcttgcacaagacacagtaccagaaagtattgttttgatacctaattaaatgtgaacaagccgttttggatgttagcaacttatgacatatctgcttccagatattaaatacaagttgtcgtgtgtgggtgtagaattgctgatccaaagcttttgtgttaagaaataaaaactctgcatttggtcagacagggtggtgagtgtggggtcccaagcagagagccgtggagctctgaatacttgtaatgatgcagtgacaggcatcagaattccagaggtgattactcgttgccagtccttctacagtgcaaggggttcttgagggctggtgaaaaataactggaaggagagaaaggcagataggagggaaaggaaggcagcccctgctctcctccttgctccttcctgtccccatgctcagtggagcactgccctgctttgcacaccccacgtcgaggaagcccaaggcctgctgactgcaccccgtggatgtcttccatgatccgatccctctgggccggcccttcctgtcaccccctccccagcctgcatgcacactgtcattcggcttggccgggtctccccgatcctcctccctactcttgcaccttgacagtcctttctccggggaccaccgcgggtctcatcaaaacgcgcatctatccctgtgcccggcagtctgatgacgccaggcaggtttgcccctgcctgcctctcaaccccacgctgtgcccctttccttctgggtgcgggtgacccaacccctctgctattatgggctgaatggtgtccccccaaattcccatgctgaatccctaatccccaggacctcagaagggactgtatttggacataccaccttcaaagaggcaattaagttaaactgaggtggctgaggtggggcttcatccaataggacttgggtcctgataagaagaggagattggggcacagacatgcacagagggatgatcctgtgaggacacagggagaagacaccctctacaagccaaggagagaggcctcaggagaaaccaaccctgatgacattttgaccttggacttccagcctccaggactgtgagaaaatgcatttgcattggttaagctgcctggtctgtggtcttttgttatgacagccccagaaaatgaatacaatggttttttactcctggaactcatttcttgtgtctcagagtctatgtccttcttctctgcacttggacctatgacatccaagcagagactgctggctacaggctaggacacactccatgacatgcacagcacatctcacctgtgatgtttaatgctgactacatgttgaaggggtaacaattgcatctactgtttactgggctaaatagaatgtactgttcacaccaacttcacgtacttttccttttcactgtggctcctagaatcatttcaggccacacatggctccctgtgtgctcactggggctggctcaactgcttgctctggttcgtcccgcaccacctcccaccacatcccactcagagccataatcatccctctgtcttgctcagatattagccctgattccacttctgtcccctccagatagggcagctgttgctgctgcctgatctcagtcacctgtgctctctcagcctccaggtcattactaaatgtgtgtgtgtgtgtgtgtgtgcacgcatgcatgtatctactactggattaatgtccaccattttaaaaaacattaagtttcaaaggaaagtgtgtcttcagcgctcgctgctgtctcctgatgcacagcacagtgcctggcatacctttagggctcaataaacagaattttcttactgaacgggtctgaatcccattgtgtgttcagtagtaaaactgcagtgaacatttctgtcatcaggagcaacagcaagtgtctgaggattagaggttagaattcagagctatcacctaaaagcatcacatggacatttaaaattctcagtagagcattttttccttctaatgaagctttcctaaacctgtgacattggtttaatttgtgcaggagtttcctccttgtatttgtttaaatgcccccagaagctcggaaagcaggaagtggtttgaaggggattcagacaaggttagctggggaggccgtcaccgggagcctgagtccatggagtcatctgttcttgggccacttttagattcagcctttgtggacaagcaggggtttccataggattgagtccactgtcccaaattcagcagggatagtttttgctcaaggcatagaatgttaggaaaaggctggcagactacggagcaggagtgtttcctcattcagtagtgacagccagtgaaggggaggaattggaggtccaatccacctgtcagatgctttatacgttcataattaactggactgctaacaaggcctgtctaaagtaaacaccttctctgcttggctcctgaagggctacaaacattttttttaaaaacaataaatacattaatgaatgaatgaatgccatggataacaaaacagtggactgtcagaataagaacggtcaaaatatgtgctaaggtgcagccaggacagaattgaagtcttttgatctcaaggttctatgttagactattttagttagcatgtttgataagacttgcagagttattcatccacaaacttctgggctcacagagctggctttcataactcctgttcctcatgcagcctctaacctatactggacctccccaccctccaggtgctagtcctgaagcctggagtttttggaagtctcttccctctccagaaggaaggatttgatgtcatcacttatacgtggtggaactcatcagcacccgtgagccaactccctcaggtgtttctaagccttttatctctaattatggaacaaatggctttgtctactgttgaaggctgtgagggctccggggagagtaaaagcctggggtttctgacctgcaaggggccttggcaacaatccctactcagcgcttcattttccacatgaacaatctgagtctggggagattagggcttgtcaaggccgccatgtctagccttgagggcaaaccactaggctgttgtgtgatggtcaatgtgggtaagaagacctggagactgcaaaacaggaccccaagccaccacctggagcgctgtcatcttctcctctctcgtttttgtcatcgtcctcatatagtaaaaggataaaaatataactcaaaataataatctgagatacaaaataaattatttttcctattggatataatttagaattacttcttttcaaaacgacctgtgatattgttttccaaaagaagttaatggcaaactcacagatgataaaattcttataaaggatactgaaattcattcattctttaatatatttgactcttccaaccatggctacaaatgtgtcagcttcaatatagtgatattgccttgtttataatactaacctaagactgtcactgcagaagcaaactagagaaaaggttaaattaaaagaaaaattacttcaaatttctatggtagttatattgaggaaacataagaaaaataatgatttattgaaatttcctttaaataatcaattagggcattgtatagtgtctcttgcagatgggcaggctggtcatacaggaatcctggtccaccccacagggtttcccaaagtgtgtaccacggaacactagttccttggaatggcaggggacattgcacagagaaatgattctttagccaaaaagcctcagtaaaacttaaatctttctctagtaatcgacttcttggagcctttaatattttaatctgatgttatgtatcttgtttgggttttcatcatgtaatttttctggttcttttgattattattagagcagttattattttgttcagatttaattccaaagagtatttctcaaaccatattctgtacggttttactacaagcattctctacacagaaatattgattaagcatcacatcttgctgtgaaattcaaagtttttgaaattcatgcttaaaatagcaaattgtttcatatattaattggagtaatgtgctatttagctaatccattgccttgcaaactgtcaggtagaagacaatctcttctgagggtcactggtgtgtatacaatgtgtatgcctattctataagctggacactgatttttcactcttacttagtcttaattgaacacaaatcagggcttttaaactgtacatgcacgacccacaaccggtggcacttccttccactaacaatgtgtctgagtgaagtgtgtgggaaataaatgcaatggccccattcaggggaatggtggggtctgactcaccttattcttggtcagtccctagaataattaacaatcaacactcaaatcgatcaatcctattgaagagattttgaaatgaaactaaaagtaaggtacatttggacaattagagaaataggacaagcacatttacgttttttcagtccgggttttggaagcagcaggagctggacaggctcagagccgagggagggagggttatggggttaggatgagcagatgtctgggagtggggtcttcatgactcacagcaaaggtgaggcctgtgggtgggaagcagagggggcacctgagccacgtgcatcctggggctccttttcacgtgaagcctctgcatggaaggttacacagctccacgcctgcaccgggagggagaccttgcgactcgccatggttctcaggggcagcgagatgaacagggatgtgtgggtcatgggccccccgtgccagatatgactcctcttgggttttgtgcagcgaggagaatggaagcctgaaaacagcgcatctgttcagcagacggttcactcaccaccagcagcctcagatggtcaggtcacttcttggaacctctgattctgaacccacaaaaacagacaccagctgccctgcatggtgaagtgaggatactcttcttcctggcaagaatgggctctgcagaaccgaccaggcccaccgtgtactttgagaacccccttaccagcggtgcagctcagagcagacagagtgacccccgagcctcagctgttctcagcattaacaggctcacacagcaaggagcagagctcacatcagatgctcagtagtgacggttttcttccttttacctcaagctatccactttaggggtcgttaccattgattcagtcactcatttattcattaagagcttattaaacaatctcatatatagacggtgagagtgctatggagataaagaggcagaggcaaagggcaggagcaaagatccatgtgtaggtctgtgtgtgcatgtatacacagaaacatgcatgtttgtgagagtgtgtgcatgtatacacataaacatgcatgcgagagcgtatgtgcatgtatgcaagaaacatgaatgtgtgtgcatgtatgcaaacatacatgtatgtgagaccatgcatgtgtatgtatacatggaaacatgcatgtgtaggtgtgtctgtgcatacacatgggtgcatgtgtgtatatatgtacatgtgtttgtgagagtgcatgcatgtgtgtgtacatgtgtgcatccatgtacacacacatgcatgaggacacacacatgcatgagggcacacacgtgcagatgtaattgtgaaagtgtgcatatgtgtatgcctgtgtgtgggatgcacatgtgtatgtgagagaatatgtgcatgcatgtgtgtggggtgtgcctgtgtgtatgcctgcgtgtgtatgtgtgcatgcacatatacatgcacacacatgcattgtgtatatgtgcatccatgcatgtctgtgtgcatatatgcacacacatgtccatgtttgcatgtagtatcacacatgtatattgtgtgtatgtgtttgcatgtgtctgtgtatgcacacatgcatatatgtgtcacgtttatatgcctgtgtatatgtgcgtatatgcatgtttgtgtgtgcacatgtgcattgtgtatgtgcctgtttgtgtgtatgcacgtgtgttgtgctttgcgtttatatgtgtgcacgtgtgttttgtgttcatgtgcattgtgtgtgcatgtgtagaggcagtgagtgaggtcgtgacagattttatatggaaatacacacatatttatgtcttttaaaatggtggaaattatatatgatttctcctgtttttttactttggtagtgataatatttatgctttaagcagccttttatttcaacccccattcctaacattgtgattaaaggccctttccaattgctttgtcctctgagggtatgttatcagaggtggtagacatttaggcctggcagctgcatcctgttgaactcccagtgtccagcggacctgcccacctggacaggctgtgcctccgctgagagatgaatgcttctcaggcctgcccagggtctggagcctgggtggtagcctcctcctgtagggcattctgctcaggacctgggacctggggctgaactgcaaagaggctagaggctgtgacaaggtggatgcaggtgacccttggcacttctgaccctgtactcccttccttggtcccagcctccaccagcttctagagcaagtttgtccaacctgcagcctatgggccacatgcagcccatgatggctttgaatgcccaacacaaatttgtaagctttcttaaaacatgatgagattattttgtgattttttttttttagcttattagctatcgttaatgttagtgtattttatgtgtggcccaagacagttcttcttctgatgtggcccagggaagccaaaagattggacacccctgatctaaaggttttcatttctgtttcttctcttgaatccacctccctgctcatctgggtgggggctgctcgggcctctgtgtgcgaacactgctgtgggtctggttatttgcccacccacacacctaaacacacacattccccacagccctgtggcaagagggtcagcctctcttccgaaaggaaaatcaaacaaaatccagggaaactgatgagatttccttgaaagcaacatgttccaggtcttctcccctcttgtcttccttgttgctcagttttcagatgccagcaagtcagtagtgtgaacattgactgaacactgagcgagacagacacagagaacacgtggctcaaacctgccccatcactggaggcatcgatgcacaagacggtgagaagaaacttggtgagaaagaaaaactaggaagacattgagaaagtgagaaaagattcatctacacagatcagcaaaactccaaaagaagccccacagttgatactgaaatgctgtcttctctaatgagaaattggctgctttgtgtgtccatcctgaaccccagacaagggtgggtgggaagagaaaccccacaggctccctctgcatgctcccaggatgtgctgcagtgtgagtccccggcgggctgacggaaaagcccggaaccagttggggcccgtgacctgagcacggtgtattgaagccctgatggaattcttcagtggatcctgtcatcccccaaatgccccgactccctgcaacttctctttcgacttgcttactccgtaaccgtgaattcatccctatttgaaggttcctctcaagaagtacagcaaggcagaagtcaggttactgggctgtgaggagcggttgggaatggatagtttcttatgcagttctctaaacattaaacaataatacgcgactttcacctgtcagaaaaactacacacctttgttagaatgatgggtttccaatggttacatattaataaatcaacatctctacctctcccactgccctctctggcttccctctttagtagttactcacatgctccctgtcccacgtaccaacatgtttaatcagatggtaaagacttaaaactccttttcttttaaaattgtaggtgttgctttttctctttcttatgaacagccttaatcaagttttcccctacactgaagatgccacccattagcaggtgcgggacacggaacattgccacccgtggaatgaggaatagagcttggaggccactctgacctttgagagccaccttcaacaaaggcggtctccacagccactggagggggctctgcgacctccgatgtcatgcacagagcatgggggagagacatacgcttcctcttcctgccttccagacagctgaagatcccctttcttgttggaataacaatatgttgctcatggaagaaaaaattcgaacatcctcatccataattcccagaacatccctgggctgacactgcagctgggtatgagagacgcataggagtaaaaacttgatggaaaaagcaacttctaatgttggaaaaaggcacatctgtgtgttgtgtaaaagggtagttaaaggtggagcagaacattcaaaaatagacttaattgtaataaaaacagtgaaggtagaaagagttgaaggggcaaatgacttttaaaaaatttattattattattttttaaatggcatcttgctctgtcgctcaggctggaatgcaatggcattatcttgggtcactgcaacttctgcctcccaagttcaagcagttctccctgcctcagcctcctgagtagctgggattacaggcacccaccaccaggctgagctaacttttgtatttttagtagagattgggtttcgccatgttggccaggctggtctcaagctcctgacctcaacttatacatccacctcggcctcccgaagtgctgggattacaggcatgagccaccatgcctggctgcaaatgactttttttaaacctcatttggtcaaggctgacactgcagtgattttaagcgttatcaaattaaagatgcatccactgccagctgcagcatactgcaatcccactccacctggagaccaggcgctcaccaatacacgcaatcccactctaccaggagaccaggcgctcgccaatacactcaatcccactccaccgggagaccgggcactcgccaatacacgcaatcccactccaccgggagaccaggtgctcaccagtacacgcaatcccactccaccgggagaccaggcgctcgccaatacacgcaatcccactccaccgggagaccaggcgctcgccaatacactcaatcccactccaccgggagaccgggcactcgccaatacacgcaatcccactccaccgggagaccaggtgctcaccagtacacgcaatcccactccaccgggagaccaggcgctcgccaatacacgcaatcccactccaccgggagaccaggcgctcgccaatacactcaatcccactccaccgggagaccaggcgctcgccaatacactcaatcccactccaccgggagaccaggcgctagtcaatacactcaatcccactccaccgggagaccaggcgctagtcaatacacgcaaacccacttccaccagggagaccggggcactcgccaatacacacaatcccactccaccggggagaccaggcgctcgtcaatacactcaatcccactccaccggggagaccaggcactcaccaatacacgcaatcccactccaccgggagaccaggcgctagtcaatacacgcaatcccactccaccgggagaccagacgctagtcaatacacgcaatcccactccaccaggagaccgggcactcgccaatacacgcaatcccactccaccgggagaccaggcgctagtcaatacacgcaatcccactccaccaggagaccgggcactcgccaacacacacaatcccactccaccgggagaccaggcgctcgtcaatacactcaatcccactccaccgggagaccaggcgctcgccaatacactcaatcccactccaccgggagaccaggcactcgccaacacacacaatcccactccaccaggagaccaggcgctcgccaatacacgcaatcccactccaccaggagaccaggcgctcgccaatacactcaatcccactccaccgggagaccaggcgctagtcaatacacgcaatcccactctaccaggagaccgggcactcgccaacacacacaatcccactccaccgggagaccaggcgctcgccaatacactcaatcccactccaccgggagaccaggcgctagtcaatacacgcaatcccactccaccaggagaccgggcactcgccaacacacacaatcccactccaccgggagaccaggcgctcgtcaatacactcaatcccactccaccgggagaccaggcgctcgccaatacactcaatcccactccaccgggagaccaggcactcgccaacacacacaatcccactccaccgggagaccagacgctagtcaatacacgcaatcccactccaccgggagaccgggcgctcgccaatacatgcaatcccactccaccgggagaccaggcgctagtcaatacacgcaatcccactccaccaggagaccgggcactcgccaacacacacaatcccactccaccgggagaccaggcgctcgtcaatacactcaatcccactccaccgggagaccaggcgctcgccaatacactcaatcccactccaccgggagaccaggcactcgccaacacacacaatcccactccaccaggagaccaggcgctcgccaatacacgcaatcccactccaccgggagaccaggcgctcgccaatacactcaatcccactccaccgggagaccaggcactcgccaacacacacaatcccactccaccaggagaccaggcgctcgccaatacactcaatcccactccaccgggagaccaggcgctagtcaatacacgcaatcccactctaccaggagaccgggcactcgccaatacacacaatcccactccaccgggagaccaggcgctcgtcaatacactcaatcccactccaccgggagaccaggcactcaccaatacacgcaatcccactccaccgggagaccaggcgctagtcaatacacgcaatcccactccaccgggagaccagacgctagtcaatacacgcaatcccactccaccaggagaccgggcactcgccaatacacgcaatcccactccaccgggagaccaggcgctagtcaatacacgcaatcccactccaccaggagaccaggcgctcgccaatacacgcaatcccactccaccgggagaccaggcgctcgccaatacactcaatcccactccaccgggagaccaggcattctcgccaacacacacaatcccactccaccaggagaccaggcgctcgccaatacactcaatcccactccaccaggagaccaggcgctagtcaatacacgcaatcccactctaccaggagaccgggcactcgccaacacacacaatcccactccaccgggagaccaggcgctcgtcaatacactcaatcccactccaccgggagaccaggcactcgccaatacacgcaatcccactccaccgggagaccaggcgctagtcaatacacgcaatcccactccaccgggagaccgggcactcgccaatacacgcaatcccactccacagggagaccaggcgctcaccagtacacgcaatcccactccaccgggagaccaggcgctcgccaatacactcaatcccactccaccgggagaccaggcgctcgtcaatacattccatggtatagaggcgtgtgtatgcttggcttgagggaaatgaagaaagactgtgaaatttaaagaaagacaaagagaaagaagtgggagagagagtcatgctcagagttcacctgctgatgtagaagccctgattggccattccctgaagatgaggtggaggctcctttctgtatgtgaccaggacagagaatgctgcatcccacagggtgaatctaccaatgactgataatggaattgttcatccaccttcaaatgcataaggcaaatatacagacttaagtatgagaacaactcatcattgtagcactctgtataaaagcacaatttttgaattaaactcaattttgacagtagtggataaccataacccattcattagatggaattaccatgcagtcaccatgttttagagacgaccctcaaacccctcttgaatacaaaggctgaggagggaagatgaaggaagagggtgagggtctggggcccttgactcttcctctctcttgaggtctctctgtcccagcacctgggcaggtagggaatcccgaaaatctggggattttcctccatgtccatcactctcttcccttttctctccacctgtcttgattaaaatccagattgtccaagcgatggctgctaatccacaaaagtcacccctctattctcagactcactgaactccagtgaccctgctttgcttgagcactgtaagaccttctgcccccattccccagggtacatgctcctgccggcctctctgggccccacatttgagaatgaatgcctcactggcagtgctctcgctgattttctcccacaagttcagacaagatctcagactggccctcctttagaggaatgtttcaccacatgcgatgatgagtatgggttatttttaaaagcagattgcaatgcaagattcaaggtatgaaccacttgctacagttataagcagtaaagaattagctactgttatcttcagatggtagggactcattttcattgtcttactaacacttttcagtattttcagaagtttctgcaatgaatcttcagtaattgtattatcagaaaaaagacacaaacacaatgaatacagaatgattttgagtgtgggatagcgagttgcatggagaagcagacccgttcactgattcactgcacatgtaagcacgtgctacaccaggggctcatctgagttctccagatacagcaattaaaaggaaaaaaggatgagggcttcagtcctagtggaactgagcattttcatgggtggagggcatgggcataaatagcaagggggtgggggctgcaggttgaaggggcatccagggaacacctgatgaggagggtgacattttagcgtacttctaagggaatagaggatggggcctgtggggacctggaggagtggagctccaccccgaggcacagcaggtgcaaaggcttggagcctggatgctggtgagcagtgaggaggctgaggggtggggggagacttttttaagacaagagaaatagtagtgtgtgtttgagtaggcagggatgatccagcagagaggggagagttgatggtgcaggagacgatgcaagaactggaaagtgaggtatgtggagtcacatctcccttaaaaatagaatggggagattttgcatcaaataggataaaacagattattagctgtttagcataataatcttaaaatgattaattgatgattttgcctgaatcctcagatgaatttttcatcttgcagccttgtgtgctttttaggtaagagaacccaatggtcattgtatctgggagcgtttctttgaaagcaaggtgttttttgaaagtagcatttggccatattaagtccaccaaatcttttgaccactgttcactatacactggctttcaactggattcaccttttgttaaatgcggtcaaccacgggaatgagtgaccttgcgactttcacaggggactcactcctaagaggtggtgttcagccagggggaagacctagcaagccgtgattgattttagtttgtttattggatgctacattagctatctattgctttgtgacaagttacctcaagagttagtatcttaaaagaacaaacactatatctaacttcctgtgggtcaggaatccaggagcagcctcactcttgctgtaagacagcggtcctgtccccaacctttctggcaccagggatggctggttttgtggaagacaatttttccatggactgggggctgcagggatggtttcaggatgattcaagcacattatatttattgtgcactttatttctattaatattacattgtaatatataatgaaataattatataactcagcataatgtagaatcagtgggagtcctgagcttgttttcctgcaactcgatggccccacctggggatgatgggagacagtgacagatcatcaggcattagattttcataaggagtctgcaacctggatcccttacaagcacagttagcaataggatccccactcctataggaatctaatgccactgtgacctgacagaaggcagagctcagacataatgtgagtggcagagagtggctgtaaatatagatgaagccttgctcactaacctcctgctgtgcagcccagctcctaacaggtcctggaccagtaccagtccttggcccgggggctggagacgtctgagttaaagcatctaactctggggttttgtgaggggtacatataaagtggtttggaatcatgtgggattattgatattattacaaagaataaatctgatagggtctcagagagcctggaagcacagaatgataaaaaagctagtgtgggtcaagatgttaaaggggcagggagtattgagaacggtgagcttgcatatgccagcctgagcctccactctctcactgaggagcccagcagtttatcatttgagcaggaaaagggtgcaggggagaccatgagggcgtgggcaccacccagccatgagtctcagaggcaataaccccatgagcacagacccacaggcaaagccctgggagaagtcctttcaaagcttttcaatatgtgtgaaaaaaattgcagctgaaatcccataatttcattaaaaaaataaagaaacaaatgtaggttgatttttaaaattatttaattaaagtggcatttcttcacattttccaaacctctgtagcctcagaatggcttagaccctaaagtcctcttgatctaatgacgaaaccactttgacactttgaggacacaggtggatgggccaaggcggctgtgcttggcagggttgcaggggctgcattctacatggtgcctctgcccactctatgccggttttgtggctggggagggtagtgtggtctggaagagtggccggtatgatggacaaggcagctgacgtggatggcaccaggggtcctgggggaccggagaggacggactgggtcacttgatcacagtgtcaccggagccccagggcagcagcaggaggagaggcggcagatggggtgagaagggctgcaaggccaggtaggttctcaggatgttaggcaggcagctgagcgggggttaatgaacagaatgcaatggagattgtttacagacagttttgtagagaacaagcttaatctgaaaatttcagacataactgtcctgaaatgcagggtgcggcaattaaggtgaagcaatctatttattcccatcattcaccatcagatgattttactgtctccacctaaagctgttcttacaaagaagcgtgtgaggcctctcaatattgtgctgctctgagggttccagggatagctgccgtccgcctctgtggataatgactcacagggacaatgagaggtatacttgggaagttatttgaatttggagatcaaattttgctttgattgattttttttttctcttaagtattgcttccctagctattctaggatcagaaagtgacaaaacacttcacggtgaattacagtggtttaatgccttattttaaatttatgtttaccattttatcttcttgttttttgttctttagctgaggttctagtacacatgaatgctttaccagccattagctgtgattagtggagctgcagtgaatgacggtaatgtgagcagcatcaaatgttgacttgcttttatcagagagcagagaatgtacagaatcagctgtgtgctcaaattcactttgctaaaacgctagtgttttcgctccctaccctggaagcataggtgatgctttttctctcctgagtagagcttgactagggtcaaggccatacttatcgacatggctgaccatgtttcttgcctttcagaagcagaacattccatgcatgaaaaatggtgagaaatgggtacaaagagaactggggaataggaacagcttgggagtagaagaggtgagcacccctaggcttcaaaaatctcctctcctttgctgtttttcctgtgggctggcctttgtcccagaagccagaaggccagccacaggtatttacatattcaggcaacacattttgtgctgcagtgatttcttcttctcaaggcaacaaatccaaatggtgttccaggagagtattttcggtaccttttgattcctccaagtatttttatttcaaaggaaaacagtcctacttttcaacaaacagagggcctggcgctggactagaatctgcaggatgatgttgctttctgcagtaattgagaatcagaagcctggtttctcaggtatttttatcttctgcctgtgtgtgaagtcaaaaatcttactccattaaataaacacacattgacgtgctaatcagaaagacaacactggccttataacaggaggagactgatggggaacaaaagaatcacaccctccactgaggacaacctctccagggacaccagagtggtgaacggcaggaagtggggtttttgttgggcaggaagtagggtttcattgggcaggaagtgggattttctttgggcaaagggtttccccggggcctcctgacatggcttcatgcgttcctctcttcaggtacccggtccagagtgaagagggagatacaccccacagaaaaagtttaggatttttatttcatcaaatggatatcaaaattatttcgatcacaacaaacattgtttccagaaaatatgcccttttcccctggattcctttacaggtgcttccttcacgcggtgtcccggattcctgcaccggcgcacagctcagcaccgcggccccgatctgcccaggacctgcccataggcgcctcctttcactgatgccacctcagatccacctcgtcagaggaggcagagggaagactccgaaggaggaatagaggggtgtgtcccacggggcttcaaatcctcatgcaccccgttttccagaattttctgtgaacgtttgtctgccccagtgagagctcatcttaatcttgatttgtagcgtctttggccagtggtcttctcacaagcaggcattttctccacattgtcttttgaatccggtttcctaatgtagcctttgagacgtcctgatgcggaaaattaatcttgttacttgatgaagatggtgtttgaaaatcgatcccgtggcctggtctgttaggtggagagtggttcctgtgcagaactgtgcctcacctgaggacgggcagactcgggctgtctggagagtgtgggttaaccactatacagggatgccttcctgggcttggttcggcacagttagacttctccaaatgtatacatttcatctcctttctttataaactagacatttggctcagaagactgtgaagatgaagcttggttaaagctgtttcctgcaggcagcacagaattcagacctttgtctgattggtcctctgcttgttgggggaccagcccggtccacacacagcagagtcagcactggtcagtgggagaggttgcagggggctctaaaaagagtttctggcctccattttttctcatcatgaaaaatactgtattcagagttgttaacattctacaatgtgttaaagcctaagacccaggtcccttcaggaaaatgacacggtagcttgtgctcacatgagggtggaaatgacaggtatgcaatgctggaaggcagaggcaagccgcagctctgtctggggctctgctccgtgcgggctgccttctgtcccttggggttccagtttctccatagcagagattctagtttaactcgtatcttttgatgcctgttcaaagtggaagattataggaactcaggggagttttctatgttgcaggagaggtgagaagatcaaaggggatgaagaaaagggaccctgggctcccaacgccagggtgcctacctgcagtttaaccagggcagaccccacaccaagccttggtctgagaagcccaatctgctcctcaaaggaaagaatgcatttacttgggaaaatctgccctgactaaatatgtattaattttcaatggaaagggaagtatgaatatgtttgcctccttcctggtcagaatctttcagccagggtctgtgctggcagacaacaagacacaaggccctttagtcaagacgccaatcaagaatttgcaggaaaagctacaagaagaagaatgttcaaggagaggcatgggctttgggggcagccggggtcctgggagacattcaggttcaagtcctagttttgctaaattcaatatcattttagggcaagattttccttttctgtaaaatgggaatagtagcatctccctcctggggtcacagtgaggatttgacgaggatgtacacacagaagcacttggcacacaccacgtcaccatcacatatgaaatcctttttccttctttctacagtcactgcagaatccatcctccagcctgcaagccacacctgtgaacatgcaacccttgctgtatgtgagcagagggctgagggcatgggtggaaatccataggagaggactgtggtggtggacgcaagacacacctgaggtaaggaaaggaggaggccacgcagggaacattttaaatatggagggaggaggggaggtcacgtcgggtcctgagaaaccttctcagcctccatgctgaccccattgatctaaactaagaatgactgtttcataggtatttcctgctctagtgctgaatgagtctctctatggaagtcgctaagtggagacctacttatgttgccttttataataaagctagtacagtgtttgtgctaagtctcttaaggggatggtttagactttctgcaaattgctacaatgtacacagctaattaataacacaagttccctctgatgagggggaaagtatttcttgcctaaagagggatgttgtttagtcttgtaaaactgtagttatgtcttctctacgtcctgccaagcatgtcttcataaaaattagaaagaatccatctgttttcttgccacagactctaatttctttgtgaatcttatttggatttgaattccaatgagcaagcagcaaggtttgtgcaatgtttgttagctgctgactatgatgtggaagccgggctttcttttccatttttccttttcatattgtctttactttggagagacttttgatctgaaggaagctgaattatgtgtcattagaaagagtgaccctaagcacaggtggtgacttgagcttccaaggggggaacattctgaaagtatcttcaaagagtgctagtgggagagttccaatgatgcttcccatgctttctctctgtatagatgaccccatgcctagctcttcttacaggaagcccttggcacgtcaacacacccctctccttcccttacctcaaccagacaactaccttagcagctcagctgtgttattgagacatttcagcatgaaatttgtttttcctcactgaactttaagcagaatttcaagtgccaagtctctaaagccaagtggggctattaagagataattactaattatgctaatttgagaagttgctgctatttccttcctggtcattttatgtgcagctctcctgagagcacagtcccctcgcagggctaataaccttctctgcaaagtgctcagtcgaggacggtttgtcctaaacttccacgcctcaaaaccgggaaggttcacagttgagcggaaagggtggctttaggggagtctatgtcctcattgttaatgatttatactagttattacagcttctcacaggccagcagtagctattcctttatactcagcccagaagagtatatttaatttctaacctggctgtggtttccccctcatcatctctgagtcttaataatggatcccaagcattggaactgtcctcagggccctgcagcactaaatcagaggctggggccttgtgtgacattgataattaccatcctttctccaaaaaagttactatttaggagaaatataatggataagcaaaagcaattgccgaaactccctgggtttgagttgatcctgccactgggacacatgcacccagaagataagctggagggataaggatgagatgcctgggaatccagcctgcacttgggtgctgggggcaccttcccctccttcccactgtccttgccacttattcacggcactcacagggcaggggatagatgaggctggctggtaaatctggtgtgctgatcagtttatctgggttcacaccacactaccatcagcgtggactgcagagaggcacgaggaatgccgttgggcacctgactgtgagctcccgcagactctcaggctcttgcagcctctcagctttcacaccatgctcctaccttcagcttcgtctttactggccagaaagaccaccctggggcttcaccttcactccttgtctcatttctcagcttgttcaggccagtgtgaggaggaggacagctttgatacctccacagatgcttcccaggcctgtccggtggtcctgcagggtcaaatgtaaccaacctagaggatctaatttttggcccaaccccctgtgctctgcatttccatgtttgaaagttagttcttgcaaactctcagggcaccatcagccagtgacgtgtgttactctgaggcctggcccaccccgagcttgccaggccccaaaataggctcacaatggccagggacacgggtacctaacctcagcatcatctgggatgccaggcagccccatctggaagctcagggctggatctcaggtgttagtccttcctgtttggccagtggggagctgacttacacttaaaacatgagaagctgagaacaaactcaaggtctcctatctgtgagaacaaactcaaggtctcctgtctgtgagaacgaactcaaggtctcctatctggaggggaacccgctggacacccggtgccatgctgaggtcacagctctgaaggacgcacctgggaaactcctacccctggcggagaccagcatggatcctaggaacaccaccatagctgatgggagcactgagaatgttgataattggcactgattttgttcttctgctctttgatatagaacatagtctcatagaggattccttactaaggtgttttcctccacttgacaaagaagaaaacgtgagaataacaagagagctggagacctttagagctgatttccagctgtgtgatctgaggcaattcctcatttctcaggaacacagttgtgtcttgtatgatagcttccaacaaataggagttacaggcattgccaaagctctcgaggctaaagatttatttctctttcccatgaaaataagtaatgaaagagtttccctcctgcccaggctcttatagatttacatgcacagcttcctcctttataaggactaggataagaagaggctctgacatttccaggctattccaggttctagtagaattctcatagctgcctagaatttcatacaactctgaaccatgctatcaagccccccaaagcatcctgataagaaattaaaacctagacaaattctctgggtagcttattcatttaatgttagatggatgttgactttggattttccagccttctccaaatgctcataattttagttactcaaaatacacccagtaaaaatacatttacaaattataaatttgtaagatgtattaagaaaatacaacagttgataatgttcgaagctgtatttaaaacagatattctcaaattcgtgcaggaaacttcctccaggacaaagacctcagtgacaatgactattttctttttatgactcaatatttgcttatctcctgacacacagtaattgctcaaaacacgttttatacaacctagcctagcagaaatgcaacagtttattatgtaaaaattaatattttttgaaagatttcacacagctctagcaggcaaaaattacctggtttcatggcctcagttttatacaaaggtaagaagttatgaggtgtattgcagaatatactgcttttttttttctttgcgtgccttctgcatgaggagaggctgtgtggaagcacagggggcaggcacactgtgtgttctcaaagctggactggctgtggtctgtgggaagcaacccgggaggattgggaaagccccccttatcctacccagaaagctcttccagttactgaaaccaccattactttttttttttttgaaacggagtctccctctgtcccccagggaaggagggcactgggcgggatctcggttcactgcaagctctgcctcccgggttcacgccattctcctgcctcagcctcccgagtagctgggactacaggctcccaccacgacgcccaactaatttttttgtatttttagtagagacagggtttcaccgtgttagtcaggatggtcttaatctcctgacctcatgatctgcctgtcttggcctcccaaagtgctgggattacaggcgtgagccacagcacccggccaccaccattactttcactgcattggtcaaaaatgatttttcctactaacacgaagctccttagtcccgacagcagggttttcatcagtcatgtgtacttccctgtgaaatagtctatcaaatcatttccacttgtcaactagctgacatcagattttaatagtggccagtttgagaaaaaaagcatagttgttaggagtcaggcgatggaggctgcagacatggggcgcctggagggtaccgctcacacctgggtgccggcgaggggaccgcacatacctggggaggtgtgggtgatgggaggcgaaggcagaacctgcaaagtcccattcagttgatctgtttcaagaaagcttaagtggatcctacagcgcttgggatgaaattctctcttccccggaccggcatccaaccaccttaccacagaactgtctcgccatgtggagagttagagaagaacattagaacattaatccgggcagtgctgctcccagcatattacagtaggatgggcagggggcgaagcttggtgaaggaggtgggaaaggagcccagtgcactcttgataaatacaaacagagctgccatggctccgtgggtgtaaatggccacagcaggacggtgctgcaagactttctcacgtgggttccagggggttcaaagagcattggcaaagccacaatactcttctatttggtcaaaaagcaatgggaagagagtgtagtgaacctcagcacctgggctgcagaagcctgttaaacaagcgccatggccagaattcctcctgctgcagtacctggatacctccatgggtgaagtgccatgctccggtcccgtggggaacatggaaagatcaaagtcacccttgacactttaaagcaaattgtcaatgtattgcatgtcctcacttccttgaggacacagagagcgccaagttggaggactccggttacagacgtacataaaatgatatctgccatacaagcatgggccagggtcagatgcctggggacccagtggtctactgaacgtgcttcctggagctctgagggcaaagcttagttccttgttttgcataaagagactctgtgtgtgatttcacttaaaagatatttcattgcttcaaaaaacatttgatgggaaaacgtgtctagaaaatttcagaggaaggtactctttggactggattggtactaaaaccaaccaaacaaaaaccaatggacatttcagcagtttctatttaaaaattgacgccaggatttgaaatattacagtcagtgttccacatgaattttgcactgggtggaggaaggttggacgatttagattgcgttcgcagctgtcattgtgaagcacctccgtaaacgacgtgtgagtgtcgctatctagaaccggcatgaggaccaaacggaatttaggcaccatgtattttttaaggctaattgccaatctctctttcatttattaaaaaccaaagctaaaataattcacttactgagcatgtctaatctgcatgaagcctttacttcattggtcaaagctgcctctaggcacgcatctgaaccagccaacgcccatttaatgcctttttgaatctgtgcacactttcagaatgtggaaacagtcttctctgtattcagcctgaagtggtaaaagctacgcctgggtcctaactcccttcttatgtttcttatttaagtaactttacttgtctttcattcttttagatacataccctcctcccacagaaggcaggaagatcaatacctgcctttgcagacctgacacatccgtgcccatctgaaccttagaaagtggctccacgaagcctgtgagggctttcatttacccaggggtgtattttatagctgattctcactggacagcccattggaaccagctactcaaaagccagatgcttcagtgaagccttaacaaggggctattttttaaaattattatactttaagttttagggtacatgtgcacaacgtgcaggtttgttacatacgtatacatgtgccatgttggtgtgctgcacccattaactggtcatttagcattaggtatatctcctaatgctatccctcccccctccccccaccccacaacagtccccggtgtgtgatgttcccaacaaggggcttttatcatcatcatagccaattagtgatatctgctctcattctttcctaagtcaaataacctaattcttttctctctgtggtgtgacatcctggtttggttgcttttattagaaagcaagaagtctctaaatcattctgtttccctttttgccttgactgccaggaagcccagcatttcattcgatgctcagttgcaatagtcttattatccccagatttttccagtctacgtggaagtgtatttccattggcagaactttatctatgccttttatggcaatcctgtgaaattctttttggaaataagtagggtttgaaaatgaaataaaagtcactaagtgtgtttttaatatttgttttttactgtacaaatagattttgattgagaaactttcaaggttgtttaatattaaatgtgatttaaaaaaattgtagatgaaaattgacccccaaatctaggaaatgtaggaaagcttaagtatcctgaagcagaaacccagccagtggttccacatctgcttctcaccagtgtttcctcatctggccttcttctatcatcttacaaaggtcctgagaagaaaatcatatgctagttcttattttcaagcagttgaaactaaacccattaattttatgcaaaaaaacaaaaacaaaaacaggtattagaagtacacagagcactcctggagcgaccagctggtgccgctgaggaagccaggaggctccggaaggttccagagctgccttgcagcacagttaggcaatggcctccaacaccgctgctcacccctctgcctcagtggctggcgcaagctctgcacacccttccgaacagcagcagggctgcagggaatgctgcctgcaggtggtgctgtgcacacttctcgcccgactgctaacttggtgcaccctgttcattccacaactcacgcccagctgctgtatgcacactcccctcccgcccgctgagtcagtgtgccctgcgcgttccatcacgactcatgcacacctcctgtgcacactcctctcccgattgctaactgggtgcaccgtgcgcgttccacaatgactcatgcacacctgctgtgcatactcctcgcccgactgcttactcagttctccctgtacattccatcacgactcatgcacacctgctgagctccaaaaacacactgggcagcctctgtaactgccccaggcagaaagatgctttagactctgaagagccagaaaatgataaacatttgtccaatacagctggagacagtcaggaagaaggtgtgaaagatctaaaaagagcatgatccttggaaagacaatagacatttcagacaaagtaaaaattgtagattacttggtagacagctccattatgaagcagccagtgaaagttcttgatattgtgaattaatcatttgagcatttcctaattttattgcattgattgctaatattaagtgaggcattaatgtatcattccctccaaaacagttgtttaaagttgagataagtttagaaaacatggcatgtgtctcttttccttgggggttctcaatgtgcgttacctctaagaagtcttacagcaaaacaacctgatacatttatataaagcaaaataccccaaactttaaaaaataaatatatattacatgaaagttgatttggaaattttactttactccattacacagttgaagtggcatgccatggatgctttggcagatttaggattctgagatctctgagtatatatcccttatgactatcaaggagctatactgtagagaagatctacaagaaaaaagtctacaaaataaccgtaaagtttacatataccttgaataacaataaaccacatgcaggccttttgaattcactgggattggaagggctaaaggcactcctaaaattcctagagagcattagagagcatgcttcattgcacacattcatgttattctgatcacgttattctgatcacattattctgatcacaagttattctgatcacatgttattctgatcacatgttattctgatcacgtgtttcacaaccaagatgggaagcggctcctctgtctctgcttgggtttgtagtgtgcttttttttttttttttttttgctttttgtttttaaatctctgagctcttcccatttgcagacacagattggcccatgtatttctcaaagcaattttggggcagaaacattgtccagggccctgtgtatttggttgcacagggatctgagtcggggaagccctggggaccccagggcagctgggcctgtgtcagtgacaagtccatcctgacagagccgcaggtctgaacctccctctgcacccactcctcagacgggtcctcactctcagaccctgcgcgagaagggactccagtctctttctttcttttcttttctgttcttttctttcttccttcctttcctttctttctttctctctctctttcctttctttccttccttcctttcctttttccttccttcgtttttctttccttccttctttctttcttctttttttgagacagtctcgttctgtcaccaagtctggagtgcaatggcatgatctcagcccactgcaacctcctcctcccgggttcaggagattctcccgccccagactcccgagtagctgggactacaagcacacaccaccacgctggactaacttttgtatttttagtagagatggggtttcgtcatgtaggctaggctggtcttgaactcttgacctcaagtgatccacctgcctgggcctcccaaagtgctgggattataggtgtgagcccccacacccagacaccagtctttcaatatgtatggctaagggtggcttgcaagctgattttgggtggcatatgaaaaacttttaaacatgtattaaatgccatcttatattttaatgggaattagaacactataatgcaggcacatcaaactcacaagcctatgaataatatagttagaaaaatgctaaggaagaaaggaagggagggaaggagggagggaggaggaggaaaccaagaggcacaaacacagcagcaacagaaagtcgctgtttccatcatgctgagaaaacctaacacacatcataggaaggtgatggccggggcagaaactgaaaatatggaattcaaataactacaactgggggaaacttatatttggtcgtacttttttgattctggagcttagctcttcccactctccatgttccttgcctgtgacttggaggaatcatccagaacgtggtcccacccacatgcatggacggtcaggcttctgctggtagggaggctgcttcctcccagtgttcttgggcacctgtggccccactgccctgggaacacggtggggaatgaacatgctagcccccagggctgacccgaaatgtcacccttgcccttttgtgtgtgtgcatgcctccgtgtgagtccacaatcgagtctctctgcaaatgctgggctgtcctgtacctcctgccccgcctccatgtctgagcattgcccctgtgggaggaatgagacagggagcggcgtttagagattgcagctggcaacacggctctgagcatccctaaagcaggggccagggtcttcacggctgctttacctaggggggcagcacgacccagttgacaggcagaggccaggcccccaggttgtgtttctgactctgccctcccaggagggggctccaggctctggcttccagctcccaggcaggttcttgtggctgggactgtccctgagcctctcggcaagatgagagactttgcctttccatctcaattgattgtgaattaaggaactttggaaatttacctcgattgtagtggtcagattttcctatttttcttagctgtataatctgcctaaaagtttatctttaccttctttttgttgttgttgttgttgttttttgagacggctggagtgcagtggcgtgatgtcagctcgctgcaacctctgcctcccaggttcaagcaattctcccacctcagcctcccaagtagtagctgggattacaggtgtgtgttaccatacctggctagtttttgtattttcagtagaaacagggtttcaccatgttggccaggctggtcttgaactcctgacctcaggtgattggctcacctcagcctcccaaagtgctgggattacaggtgtgaaccaccatgcctggcccacctttaccttctacaatgcccagggcactacagtctcacacactcctctattctcttgctctccaaattgggatcccatcattttacaccactgattcttctctcatgaagtgcaacatttcaaatctttggatttcagaaaaaacaatgccttctaaattgaatatatgatatctatagaataaactaatttgttccctagctccattgaatcagaagcattttatacagtggccttttgataaaaaattgctaaaagaaacaaaaccaaaaattggcaaatgggacctaattaaactaaagagcttctgcgcagcaaaagaagccatcaacagagcaacagacaacctacggattgggagaaaatatttgcaaaccatgtatctgacaaaggttcagaatctataaggaacctaaataaatcaacaagcaaaaaacaaacaaccctattaaaaaatgggcaaaggacatgatcaaacacgttctctaaagaagacaaacatgcgatccacaagcatgtgaaaaacattgaacgtgactaatcattagagaaatgcaaatcaaaatcaccatgcaataccatctcataccagtcagaatggctatgacaaaaagtcagaaggtatcagatgctggcaaagctatggaaaaaagagaatgcttatacactgttagtgggaatgtaaattagctcagccaacttttccaaagacctaaaacagaactaccattcaacccagcagtcacattcctgggggtatacccaccccccaccaaataaattgttctgcttaaaagacacatgcacttatatgttcatcgcagcactattcacaatagcaaaggcatggaatcaatctagtgcctattgatggtggattggataaagaaaatgaggtccacatacactgtggaatataatgcagccatgaaaaagaataaaatcatgttctttgcagcaacatggatgcagctagaggctgttaccctgagaaaattaacagaggaatagaaaaccaaataccacatgttctcacttataagtgggaggtaaacactgagtattcatggacacaggtatgggaacaacacacactgggaacactagaagggtccggagaagaacaaggattgaaaaactgccaggtactatgctcactccctggctgagaagatcctataccaaacctcagcgacacccaatttattcagggaagaaactcacacatgttaactgaatctgaaataaaagttgagtatcccctgaatctaaaataaaagtggaaaaaaataggttaacttgtagatggcaaaaaaaattgccaaaagagaaatctaggggcagtctttatttgaatatttagcagagtaatcggtattgtctcatggatgatggggtgaaatgggacattatttctactttggcccacactgcaggagcatgcgggggcctctgggcccctggacacgtggaaaccctgtggcaaaacatttggaggagcaggaagctcactcaaggcaaatttgggggcagcaactaatatcatatggaaaaagaagaggagctggtataaaagacgtttattaacgtgtgtgcccgatgtcctggcgccactggctcgctgcagtgcttctgtctggaaggttttcagaaagcaaaggcacccacctcctctccctgcacaaagccgctttgaatgtgcatcttcccactgctcggatgaagatgatttcaaaaatgggaattcaattgtggaactttatgaggaagaatacagttaacataactgaaaacaaggccagcactcgcttgaaggaaatgcaggaagagattaatttgacaaacctgcatctccagctcaagtttggccttcctctgcttgaggggatgtcagcagaaagaagggccctggccccagcagagaagttaattcatcatcatcaaaattatgtaaataattcaagtcactttttaaaaataaagctataaagagaagaatacaaaccaaaatattgcaagaggtgacattttgctgtatgtgttcagataagaccaaacgaatgttgacgttgacataaaataattcagaaagaacaagtatcaaacacagactttaaaagtaccaccttactgtcagcgtgttttctatattttcccaagtagctttcacctagtgggattctatttatactgaattaggtgggcttgctgtgtgcatacacatcacagggagtgcaaagacacacacacgctggacacattagtgttaggtacacagattgcaagtgatttctgttggaagtcaattgggactttgcacaggaaggtattttacacataaagaattttatgcattattgcaacggcagcaaagctcacaaaagcccatttaagccaaatgtacagagggccttgtgtggcctcagtgtcacatacaatattatctcaatgatgtgtctgttctggactgagctctggatctcagggacacagcatttgtgctttcatctaccctcagccttggcctcatcccagcccttggtcagtgctcctggggtccacaggactgactggagaggggtccagagaaatcgtctccatctgcccccttgtcgaagttcagcggcatgagagcacccctcattcctggtgatcagagattgatacttactggctcattgctaataaaatgccaccaagaatcggggatttgtttactatatttaaaggtttaaaatgtttaactatcagaagtcctacctgtgagtgtttatgtaaaacgactttataagtaagattgggaacagatgggaagagctattttagtcagttggtgtgtcatgaaattgtgtagactctatttcactgtaaacccttcgttacactgtgggggtgctacaacgttacaacatgttttcttgggagggtcgcacttatttaacctttaaattgacatttggggcactggtcacttagagtgagttcaaatgtcctggctattattgtgcatgcagatttatttctgtaatctacttttcattcactgacttactgaggttaaaatagaacatgcacatttacctgtggcttcaattccactttgttttaccagcactgactctgaatcagttaatctaagaagtgacttcttgtttatgcaggcaagtggatgaaagtatcctctacacaaacacacaggggcacacaagggaacgcagtaggtcctcattgtaaatctacatgcccggtaacccaaagcatgagtatcaacctgataagcacactttgtaattttcaaatttagttccgggttttatcgaatgaataatgtgctgtatttcattccgtttcttggtagcacatcaacttcctattttttctattcttctcttgggaaatagaatgaaaaattccctcacccctcgtcttaattcattgcattccttaaagatttttaccttgtgctgtgattaataattattttggaattcaatgtacttattatatagatatctgaaaaatgaagacgtttgcctatctgaatctagttcaacgacctctgcagtttcctttaaccctcaaatcaaaaacgtgtattacttaagcaagcaaaagcacagtggagtgtgcctatacatacgtgtatatttacccatattcatatacatgtgtacacacacacatacacgcacacacaggtgtgcacatacacactaaggtgtcctatattcatattcatgtgtacacatgcacatacacacacatgcacacacaggtgtggacaacacatgtcactaaggtgtgagctgggctgcacgctattcagtatctccctggaaacgggagcgcatgccccttctcagaaggcccttgtgtgtcatggtcctatgatgtagcttttacggccactgctaacacactgtttctgagacttctgttttaacagcaacatggaagagcttccagcagtgtcttttctaagtggcgattcgctctacattgcccagagaacatctgctcctgagttttgtgctcctgtcctctggggacctgagctctccccgtggcctttctgaacccacctgttcaatcctgctccagggccttggtcccttcttaagcaaagaacagccggtggggccggagggaccaggctctgattcaggcttgctctcaccatctcgctttcttcggtagccacttgcattctttgggcctcacttccctcatccaggagatagagacacagtttagttgatggtgtcttaggtcctttttacctccccataagagagttatgaagcagaccttatcaaacctgggaaaagaactgtcagcgagaagtgagaacggtccgcttgccacctgcacaggggacagcagcccttcttagaatcaccacggttctctccatctttaatgagaaatgggcaccttccaaagggccaggaagggagaaatcaaaaggtggaatgaaataaaactacttaccttctaaccaccctgttagagggcaccacgtggcaaagacatcaaggggaacctaatcagaggttagttcaattccaaaagtatttctcaccctggagacgtgatggttttctagcagtgatgctacagggatgaaggtgggatttatgaattttctggcccttattgaggtagagataatgtttctgggaaaagggcactgataccctaaccgtaagctttagttttcagaaaatgtttccgaaggtgaatttctgtggttttctctctgtcatgggctgaatggtgttcccccaaaattcatgcatttaagtcctgacctgtggtgcctcacagtgtgaccatatttgaagatggggtctttaaagaggtgcgcaaggtaaaatgaagctgaaaacatacagctgaaaagcgtgcagccaagattaaaagcacatgcatgtgcctgtgtgtcctcaggactggggctttttctgctgctggcttttcagctgcacccatctctgcatctggcccatacagaaccatgaggtgcacaattcttgcctggctaattattctaactgtaaagagctgttatctgtgtcctggtggtgtcgaaggacactctcacaggatcaggtgaaagcactcttctccctgagaggtcagggcacatagcctgcctggtttatcttcgttcccaagggacagatgcaccaagcccccaaaagcatctccatcagagccagtcccccaaaccccagcagcctcggaggctccttgtgtgcgcagcagcaggagggcctgcctgtcatcctgggtccccgacagaaagtgatgatgctcctcatttccatggccagggtcccactgtgctctctgcctcagtgagccacagcctggtggggtcctggaagagcttcaggtcccatagagcaataaaagaagaaccagaggaaagaataaattggtctggaagttccatattcaaaatgggggaccctagccacgtctaccctttgtgggagagaggatgtaacctagggtgggggccacagaactttaataagcaggggtgtcgtagggagaatgtggacagccacaatgcctgatgaggggccacaggtacttgctctaacctctccacgccaacgctgtaaaatgaagacaataaatgtcactgccttgtagtgttgttgggaggattaaatgaggcaatgcacatgaagctgttaggacaggataagggctcagtaaatattagttattaatctttagttcctattgcctaagggccaaacggacaatcagttaaacagacgcactgcactgattcacacctgactgagcgcatggaccctgcagagaaggaaagtcccaaccagatgaacctgccaggacatgtcctccctgcatcgtgctaacctcaggggccgcgttaacgtgctgtaaaatagatacatccaatctcatgaatttttagtgaatatattttgcctggaatgtgagtaaaggggcacgtccctgactcctgaaccggagtggtctcgcgatgtcacatggctgtggcacacacgcggttctatttatttcttctccatcatgggtaggggggcctctttctgacatgagcccagactagaatgtcattccttcttgcaaaaatacatcagaataaatcacatgtcaccgcttcagagtcacatgaaaaacactcgcaagtgagtcctgcagcccagaggaagagacgcccaggactctgcggtgggggaagaccccctccccgcgccgggaagagacgtccaggaccctgaagcagggaaagccccccaccacccagaagagacgcccaggaccccacagcgggggaattacccacccacccggggcaacacccgagagagcagggagcaaagacattcacttccaggacagaaggccacgctgccgcactcgtatccgaagtttgaatgtcctcagccgcagatgcgttttttgttatgagtgacaagaacgctgacacaagacactaacctttctagaggtgcgggtgaagctatcctgggaaacactaaggaatcagctcatcccgaaccgaaggaaggtgagaagtcccagggagagaggcatgaaggccatttcttcagccacactggactacggataaaatgttttcatagtcaagagtacaggggctaaccccagaattctactgtgtttatcagtgattacgcataaatatgtacaaacagtatacagcattcaatctgttgactgatttccattttagcaactcgcatttttagtttccctgatgttcaagttttgaggtattactaaatactattacgggtaaggatctctgcccaactgctgcagccaatattcctgtggccaaaaatgagcagagcctaggcaagtagcacatatgacagaattttatttattctctacagtgcggttgggtgtagcctctacatatgtctcctgcttacttagtgtgtatgagagaaaaggaacagacgatagattgtttagattctaggtgatagatgacagatcagtaaggtagatggtagatagttggatgatgggtgattgatatgattccaaagttatctaataagataagaccaagagacatgctgtctacatagaaacaagggaccattcactctcggtgactgtcgccttttccgttccctatccgatatccacagtattgagtggacgtggtgctgccagcaccttctgtgactctatggatgactctgtaaatcgtgtgagacagatgagtgtgtatcctgcttcacatgaccgacctccaggcaaagagatgccgtccttggtcacgaacgaggccatgctctgttgagagtcagagtcctcggtttccccagctgcctggatttttcatgagataggcaggcagcacttgccctgagctgcaagaagccagagggtcctgggccctgggcagtgcctggctctccgtagatggggagctggggacctgcttgcaggtgagggagactggagagcagctgtgcattcaggagggaggagtgtggggaggagtgtgtgcatcccagtgagacctcaggggctcacgctggaagcacagcagaggggccagggagagggcccggggaaggacagcgagggcgcccatcttcaacagagaccacggagaaggcaaaccacattcagacttgctctctggcgtttttagaacatgttctagagcttctgttcctgcttaatctctaccatgtagcacagtgactgacaacgaaaggtgttcagtaaatgtttgctgaatggacagactccaatttacataactgtggcttaaaaataaacccgacagggcgctttgtaaatgtacaatgtaaatctgataataaattctacaacaagcatgtattcgtggtatgcggcgagacaatctctatgctggtttctgggagcccagagatgtggattttggcccccattcttgagaaatcccaacaaaggaggaagcaccaccagcacccacacctgcggggagccccgcagagcaaaaccaaggaagatgtcttctctgctcgtctcgtcaccccaaaggtggtcatggaagccacctccaaaccctactccacgctgagtgctgccctgtgtaaaagacgacagctcagcccatctctccacagcctcccccgaaaatgttcccctctcccagagagttccgattatttaagaaattcttattacaaaaacgcaatcagttttctcagtgggttttaattgagtagctattatgttttgatattgtagaaagaatagaaatgttcaaacttaaaggggtttacattttaacggtttagttttacaaagaactttcatttgatataataaaggaaatacaatagaaatctatttttgtaagcccatctgatgataatttatatatatatatagtgttgagatcacggaaggttatttttgttccctgttcggatttcatgtgtgtgcctctgtatctccataaacaatagaagctcaggaggaagggccgcgtccactccttttgctcatgtcattgtgatgcctcactctttgcctgtctcacggtaggcactggagatagatttacacatgaataaataaataaataagactcatgcccaatacagtttttgtctaaagacacatataatgtttaaggcaaaattgcaaacagagcagaattggatagcacgcaccatactttaaaatcaagtgttctttctgtattggtagccacataaagcaaaatgcaagaaagatgaactttaatcaggcacaggaagagacttggaagttattctttgtctctctttccattaaaatcccttccttcacaccaatgtggttgttgtttctcttttatgatgtaagaagatagattttttttattagtggcaatgacaaaaagatttatttcagttggtgtaaaatatgcacaaagggagactttaaacaatgatgttttgcaatttttacaattaagcaattagtgtttctctccatactctaaaacacagtcacaaaccaacattctttttcattgcctcccaaagaatttgtgctctcagaggtttagtgaagatttctttctctacatgatttttgtaatgtttatattagactgctgctgttctagagctggggagtcttttaatatttcaactttctctatttgaataaacgcttttgtgctttacctcttgagtctgtcatccctctacgtcgtgtgcatatattagacatctgcacaaacacacaagtgcacatgttaacggcatgccttctattcattacccacatacaagagcccctgtcatgatttaacttccctgaagcaaaaatttgattaaaaactcaggtgattacataaaattatatgaactctcacatttgttatacttaaaaacaaagaaccttaacttcctaaatggctaataaatatttccctgcaggtcagtcagtgctgaatatatacccatctttagttcctgagagtgaaacagtataaggatgttggaataatgctttgctacacatcaaagctattatacttctagaggcaacagcttttgctctcagttcagtatcactcagggctgtcaaagtttctacattcctcatgctactgtcttggagttttttcaaaagctactgcttatcctagtacttttcctagaactccaacaatgatgtttatctcaaaattatttcttcttcagaaaaaattggcatagaattctgagaattttcaaaatttctccttgagccatgtattttggattgaaaactctgttagaattctttgagagcctggatagtcctttaaaaaggttatctgtagtagtaacatttagaattgaagcatgaataaaatatctttgtgtctgtggttaaattaggctacctatgtttttctttacctaaggaatagtaaaaggtattgttttttaataaaacaaatcatttgtagatccccaaatttataaaaacaatgtcctttttaattgtacacatcagatagtgtctgagcttgtatatactttacatttctgtcctcagtcctgaacacagtctaacacaaagagggcaggtacttccttaaagaatgtggctattttcacagctataagcccaatgcaagcacagcatctgctccagacagggatgagtgaacccagccagacttggggtttggaggaggtcagaatctattctactgatgtttctgtcatgtttattaaattgcatttttttcccaaatgcaattacacttttaggaaatattgcaattattttaaagagaggacatttttatacttccggtggacttaaactaataaaacctgctttttgtttaatcattatcagcgccctaggtatatgctttgagctctcctgctatgggtctcaagtcctgcttcttagcaacagtaaggaccctctactcgtttgtttttagccataagaagagatttgacttgggttagcattttcaggtaggaggaggctccagtttctgagaactgagctccccatcctattttaataccacctttgagaagacgtatttgagaaatcacatcagacattagggaaatgatgaggcagagcttctgtctgtcggcagtgggaaacaagaatcaaagacttcatctcaaataaatggagcagcacagattaattaaatcgataaattctccaaagcacatcctggttaaggggtttaaaggaattctttccattatgtgcaaatcacctgaaggtgttgagctatcatttgggcataagattcactccatctattagaggccctagagaagtgggtttacaaatagattctgagcaatgttcattttatttatgatccaaatggcaaaacaacagccacagagagaaacctggatctgttttgcaaatgagtgatctgttgctggcaccgttaaaaagacgtgcagtgatgaacgtggccagatttgagttagagatccgtaggagtgagacggtacttaacaccaaaaataataactgccccctttcacctttgcatccccactgctgggtttctctttctgatccgtgggagattttgcttgtacacagtgtggccctcttccgcgtgaggcttcagctggtgtgaccatttgcatcagaactgaattagctgtttagttacacaaacacgagggtcctagttgccctctgccttggaagcagctcaacgaagccacctgaatgccacaattttaagtgtacacagctgaaaaaactttcaaaaatttcacctcttagagagttgaaataaatttccttaaaatctaagtcacctgagcatttatatcatctttctcttcgaacttaagcacacatgttactcttctttttttataggaatgcatgatttattggacactatttcttaagtataaaatcccctccttaatataaatatggaatttagatgatctgttctgctatgttttcagattaaaaaactgaacgttaactattgatcatttttgtaatttaaaacagatgatactaaattccaatatatatgtattttataacccaaagaggacttaccagacattttcctgccagaaactagatactaactgtattcattcaccatcaataaaataatacaatgtaattattttgctgctcttcctactcaatacctatgactagaataaaaggtgattaaatatccacagtgcatatggagggcctgggaaattcagattaactctttatttccaaatatagatcgttcttcagaaaagtctgctatctttgcaaatgaccaaattttaggggctggagggagattgtggatctcttgaaaagcaaacatgtcagtttctaagttgctaatatttggatgtggtttccgggaaaatggattcactcataaacttgcagatggagattcagggcctacgagccctgtttgctagggcgttgcttaaacaatgtcaggcaagcaatcagataaaatagccccgtcctccattccttttaaatcaaataaacgagtaaataaaagcccaattttaattgctgaacagggatgtcttgatactaagacagtaacatatgcaagcagagaggagttctggctccaaggtcctaaatttctcaatgttcccttcccttcctgttttctaaagtctcaccagagcacgttagctgtccctgtgaaccaaaaattttataagcattgtttcttctctttttgaatgtaatgtctctatttgatattggtatgttcttaattgagttatatcaaaagctaggaataaacaatcgcctttgaaaaatcaagtattaagcagcctctgtttctctgagtggagaaaaaacttttaattgtacagatagaggttaatttagtttcattctatttgcaaatacttaacaacacgaatcaggttctcggccacacaccaggcagagtgcagcccctgctgcttttcttgagctatcctaaccacagagacggcatcaacacacagtagtttgaatattctgtgaagggcagccaggcttttcatagttcacttggcattcattcacctttattcgtatattcggtttcaaaatggcaataagcacttataaagtcttgcttacaatgtggaaaattatccttttagaaatcttgtgagctagtaattaagaaccaaatttaaaactgcaatatctgttttgatataatatttttaaatgatgagaaacagagtattacaataattttggttttaggagttgttcaaaattgttcatattgcaaaaatactgacattcattttctactattttggaaaaagaagtagggggtataaaaattgctcaaatgtttcagctgcttttaccgtgtatatacatatacatacatacatagtaatatacatgtatatatataatatgtatgtgtgtatatatatcatactatacagatgtatagttttaaaattgaacattaaatgcttttagggcataagttatcttttcatgcctcaaaaaaaaaaaaaaaatttccttttctatgtttccttacgtaatgcgcttctgagatggttcttctgcaggaaccgagtcacccctgtttagatatggatacacgaatcccatatttttattctacattcaaactcgcacgtcatatctaatgcccttgaagcaatctccaattactgttattacatgggtcactagaaaccagaggcactgatacaaaatttttaaaaagagaaagggggaaaaaaagcaccacacaattaggtgctggttaacggttgaatcaatttgattttatcagtaaatccagcccttcctcttgagctgtcagtgagcgagataagcggaggatgtggggctccggccggcggtgcaggactgtgtccctggccagccagggtgacaccggcggggacgactgtagcattgcaggggctgcggagcccacggccgctctgccctcatcctcagcacaatctttctatttcattaatttttcatggattttcatttcacagcaagccggcgtctgccatccatctgctcgacttattttgttccttttgccaactttttatttgcatttcacaacattcagcaacctgcccgttctccacaccttcccatgagtcatggctttacttttatagagctacctcgtgctcaaaatgtattttcaagtttctaaaactctgtataaccaaccactctagaacaatacctaaatttcaagataacttattttgctgtcaaatgcctcaaagaggtgtcctgtgccaaagctcaaatgcaacccgaccggccccggatgattgcggatcctgcatggccagtcacccctgaagccccttcccctttccactctgtgaagattgacacgccgcttctaaaaccccagcctccaatgtaccttgtggaatcagctgattttggattggccctcaatctatttccaaatatgtttgccttgaaacagcctttttcaaagaaaaattctggaaacttcagtcattttacacattgtacacagtaatgggtagaagattaaaaatatttcatttgcaaaatgcctttcatgccaatgcatagcttcttttagaaaaaaaaatacattcacaaaagagagaaaaacagatagacaaagcagaatatatgcactgttttaataactaaaaacatttaagaaattcctcatacatactaccctgaagttattccagggttcagagaattattggcatattttaaagtgatttatttttatatactctactgttttgttgagttctgcctcttaatctacctggttgaacggatattaacaaaaaaaaccctttttctttattattttttggttaaagtgtatccttttttaatacgtacacattgagctattttctaatacaggcagatattactctatataaccacataatatggattttgttgtacataattaccaagaactataaaataaagtgcaatctcctggtactgtgtgagaaatgaactccaggggtatttagtgatggcaggtaacagtctccataacctccaagtgctactattttccgaacgcctctgagtgaggcaggcgcgggacacactgacgtgtctggcatgtgtcatgggatatgaacgttgctttgccgcgatgtaaaaatgagagagattttccctgtccttctcatagttttttttttttcagcagcttgtttttctcttatatgagagtcaaattttggcatttttcatttacataaaaaatttaaaccatttatgaataatttctaaaagaaagtccctgctgaaaaataacacagaaaacacaaaattgtacaacactaggtcccagtaaaataacagaagtaggattgatgtgtggggagacatattctgagaaccttctttaaagtttatttgagagagaaatacaggttcctgccaaataatacctgaaagtcatattctgtgacgaaggtgttttttttttttttttttttaaagatacatacagctgcctttgtggcatagtaactaaaatataacttctacagaaaaaaatatcatttccaagactatggattatacttaatgaaagtattgtgtcctgaccacccttcagtggtagccccggcatgctttatttcagagctcacagatcattttgataagaagcatatcatgccaaagtcactctcagagtcacacatagaaaaggagccagatgtcaccacactgggaaattaaagttatcatgcatcttcaaaaatgattcttgtcccttagactaggtagaaatacgcatctgacaggcaacagggtcagcatgtatcttaattgtctttattcccccataagaacagcccttaccttgtgcttctgtcagtgtcttcagttagcacctaatagagccacactaaattccttaacagtctctcatacacacgtggattttaaattgtggcaagtatagagttttaatatcagataagcttaaaattgaggttattctattcatttatggttgttaagattcatgacaattagaacataatttaaactcaccattgtttttataaaataaaaaatatcagcatctgtaataactaggtatcatagatgaagtaatcaattcccaggaaaatgcaaataattatttaatgtgtctcttagctggttactttaccttttaatttgatcagttacatctacatggttaacgtttccccaaaaattgaatctttagccgtttgatttgactttcctatcaagatagctgccggcaggtgccctgggaaattctcccgcacgccagaaatctcttcgtaacagaaatcagtgtacaaaacctgaatgccctttcccgcttcaatttttggctatgaaaattaagggacttgacatattcaaaataaccaaggtatggaaatatttgctataggagttttattttgaattgctaaagttaagtttatagcaaatgaagtctttccccagatttcctttttccccctaaattgaatactttctaagctagcatgactgacgcttcctggcaaggcaagtgaatttggagaaaggcaacactttcctcctgtttatatttataaaatgcattattgcgaactattactccacattcttcaactctaaatatttaaatagactaatcaaaaaatattgggaaatgtgaacatttcaagtgtaaagatgatgcttcctttttcctcttttaaaagtcatattcattattcaatccggtgactttctcaatatcaatgccactttgtgttggcattatctttggaggacactaacaggtctgtttcaaaatgataatttcaaacaacaaagtgaatcgcaagcgcacacttagcagctgagaggtaaatgagaaccacaacatcacctcccttctgaaaccaaaggctccaaaaccttttgaggaagttgtgggggccaatccctcccagtggtcctgacgttcggtcataatgaatgactgtttgctattgacatttatgcctgctgactgtctggataatttctattattggaagaggcaataaaggacctggtgacggttcgagggcacacaggaaacggtctggtagaaacttatcttaggccaatgcaaagatgaaaattcttcaggaaagatggacaaccccaaacacacctaacgttgcctcctgctttcaaacaactggcaaagctgatcaattctagctgtgtttttccaaccgttctttatacttctacctcacttaaaaaaaatcagcacatttcaaatcatgattagaactgaactttctcctgcaggctcactaggaactgacaataacacaggttcctctaggagagaagggtcggcatgagaagaatcttttaattcttcctggcatgcacacaggctacgatggcactgggggcattgctctcatattggagcgattgctaattttgcaaaatccccagtgtgaaagccctcccttgctgtagcattgactaacttcagcgcggcccagccccaggaatatcagtaacaaggcacagctgagtttgtcagtggccgctgtcagccggctgcttttcctgctttcctggtttgcggtttttttctaccactaacaaaatatgatgcttctttctgttttcctgtattcatttctgcttatttctccaaggacgagccctgtgttctctttacgacccaatgtttacaaatcgacgggcaccacattgagtaaaaactgccagccaatttggagaggcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggccgcttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaagacacagggacgggtttttccaaccaacagtttttaactagtcaattcattaccatgctccttgtgtcaagggggggaaatacctctttcagaaatgcagagaccgcacttcctcagaaacggactgaggtttgcaattccccaggagacagcgtcctgaggggcatttattcctcagagcctgcatgcttgtctgtttgcctcttctttcccctcttcatattccttggccgtttccaatgcaaaagataaatcttgcataaagacagaggttttgggatctgagtctgatttttgccgtcaggaatttcatgtgttgctttatttagggaacaatgacacaaaaggaagagaaagctctcagcggagagttttgttgccaaatgtaatatttggatggaagaaagtaacatttacaaagaggtggattgcacactgaaatagttttaagcaatttttttttccaggaatgtcctatgtttcaagattatacttatggaaccctggaagtcttatgtaaaatataaagaggaatagaatctggtaatcatcattgcatcttgtatttaaatcacataagcttttaattacaatagtcatgtttttaaaaaaatccactctaaaattcattagcacacattaacatgttgatataaaaatggcacacaaatatttctgctattcattgcctcacatgcaaccttttcagctgcttatgtgcctagaaatttccagataatttttatcataagaaaaaagaatcactctgggggacattggaaataattaggatgatcctgtgttgttatgtgctgagctgatagatcgtagctcagttttcattgatgagagagagtaagacatttgatttcaaatcttaactctactgctatgacctcgggtaagttaaaccgtgcctcagtttcctcatctgtaaactggggataacaacgtcacccacctcataagttcattcatactcgttgaatcagtatcaaccagtatagacaggaactggaacatgttaattactctatgattatttattaaattttttccagcaaataatttggaaggaatgagcgtatgttgcagacaagcctcagaaagacagggcttctgcgttttccttttagaatgttgaaccttctagtccaactcagactgaggaccacaatcaaaccaacatccctcttcagggctggcttcaacaaccctgttcccatgacagcacagctcagctctgctgataattcccagcgagggttgagaaggcacatagctctctcacttcctctctgcaatacccgagatatttgagtgcttaaactatatcgagaaacacagctctaggactctgcctgtgaaacttctgagcttcacacaatgtgctgcactaatccagagttgccctatttctgtatctgcagaaaacccatcagggggtggagtcaccgaaggaaggtgcttcagaagagcttcacacacacacacagcccccacaaggtggtcagcatttattaatggccccaatagctccatcatcacacggagcaaccgtgctgtctgggagactcgtatacatgaacccttgtttcactccaagggcaggtatggtggccggaaagtaacgtgtctgttaaatgttcttctgatgttggtggagtggggaaacaaaactgaaaactgtctttgaacacttcatttagaccctaatttgaaagttacgatcgaaattttggcaaacctttttcttgaagttcctccaattggttcttttttgtataatttatgaaaatgctgttttcacagatacttgctgttttctgtattttatttattttgcataagacgatgcataatagatgatgctagggcgacggctaggcgagaaagcctttgtttctcatcacagaggggctttaaagaagaggctcgcagcgacaagtgcgttaactccagcgtggtttccagcacgtctcactctgctgttgcaagcagggctgcgagtgagcagtgctggtaagctgccattccccgatgagcctcctcacctcctgcctgtttcccacagtgcctcagcgcagctttgcaacgtggtgggatgagcagcagttggaagaggcttcaggagcaggagccaatctcgcccggtgcccatcaggagatgtcgctgtggtgtccccagctacttcatgctcagtccctgctcttcccacaaaacaaagcaccagcagagaggttgcaaggaggaacaggcagctacaaagccaactgcagcccggcatgaacctataggggtcggggggagacgggtgaggcatagaaaggagcccttggctggatagaaggggcagtgctgcctccgcagtgagtccccacacccaaatggcatgtgtgtgccaggaggaagagttttctcaatcaaggccagaaagggtcctcttgttggagttgcttaaagctcccccaactcactgttgctctcatcagtcctacaatgttacaggtctcctgtgtgatattttgcttgtttcttcaatgtctgtctctccatagatcacaagcaccacaggaggcaaaaccacgtctctctgtggctttgcggctgtgcgggcactgacctgggacacaagtgtccttgcagggcagaggctgatatttaccactggggcagtgcttgctctgctcaaggtatggttctgagcttaaatgttatagtgactctcagttaatgcacaagacctcgatggcggcaggactgaaacaatattcatttcagaggctcagacaacttaggtaacttgctagaagtcacacgggttactagtcaggattcacattcagcacatcctaacttcacagtctggggttgttaccactacgccctgctggtattttatcctgcagcctgaaattggtagattttgtgaacttctacaagccttcttgagataagcaaaaaatacattaaatagtgactcaaagcttcagtaagcctatgtgtgtgcataatatacacacatataaacatatcagaatttttctttcctcagaatgaacatacaatgtggacagaaagaccttatcatcctcatttttcccctgaggttacgaaggtgaagtgtgaggtctggattcgtgtcatgttgccagatagcagcagagccatgacccgaatgtaaggttccaatacattcccgaaataacagccatgagaaatttcatagattcacataactgccctgatcttttatttctgcaaaagagagacctaaggcatccttcctgcggctgaccacacagcttgcatcttttaacccatattcagatcatcttgtgcccactcccgaatgttttcctctcaactccttgacctgtctgaagacatggacaactattctttgcttcaaagtcctgatggtcaatactgacttacaatacttcagttcttaatgcattgcaatgtctttccagatagttaaagggttggctgacttgatttcttattggtttcccgaaacaaataacactgacaaacaaacatggtttctttagaatcagaattctagttaatatccccttccctccatcagacaatttcactaggtggaaaatagcagaataaaggattctctggagatatttgtgtttgctgactcactttatcatcacatatgacacacaattatgactttttacaagaaatagcacaaggggacttttttactctttcatcttcagccgttgctcttaagtctaaataacacacatcaaagaacttgggcatgagacctgaaagtatttccaaataatattgtgcaatatacctgctatgccacatgcacgtgtattcacattctcttcaaagggcatggaaggaggctggtgaaggggagggggcagcagagaagtcccaggatgcagaggagcatcttgaatatgaaatgctctttatcctacacttttaccagagtagtttttccctttgttcattctttttcttggaggcatgcttatggtttgagaacagcaaatgcacacttagcaatttcctgaatgaacttggtgtaaagcaggcgggtggatcacctgaggtcaggagttcgagaccatcctggccaacatggtgaaaccccgtcactcctaaaaatacaaaaattagcgaggtgtggtggtgcacacctgtagtctcagctactggggaggctgaggcatgagaatcacttgaacccaggaggcagacattgcagagagccaagattgcaccactgcactccagcctgggtgacagagtgagactccatctcaaaaaaataataaaaaataaaataaaataaaaagacagtgcttggaaaatacaagtgaaaaaaaaatcctacatgcataatcacaagaacagactccaaattctgcttctgttggtgctatgggtctaacacattggggaagacataaccctttctgaacatcatctgtaaaaggagggaaaatgatggcacagaactgctatgaagataaagaaaaaggatgcaaatttctttgtgaatgatcctgaaatgccaaggtcacgtaagatgtttatgtgtcttcttttaacacagttgattttaatcacgaatgtacctgtgcccaggtgaaagcactgaaaatcaagatcgtctttaagatcaagggaactcagggatggaggcttccaccccacaagcccaggagactcccaggcccatttattatgcagcgcaggtgacctcaagtaatcaatctttcctcagggctaattgtaacagctgattccatttcttcctgaaggtccaggtcgtttgtgagatggctctaccagctgcagggagaatgtgctgatcagttgttttatgatatccgtggcctttggatagagtaaagtatggtattttactactaaatatttgtgcaggatatgagaaataatggcctgaaataatcctcttcaatattctagataggttcaattacttacatttacattgacaatgcccttggttgctagtttctgaaatgggaaaccttaatattttatggaatcataaaaattaccattatttaaagctacattaatgcatggcctaccctcggtgtttctttgtgtcttaaacgagtatggttcaaagagttatttttttcacactttccaaatcttctctttgaaccagtgattttcaaaacgaacgatgtcatatccccagagcactgtgtgacagcaggaagagaggaggaaaacaaaacacagatggaattaatggtttggggtgttaatcaatgtaataaattgaaaggaaaggatgaaagcttgtcgagaatacatttctgttatttaaactagggtaggctgatgtaatgaatttatttcaattttccactctgatgtttaaagtctaaacacttcatttcctcctccggcttcctcctttctctcgatatctgaggcgcaggtggtgcccatctgtgagactccaattcttcattttccggctctctccctggtcttggccttcggggaccacatgcagaggcctgagtggacggctgcttgtcacgtggttttgatgcttgaactggcatctccggccattgatagcattaatttaaaaaccctagattttaattccgtacatttggttccagcagggagaggaagagcaagggaaactcttattgggttccaagcaaggatgaagcctggggagctgggcagccttgggtttctgcttccccgagaccccagcctgactgggatccaggtgagggtcactgagaagtccccgatgcaggccctgccacctgtctcatttttttgagtcaacaaatgagtaaaatggacaatcgcagaggggatgtgtggctaccctgagggtcaaaaccacgtaatattatcccttaacagaatgagcgtgggcttcatgaaaggtaactgctcacacgagcagaaaatgttgctgaactagaatggatgtgtgcaaacagcaggtgatgaaggacctcactttgctactattgtatccactcggtactcaaaggctggccagacagccaaatcccccaaaacgcagtgacatcctcttattcctcaaaatcctgggtccatgcagaacagcccttgctctgagggcaaataaatattaggagagaaaccctgtcccactcatgtctgtgaaaaacagcagcaccttctgccacaattgcgaaagaaataaggaacctgaacaggaggcagaggaaggggtccctccaggacagtggccgagagcagagtccatcagctgtgttcccagggtggatggcaaagcggaggcacccctgcagccatggcagataagttcacggggtcttgctcctggcggggaggaaaagagggaaatgaaattcatccatgtctccttcccgcgaagctgctcttctcagcctcacccaagcaattttggtcataattctgggttttcatcttgataattgtcctagagacattggggttccactaacattttctgaaaatgaagccagttttccacttccatgcttcctttttcatatttccagtgctcagaaaaattatttatacggccatccatgacttcgaaaccctgtccctggggaaagctcccactgatgagctccaaccctggcctggcctgtgccaggggaagcattacttcctccagacattttggtgaagattaaaccagttaacacttgtaagagttatcggaacagtggaaatctgtgagtgcaggtacaggaaaataactcgagccagctgttgtcttgcagagcacccttcatgtccgcaggcagcagacgggctcgtgcccttcagccccaggaagggtcccagcaccgcggtcgttgcccagagggcagagccgctggactcccagttttggccctaccagccacatgggctgtggcttcacgtccccgatctgcagaaggcaccgggttgttatgtggttgaagaatgtcagcatttgtgaggctcagaacactgctgggcacacagagtgctgtgcagatatttgttatatcatggcagaaaaataaaaaaaatgcagggaactcacgccattgctttagacagcagtgttgagggtctattttcacacctggagtgcaccttgggaatgtattatacatgtgcctgtgggtgggttttctccttatactgtctaactacagatattaactaaatggacatattttattttgttagattttacactgggatggggtggggctttagagaatacaactaactttcttagtgcaggtctctattttcatagatctttggttcaccacaaaatattgttaaaatatatttgggaaaagtcatgggagagaccattgcagtctttgaagaagaaagaatgcagaaagatggagactaaaacacattccaagagaaatgaataagtacaaggaaaacatgaagcaggtggaataggagagtgggtccctctgagccgtgcacgcaggggtgtgtagacactgaccacagggagggagtgggtttggagccaagcagacctcagcccaagcttagttgagtcacctgttacctacatgacagctgtgctgtcctcatctgtggggtgtccacataaatattcatctcacggtgttgtgaggatcaggcgaggttgcttatgtgaaatgccatgttcccaggcactcacaaacatcagtagagtgtcactgatagcctgtcggactgggacattggtttccctgcaatacttaggttaatatgatcactgcacacagcagtttccacactgatgcttcaaagctttgctggaatccaactgtctgaggtggcatcccagagtcatggcaccgaggcgtccatgaagcctggagcagcctggctgtgggtgaaagggacgcagggctgtggaaagtcaccttggttttcctcctggtcctccacagctgccaacacatcagagggagatccgatttccaggacagtggcagtgatccatgtagattgcagttccagtgcaatcaatggatgtgacacatggtcagtgctggacctagtggaggtggggctgtgagagcactcagatggcagtgcagggcatggcggggcagcagtgtgtgggtgcctgggaaggtgggagtgtgagagctcacaggtaatggtgggaggcatggcagggcagcagtgtgctgggtgggtgcctgtgaaggtggggctgtgtgagtgctcacagatggcagtggagggcatggcagggcagcagtgtgtttgtgtctgtgtagcctctggggcaggtctgtgctgttgttctccataattgctggtggcagtggagcccgctgggcgcggagggcaagcatgcagcctgcatctgctctgcactgcaatctgttctgggtgtcaccagctgacccacagtgtcagtgaccacctcctggcggatctgacagccctgaagacactcctcctcttggccgggagtccagaggctggtcattaaagcaataattaatcccaggctctcctacaaaacgatgggaagggaaaaatcactttgggctgttattaaaatgttttcaatttctttcgtatccaggaaacagtttctgataaataaaggaaatatgctaatatgatctttcttttaaaaaagggaaaattgaaagatgccgtttgaaaaaatctaatcttatatctgcaacctacatgtacaataatatttcagtaattttagtgttggactttaataattttgatgtgtaagttttcatgatttgtatcatttgtacatgtatttcaattttcttaaaagaatattttctagctgggcactttgggaggctgaggcaggaggattgctagagcccaggagtcaagacaaccccaggcaacatagtgaaaccccacctctacaagaaatgaaaaaaaaaattaggtgggcctggtggtacaaacttgtagtcccagcttctcaggaagctaaggcaggaggatcacttgagcccaggaggtccaggtcaagtgtcacatgaatcacgtgacatgtatgcgagtgtcacatgaatcgcctgacgtgtacacgagtgtcacatgaatcacctgacgtgtacgcaagtgtcacatgaatcgcgtgacgtgtatgcgagtgtcacatgaatcgcctgatgtgtacgtgtcacatggattgcgtgacatgaacgtgactgtcacatggatcgcctgatgtgtatgtgtcacatggattgcgtgacgtgtatgcgagtgtcacatggatcgcgtgatgtgtatgcgagtgtcacatggatcgcgtgatgtgtatgcgagtgtcacatggatcgcgtgatgtgtatgcgagtgtcacatggattgcgtgatgtgtacacgagtgtcatatgaatcacgtgacgtgtacgtgagtgcttccacctccggctcacatgttattttcccctgcaaagctgcaggatctgaactctggagggtaaggtggtgagggatgggcgtgtcctccaggtgcccacatggggccagctgactgagtcagccccagtttcctgaggaaggactcaaaaggattttctggttcatccaggtgagtaagttcaagtaaagccacc

SEQ ID NO: 224 - DNA, 100947 bp, Homo sapiens
ggttttgatttgcatttctctgatggccagtgatgatgagcattttttcatgtgtcttttggctgcataaatgtcttcttttgagaagtgtctgttcatatccttcgcccacttgttgatgggagttttttttttttcttgtaaatttgtttgagttcattgtacattctgaatattagccctttgtcagatgagtagattgcaaaattttctcccattctgtaggttgcctgttcactctgatggtagtttcttttgctctgcagaagctatttagttgaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaacaggaatcctttccccatttcttgtttttgtcaggtttgtcaaagatcagatagttgtagatatgtggcattatttctgagggctctgttctgttccattggtctatatatctgttttggtaccagtaccatgctgttttggttactgtagtcttgtagtatagtttgaagtcaggtagtgtgatgcctccagctttgttcctttggcttaggattgactcggcaatgcaggctcttttttggttccatacggattttaaagtagttttttccatttctatgaagaaagtcattggtagcttgacggggatggcattgaatctataaattacctaggggagtatggccaattttcacgatattgattcttcctacccatgagcatggaatgtccttccatttgtttgtatcctcttttatttcattgagcagtagtttgtagttctccttgaagaggtccttcacatcccttgtaagttggattcctaggtattttattctctttgaagcaattgtgaatgggagttcactcatgatttggctctctgtctgtgtgttattggtgtataagaatgcttgtgatttttgcacattgattttgtatcctgagactttgctgaagttgcttatgagcttaaggagatttttagctgggtgtgatggcgcattcctgtagttacagctactcaggaggctggggcagaaggatagcttgagccccagaggttgaggttgcagtgagccactgcactccagtccaggcaatagagccagaccctgtctaaaaaaaaaaaaaagaaaaaaattatttaaggattatttaaggtagtttaccaagatgtagacatgacaaaatagatatacaggcaagtaaagaaataagggagaaagtgaaaaaggaggaaaaataggggtatgactaaagctagcaaggaaaatagctgccatacatacttaagaaaggagggctggttgctttattttggctgaaggccaagttgatttatccagactgctgatagacttttattttatatttcacttattaaatattaagtttaggtttttctaccctaccttcccagggatttgatggataaagtactaactggtattgtgacttgtatgttacaataaacaatctgtcaatttcaatttttttaataatcgagagagttttgaacatcacatgaagttttttggcaagtcagatataaaatacacgaaaagacaaaaaatgtggcagctatgctattcacctttcacattttgcctatctttttatctgaagtttatagaaaaggcattttactaaattcaaagtgagaactactaatactacacctacatatgacctccttatggtggacgggtgtcagccaaagcagttaagtttcaaaatggctatactgatagactttaactcaaaaactataatcattatttggtcatgttttggttggattacaatctacagaatgggaaaacttgcatcagatttctagttctttccagctttaagatcctatcatttccatcatcctgtaagatgttatctctttttatgcatactttctttaaagtccaagtcactcagagaatgaggtcattatgctgctattgatcttgctcaccatggcaatatcaacacacagaacctaaataaaggagcctaaaataaaagtgcaaaatgtaacacagctgccaattttagagaatttttcagaagtatgtcatttgtagtatagtaggaatctcagctccagtctaagctgggtctgttgctgggctcaagcatgtctgggcatgtctggcaaactggcgaggcaggactacaagaaacctgctgccatgggggctgaagctgcttcctggaacagaactcattttagtggaagagagaattagagaagccctacaagaaagacttagtcattgaatggagagtaacaaatgcagcgtggggtagctgttactcaaatctgtcgccagtctaggcccatgaaagcatgtctggatccctaagagaaacagagctctgagtaaaaacataaagggctgtttcactaaaaaccatatgatattgggcacaagcagtctgcttcggggttcccctaacacaatgatctccatttcttctgactgtactatgactttggctgttttgtttgtatcccaaattttggcagggcatggtggctcatgcttgtaatcccagcactttgctaggccaagttgggcggatcgcttgaacttgggagttagaaaccagcctgggcaacatggcaaaatcccatctctacaaaaaatgcaaaaattagcccggcatgatggcatgcacctgtagtaccagctactcagggggctgatgtgggaggatggcttgaatccagaaggttgagtctacagtgagccatgattgcgtcactgcactccagcctgggcaacagagcaagaccctgtctcaagaaaacccagaagacaaagtaaacacacacacacaaatcctggtaggtgtctgcagtacctagaatagcagagcagaggaaggggtcctgggagaggatttgacttagtgagagacccttgcccttctgggactcccagaaggctggagatgtcctgactaccttagtaggcttggtaggtagatgaaccaatgaaattcaaattattgttgctaatttgaccccatcagtgctgtggttgatgagtttgaatatgactcctaatcaaatagcccttatgcaatagtgtgttattgggcaacttacaattacctatagcatcacacgttcaccaagctggaaaaaaagaactgtagaacagtgattctcaatttgtgaaagaccagtatttaaaaaaaaaaatttctgggctgggcacagtggctcacgcctataatcttggcactttgggcggccaaggcaggcggatcatttgagttcaggagttcgagaccagcctggccaacatggtgaaactttgtctctactaaaaatacaaacaaatgagtcaggtgtggtggcgcatgcctgtaatcccaactacttgggaggatgaggcaggacaattgcttgaacccaggaggcagaggttgcagtgagccaggatctcaccactgcatgccagcctgggtgacagagtgagaccccttctccaaaaaaacaaaaaattctagtggactggtacttttgtaaaatacagtaaaaatgaattcccagtgtaataaaataaaataactgatgacatagaaagtataaactctaaggccaggcacggtggttcatgcctgtaatcctagcactttggcgggctgaggcaggtggatcacattaggtcaggagtttgagaccagcctggccaacataatgaaaccccatctctattaaaaatgcataaattagctgggcgtgatggcaggcgcctgtgatcccagctactcgggaggctgaggcaggagaatcacttgaaccgtgggtggaaaggggtgggagggtggcaggtggaggttgcagtgaaccgagatcatgccactttgctctagcctgggtgaaagagtgaaactccgtctcaaaaaaaaaaaagtataaactctagtttttaaatttttatttatttatttgtttgtttatttgagatggagtctcgctctgtcacctaggctggagtgtagtggcgcgatctcggctcactgcaacctctgcctcctgggttcaagtgattcctctgcctcagcctccctagtagccgggactacaggcacacgccaccatgcccgactaattttttttattttagtagggacgaggttttaccatgttggccaggatggtctcgatctcctgaccttgtgatccacccacctcaccctcccaaagtgctgggattataggcatgagccactgcgcccagccaactctagtttttttattgttagattagtaatttttttttttttttgagatggagttttgctcttgttgcccaggctggagtgcaatggtgtgctcttcactcaccacaacctccacctcccgggttcaagcgattctcctgcctcagcctcccgagtagctggggttacaggcatgtgccaccatgcctggctaattttgtatttgtagtagaaatggggtttctccatgttggtcaggctggtcttgaactcccgacctcaggtgatccactcgccttggcctcccaaagtgctgggattacaggcgtaagccactgtgcctggcccttagattagtaattttatgcagacataaaactgctctgtcaagttgttataaaagtttataaaagtttatgaaagctacttttagtacctatgtagctacaaaccgggaatgcacagtttatgaatgggtactgagctggggaatgactttggtcctcaggatcatcaaacctgtcacctgatgctgccaaaagaaactgtcacacagaggttctgctctagttcaacacttcagttatttaaattttgagagtgaaataatgacatcctgtcactgtggttatggaggagtgtggccttgttctaaggagatgcatgcagagcagtgatgtctgcaactaaaccaagaggaagacagggaaactctccagtgatgggaaacacaattttctgcaaaatgccaattccgagacagttcattttagtcttcaagtataaataccacagctaaaatattcgtttgtggctttgatacttgccatttccatgtgtctaatctccattcacttttgacactttttttttcccttaataaatccttcactggaacttttcacacttttcatcctatctcctatatattagattctacagatgtacaatataatctaatcatatcatacctttattaaaatatcttagtacatacctgtcagaactttttttttttttttgagacaaagtctcactctgtcacccaggctgaagtgcagtggtgcttggcttactgaaagcctggacctccctaggctcaggtgatcctcccacctcagcctcccatagctgtgtgccaccatgactggctaatttttttttttttttcttgagacggtgtcatgctccgtcacccaggctggagtgcagtggcgcaatttcggctcactgcaacctccacctcccgggttcaagtgattctcctgtgcctggctaatttttttattttttgtagagatagggtttcaccttgttggccaggctggccttgaactcgtaacctcaagtgatttgtctgtctcagctctccacagtgctggattacaggcatgagccactgtgactggtccccaacatcaactttttattcatgtccttcttcaatctaatatttaactatttttagctttcttgccatgatttcttatggttaattaaccttgtcatgaataaatgttgatgcttttccgtatattgcttctcagtttgagttccccaacacagaattctgttcgctcttcaaaatccagctcaaattaatgaaaccagatatagttattgtatgtcttactatacactttgtcgaaatcctacatttttcatgaagctttccttgattaactcggccaaacatgaaccataatctccagggcttaacacagtgtctggcacatacatttgttggggctcagaaaatgataccccaaagtatggtgctttggcatgctgagtacttttgtcagaggtgttcgaaccacagcgactcgcatcgtgaatacgggatgggtaaaataaggctgaaacctactgggctgcattcccaggaggttaggcattctaagttaggataagatagcaggtcagcacaagatacaggtcacaaactccttgctggtaaaaggatgtggtaaagaagctgaccaaaacacacaaaaaccaagatgcgatgtaagtgacctctggtcatcgtagctactcattatgtgctaattataatacattagcatgctaagagacaactcccaccagtgccttgacagtttacaaatgccatgccaatgtcgggaagttaccctatcgtctaaaaaatggagaaaccctcatttccaggaactgcccacccttttcctggaaaactcatgaataatctaccccttgtttagcgtataatcaggagatgaccataaaagtggccagccagaagccctcagtgctgctctgtctatggagtagccattcttttattcctttactttcttaataaacttgctttcactttactgtatggacttaccccaaattctttcttgtgtgaggtccaagaaccctctcctggggtcgggatcggggcccctttctggtaacactttgtgttttcttttgttttcttttcttttttcttttttttttgggggggggataaggtcttactctattgcccaaactggagtgcaatggctcttgatcactcacagttcactgcagcctcaatctcctggctcaagctgtcctcccacctcagcctcccaagtagctgggactacaggtgcacaccaccacacctggctagttaacaacaaaaaaaagtgttttgtagcgatggagtttcatcccattgctcaggctggtctcgaactcctgggctcaagtgatccccctgcttcagtttcccaaagtgctgggattacaagagtgagccactgcacctggcccccatgctgagtactttgaactaaaggagattggaaagcctgagaagcaaagtctctcactgaacctctgtcctgctgtctcctatccctgttactcaccctaggctagtcatataaaccagaactcctttccccacaaagtaagccatgaaacgaagaaaggtcactctctgccttctcatttgaagactctcattccagagaagtctgctctatacctgggtgtggaaggaatgctacacagagaggtcaagacgaatctggacaggccttgctgggtttccacactcagtctattactattagttcattctctttttgtacaatcacatttctacatggatgtccactctgttgaatctaggcatacaaatggacagctttctctgggtctttacttctgaaggctcctgtgtcacataagacttccattaaattaatttgttacacttttctcttgttaacctgtcttttgttgtagaagtgttggccatgacccttatgatgggtgaggaaaggtatggagtgcagtggcatgatcatggctcactgcagcctcaacctccagggctcaagtgaacctcccacttcagcctcctgagtagctgggactacaggtgtgccgtagagacagggtctcgctattttacccaggctggtctcaaactcctgggctcaagtgagcctcctactttggcctcccaaagtgctgggattacaggtataagccaccctgccggccttctgatagtttttaatttacagtttacagtgtatttcactttaatacattccttatctaagattgcctttgaggtttaaaatgttggaagttaataccttacattgtatgtgcctctgaaggtatctgtaaatgatgtcccatgttattatttttgcattcccttagaggcaacattttatataacagttgtccaaaggcctaaggcagaggatgtaatactgggtactcacggtatatgacgactttcccaaatgggaaatgagcatggaggctctgttttcaggcagtcagttctatcctcattttccttgagtagaagcatccctaaaattggcctgaaaatgtgtccttgggtcagggtgtaatgtgggctcttttccagtctcctttcttccaatgacctcttccctactttacaaaagaaaggcataattcttcctcatgctaaatcttagtaaggtgcaatacccggttatgcaaaaacctccaggacaccaaagaaaggcacaattgactggtgaataagaatggggtaacacatcctttcacaagtcaggtggttttcagttgcttgctttcaacaagttgaaagagaacctaatcagagttgtcagctgacagatcattaaaagtattttttctttgttagatctttatgcgatttttgggcatataatgcgaaaggcattcaaagaattgtgtggcattactataacaaaactccattcattctcatctgctttttttatgcgaacaagttttctcaacacttatatccatggaattgaaaacttggaatagaactgatgctgaactatttctcaaaaaaatccatccactgaaggtcataatgtatattagaaaaaagtccacccaagttcatttctgcaagatgcattgccaataaaattttgcttttgtgtttagtacttacaaacatttgaaatagatttgttttgatcggttgaaataagagctttatgatcacagaaaatataaaaaacaacccagatacttcaatttatgttcacatttttattacaagtaagacgatcaaaatagttcaaatataaaatatattactaggataaaattctagaggagatatgcaacgtcaatatgagttccagaaaacaatatttggaaattgtattttccaaactgtattttaaaaaaatggatattagtgggtgttaaatccctatggtatttagaatccattggctatacagtatttaaacaatgcgacagatgaaatatttataagccggaaaaatgtagctgtcattctaaactgtataagaacatacacagctttacgaaattgttttagaaggctcatgaagtaaaaagtttgaggaccctgaaccaagatgtttgctctgggttcaggatgtcaacatctccaggggtattcaaacatagggtgtattaaaacctgtcgccctgtgttgcgcataaaaatttagtaccttacaccgtagtgttttaatttttgcccattttaaaccgctctcttcgtagactgtaggctcgttctattcctggctcagctcctgtacagaggggacactcctcaaacacccccggaatgaatgagtttatcgtgagaactcggaaggctgctaaaatccccggccagcgttggagttttcagtccgcgtgtccctgggcttcgaagcccggcagggcgtgggaaggccccgaggaaacgctgagcacttgcaggcgccggggcgggggcgggggcgggcactgggcagcggggcgggcgccgggcgggggcgggggcgcagaacccgcagccgggggaggtgctgcctcgtgccgccgcgcaggcgcgcagcagtctccgtgtgagtgcgcgtagtcgcgcgcctgtccccgcgcgggctccgtagcgcgtgtgcaggctgacgcagctcgcgggccctcctcctgctctgcagcggcgtcggcggagttttgggcgtttgggaggggggcgagggagagagagtcgagagagggaggcggcggtggggaggaggaggaggaggaggagcaggcgccgccatggccgccgctatcaccgacatggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacaggtcagtgctctgaagcgtttccccttcccttcctcctcttgaactcccgggcccctcagagggggaccaaggcgacgttttgccgcgatccccctgctccccgaatcctcggcccctcccccagactctcaactcggaaatctctcgccgtcgccgccgcgcccctctcgcagcgcatcgcggcttccaactctcaaaccgttcccccccaactctcctttccccgccctctttcccctcggcgcttcgctcctcacggacctcaggacggctctaactcggaaacagtccccaaacgggcccagatcctctggcggagcagaagagggccttgatgtacacacgtcggtactcaaggttagcttcttccaaccgtgttcgggaacacttgtcagaactacaattgacaagtgtttccaatatggctggtctcgcctggatttaacagaacttccttgtccatgggagagaccccagctatcacttttctctacttaaacaaaaaaaggactgttcttttatattaaatcattgcctcccaaatccctcatttgtagtcagtcatgtggtctccaacgtgattttaacaatcttttctatttgttttgggagcatatctgggaaaaagttttaaacacgtataaatggttgtggaaaagaatagtgaattgatggccttttaagataactttgcggaatcagagagttggaatcgtaacaaaatacagtcttgaaggtacaacgtagtttgcggctttatagtaatgtttcaacatgagagtcatgattttaaatgataatatttaaagtcatgcattggagaggtctcggaaggaatgagtattatttttcttactaaagcttgttagaagtaactggagagtgacaaaaatgcgcattttttcagaacatttaaaaagtgtgatagtgtatgtttcaattgtcttatcattacttttgatctgtttgggttagttggtttttaatgtacttttaaaaaaacgagaatcacatgcatattatgccacttctaaagtgtattagcgtttattttgaccatctatgttttgacaatcacattttttttaaacatgctctccagaaaagtatagcaatggaaattttagtggtcgatagtgattttcatttaagagtttaatattctaaagttctaggaattctgattaattgattaaaaacgaacaccttagtatttaatgctacaagtaatacagagtcctggatattttgaaaatctggcattagattctgtttgacattaacgtctagttaagaaaatatcttcgggtaaagtagactgtataaaccttagaaaaattgtgttgaactgtgtaggcatgggtaggaaggagaatgtcttcaagaaaattaaaaattgatgtaaactgcacaatgaagcatgtgctatttttaccattttatgctcctctgataccattacatatctgaaagttgacattagtttataaaatcagcgtttttcatttactcagtatacacgtattatgcttgcctaccactgtacaaattagatgtcttccatttcattcccacaactatggtgcaagataggtattattttgacttctgtttaacagatgaagaagcaagttgagtatcttactcaggacagtaaatacagcatggaaatggtgggctggatatgagcaaaggttctcaagtcccctattatttccactgaagagttaaaataattcgccttaaataagttgaggccgggcgcggtggctcaggcctgttaaccccaggactttgggaggccgaggtgggcggatcacctgagttgggagtttgagatcagcctggccaacatagtgaaaccttatctacattaaaaatacaaaaattacccgagagtggtggcgcgcgcctgtgttcccagctactcgggaggctgaggcaggagaatcgcttgaacccgggaggcagaggttgcagtgagctgagatggtgccactgcactccagcctgggcgacagagcgagactccgtctcaaaaaaaaaccaagtgatatgtgtcagagttttgtttttagttagtgtccatttactacatcacttcaggagacgaattattggttaagtacatttaggaagtggagttgtggcttttatttgacattaatgagatatttacttgagtatataatttttacatcttatttcagaataagaagtaaaatacgggtgtcacaaatccaactacagttaaaacttgataaccaagcaaacttggttttcttaatgcttaattttagagactacagaatactgtttttaatgtcaccatttcagggtaatagatttgtcacttgtatgaagaaggcttactagtgaaactggcttggggtcttaataatcttaattctgaaacatcttcttgttgcctttgagatttttctcccagttattttgagtttggaaaggatccctaattcttataaattactgtagattacatcaatctgtggattttataggttgatttcatggtaagaaaacttcatttttgtaaccagtggaaggataatcttagttttaaagtgctctataacatttttaggcattcctattacaaagattctattataatgcccatttacctttcccatcgttttggttacgttgtgctttttagtttatctgatatgctctagaatttgttgaacatctttgttaaatatctttttcttttttttttttgagacgagtctcactctatcgcccaggctggagtgcagtggtacgatctcggctcactgcaacctctgccttgtgggttcaagcgattctccttcctcagcctcctgagtaactgggattacaggtgagtgccaccacccctggctaatttttgtttttagtagagatgcgatttcaccatgttgtccaggctggtcttgaaattccttgacctcaaatgatcctcccacctgggtcttccaaagtgctgggattacaggagtgagccgccaccgcaggccatgttaaatatcttaagtgctacttttaaaaagataattaggccgggcatggtggctcacccctgtaatcccagcactttgggaggccgagtcgggtggatcatttgaggtcaaggaattccaagaccagcctggacaacatggtgaaaccccatctctactaaaaatacaaaaaaatgagccaggcatggtggtgcaggcatgtaatcccagctactcaggaggctggggcaggagaatggcttgaatctgggaggcggaggttacagtgagctgagattgcaccactgcactccagcgtgggcgacagagcaagactccatctcaaaaaaagataattaaatataaagacatagatattagaggttatgacctgagatgtcatttatggtattggaaggttttgtggtaaaaagtgactaatttatgaaatgattaaataccacttggtacaaaaagttgatttttttccccccagaagaaagtttttcaaaaccagtgtaagtttatagcgtgtttattttagtaaatttagaaattcttgaaatttatatgtaattttatttttactttggttataaagatagtagggagaagtattttggttataaagatagtagggagaagtatttagctatgtgaaaccgctaaaaactagcttttctttactctgaactttttttctcttcagtgaagctgaagtactttttaaaaaagttatgctcttaggttaatttcagaggctatggtaactttaaaaaaaatttaaaaaattttaaacataattttattttcattcttccaacacagtatcatgtaaaaatagtttaaaatatggttgaatgaatgagtcatccaaaaagtgatcaaatgtcagcacttgttactgaacgtgtatttatgctaaaaaagttaatgccgagaaaatagaagacagtctcaagttcaagtagtaaattagcttttaaatggaattttaatatttaaaatgcccgtggagttagttaacaaattagtactagctattgaatcagttaatatatgaaagtactcttggccaggcatgtggcccacacctgtgattccagcactttgggaggccgaggagggcagatcacatgaggtcaggagactagcctgagcatgaaccaccagacctggcgcaaatcttaatattactgcctatatttcaatttttgagtagtatatctttgaactttagttcctcaactacaaaacaggtattactctgaagtgttgttttgtggttcaagtgaaataatttctgttaaagagcgctgtgaactgtttggaggaatccatccacgttgcttgaatgcgtgcatcttttctgttgtagaatggtattttggagggcagggacatttttgcttttttagtatctttgtaagtacctaacataatatcttgggtgtggtgaatactccattaattactagcattaaattgagaataccaacagtagtatgtatgtatgcatttatgtatttattttgagacagagtcttgctctgtcacgcaggctggagtgcagtggcgcgatctcagctcactgcagcctctgcctcctgagtagctgggaccacaggcacctggcccaacagtagtatttatttaacgtcttactacttgaggtctcttgtctatgaaagggggacaataatggttcctatcctgtaagattgcaatgtgaattgtagagtatttggtacacgttcattaagtgtttactgtgtgatgggtatattctacagatgtatatagaatccatgttatgtgacagatgctttattttttttgatatagggtctcactctgtcacccaggctggagtgcagtggtgcgatcttggctcacggcagcctctgcctcccgggttcaagcaattctcctgcctcagcctcctgagtatctgggattacaggcgcatgccaccgtgccctgctcgttttctttttttttttttttttgtatttttagtagagagggttgcaccatgttggccaggctggtctcaaactcttgacctcaaatgatccgcttgcctcggcctcccaaagtgccgggattatgggcatgagccaccgtgcccggcctcatgccaggtactcttctaaatgctggggatacagcagggtataaaacaaaacccttacctcatgagtggcagagagaatcactgcacaaatgaattgataatagctagtaacgtctgttattgtgaagtgctgtacgatctggaatgcccaaaagtactgtatcaatcaggtgttagatgtatgacaagagtctgcaaatgagtgttgcagaaatttgcaaaaggatatggtagactaaaatatttgattacagcatgtacattttaatcagttttctatgactgttctgtggtgggcctaaaagccttcatatgaaacctttcattttaaattgtttttaatatgtacgtgcagctagttataaaaaaatataactagctttcttttttttggacgataactagctgaacgtacatattaaaaacaattagaaaagaaatggaatgcttcatgaatttgcatgtcatccttgtgcaggggccatgctcattttctctgtattgttccaagtttatcatatatgttgctgaagcaagcatgccagttatctattggtaaaaagttttggaataagttttctagtaatggcagtggtctaacctatgattaatttatttttgcgatgaatagtttgtatttgtgaaagtagtaattatattggtcttaaatactaagacccattgcgccccatttagtgataagaaacatgacggtatctcctcagatactttgtttttaaagagcaggctaaagagattattgtattctgttttttctgtaaattgcgacatggtgcattcaaattagaactggaggcaggtatggttactcacacctgtcatccctgcactttggaaggccaaggtgggaggatcccttgagcctaggggttcgagaccagccaggacagtgtaacaagatcccatctacaggcgggacacggtagctcacgcctgtaatcccagcacttttggaggctgaagcaggcagatcacaaggtcaggagatcaagaccatcctggctaacacggtgaaaccccgtctctactaaaaatacagaaaaaaattagctgggcgtggtggcgggcacctgtagtcccagctacttgggagactgaggcaggagaacggcgtgaacccaggaggcggagcttgcagtgagcagagtttgcgccactgcactccagcctgggcgacagagcgagactccgtttccaaaaaaaaaaaaaaaaaaagatctcatctacaaaaaatgaaaaaattagccagatgtggtgtcacatgcctcaattcctagctacttgaaaggctgaggcaggaggatcacttggatccaggagtctgaggctgcagtgagctgtgattgtgccactgtagtcaaacctgggtgacagcaagactctcacaaaaaacaaaaaaacaaaaaaacaaaaaaattagagttggaacgtgttgtatagttagtgactaaagattttgtgtgggaagggggacagattttaggcttgcgtaaatgatgaagagagaattctagaaagcctaactgaaaacatgtaggcaggaatgagcgtagcatgttcaggagacttcctgccaacatctaaggatgcgccactggacctgggaagtaagaattaatggtgcaagtgaggcctttcatgccaacacaagtgtgtacgtctctcagtataggtttgtgaatcaaattctttttattctcttcactttctttctgtgtaattccctagttcacattcaagtcttacgttgaacaggctggttccttgttagacatattgtcagcattccgagttctttcttgccctcaccccaatatgggtaattgtttaccatttatctccactgctgggttgtgtgctccctgagaagaaaaaccatgtctatcttgattggcactttatctgtagcacctggctatgtaaacgttatttctgaatacgttttcttgaggatttaatttgaacaatagtttgcattgtttttccagacacaaccgtcactagaataactaaaggaacattgagtagtgaaagagcatggacgtaatctaacttctcagaagttgcttccttatctgtaaaataggagcagtgttaggattaagtgagatgacatgcaaaggggttacgtatttacttcgtagagtcatttatatatccccatttctcatgcagagatggtgcagtggaaagaatactccagctgaggataagcgatcagtattgtagtcttgactttattgccgtcaggaaatgtggcaaattgtttatttctgtgaagctcagattgattctttttcttaaaaatgagggtttttgacaaaacagtataaagtaatttggagctcgaatgcgagggtgctgctgtagagttggcaagtactttaaatacagttaaacaaatagataatggattatcttctttagacaaactcggaatattgccgtgtgtggctttgttatatccaggatctcaaggatatcttaggtaggttcttttgggtttaaaaatcaccatatttctttttaaaacatttttttatttttgaaaatggagactaggtcttgctatgttgccgagactggttttcaactcttgggctccagtgattctctctgcttgacctcccaaagtgctgggattacaggcgtgagccactgtgccttgccagaagtcatcatatttctacttcatatttatgatgttgtattgaaatatccatttgtgtttatttcctctaggctataacattttaaaagtaaagatcaggccggacatggtggctcacatccgtagtaaaaatacaaaaattaggcgcatgcctgtaatcccagctacttgggaggctgaggcaggagaatagcttgaacccgggaggtggaggttgcagtgatctgagatcgtgccattgtgctccagcctgggcaacagagcaagactccatctcaaaaaaaaaaaaaagtaaagatcaggtctcatatatacttgcagaacttgccttctgcactcactcagtatgtcgtagcctgtattcattctcagtaattggttgaattcaacttaatgtggaaatacctgattgcatatttctttctcagtttcattagtgtggctgattaaagaaaaagagaacagtttttttttgttttgtttgtacttcgagacagggtcttgctctgtcactcaggctggagtgcagtggtaccgtcacagctcactgcagcctcaaactcctggacccaagtgactgtcctgcctcagccttccaaatagctggagctacaggcatgcactaccatgcccagctgcttttttcattttttgtagagatggggtctccgtgtgttgcccaggctggtctcgaacccctgagctcaagcagtcctcccaccttggcctcccaaagtgcagggattacaggtgtgagccaccacacctggccatcattacttttcataaatattttttaaagtacaaagagtagatgaattggcaatagattttttagtgttttaaattaatcttggaaattgttatatcaacatgtgttttgaggtgttcagtcaagaatgacagtagtcattcttgtcagaaatgcatactgaaatcatctgatatttttcctcaaaatttccttaggaaagatctttttatgatttaatactaattaaaccttcagatgcaattgcttctttattaaatggggggtgttcttcatagtggatttctttttttaaacataccatctttgtgtatatacatttctctggaaatgtttgtgaaaaggtaaagataacttccttagtgtaattgtgttgaagtggaatgtttctagtgtttgtgaagatatcaattgctggctgatattttaagctggatgaaaaatgtgggtgaagtaatcttaaagggtgatagatttgatatgagaaatttaaagtaatgtgctcagtgcgtagtggtgataaaagaatgtagcctacttgttttccatagactatatttcatcattgttgcataaagtcccttttggccaatttagtgaatgctgctgggtcttcaggaaagaaaatcgtttgtctttaaccagagaaataattgtggggatagaaagtagtctttttcttgatgataaaaattcattttagctttttaaattacagtggtaatagcttgtagtaatagtggtaatatcttggttttggctaatgatttttagtgtgcttccagttaattttttttgaattattttagtgtgacaaagccatatattttacttgccttaaaaaatactacttaagtttctcgctaaaaatgatgagcatttactacgtgcaaggctctaactaggtttgggagtttactctgaatagaggtttataggtggctacaaattaactggatcatatgggagcagaattccttccaccttagatgaataagaagggccttagggaaatttgacttatttataacacacagatgtaataaaataggcacttgtctttacttttttttcctaactgagtttatagaccaaaaagcctacagcaccaccgcagttttgaaagcaaaatcaggtagccttacagaatctgatgtgtctaaattccttaatcctgtttaagaccagttttataatttgttctttgtccttcgtaagtagaaaaagtgaccaccccattgccctgggaaggaatgtttggagttggatttgatgttgtcattgttaggctcaaatctgtttcagtggcctaagttctaaatttgggacaatttctttctaccctcagtgttgctttctatgaccttgaatttttatgaagctaactgacgtgtaggaatcaaatttaatagtttttatttttagtaaaactgtctgcctgaatgggtcaaattttatgtagatgttaaatatctcttttgtgttatgcactatgaatgtacaaaaccaaagaacttttgcttgtgtgctacactagataaaagttttgcatactagatgaaaatgtcagcctggcacggtgactcatgcctgtaatctcagcactttgggaggctgaggagggaggatagcttcaacccaggagtttgagaccagcctaagcaacaaagtgagatcccatctctaccaaaaaaaaaaaaaagaaaaaaaaaagacagatgtagtggtggtgcatacttgtagtcccagctactcaggaggctgagacgggaagatcgtttgaatctgggaagttgaggctgcaatgaactatgattgtgccactgtactcctgcctgagtgacaagagtgagacattgtctcaaaaaaaaaaagggtcatttttttttttagttgcactaaaggagtattagtgccattttgatgtatactataggctgtatttcaattatttcttaaatcagtaattcattcaagtttctcctttgaatatatagtagtatgacagttttttttttggcattactgttttgcacttgtttgactatgggcaaatcttaatttatctgaaagaaaaggatacgaataacagtttattagagttgtaagcattacagagttaatacacatcaaacattgttccagttattatggctgcatgacagcccttttccaacatttagtagtttaaaacgacagcatttattttacttatgaatctatgatttgggccgggttctgcagggtcagctcatttctgctctacttggtatcagctcgtggaagcagcttaaagactggggactggaatcagaatgcccactgactcatgtcatgtatctgtcacatgtctggtgcctgggctgggaagactcaaaacagctgggggtcagaacagctggggcttctcaggcatccctctctagctctgtgtatgttcttcacgggatctgttccactttgcggcttcaagggagccagatttcttaaatggtggttgaagactcccgagctgagtgttccaagagcgagccaggctgaaactgtgttcccttttatgacttagccttggaagtctggcatcatcacttctgcagtagtctcaggcctgattaaattcaaggggaggtaatacagaccacacctattagtgctgtataataagaggagttaaggatggggtctttcaaaagtgaccatcttttaattttttttttttttttaagagacaaggtctcgcttgctgggttgcccaggctggagtacagtggctgttcacaggcacagtcatggcatactgcaatgttgagctctgatactcaagccatcctaccaccttagcctcctgagtagctgggactacagttgtgcatcactgcacctggcattaaagtggccatcttttgttttatttttatttatttatttttgagatggattcttgctctgtcacccagacgggagtgcagtggcacaatcttgcttcactgcacctctgcctctcgggtttaagcgatcctcctgcctcagcctcctaagtagctgggattacaggcatgcgcccccacacccagctaatttttgtatttttagtagaggtagggtttcaccatgttggccaggctggtctcgaactcctgacctcaagtgatccgcccacctcagcctcccaaagtgctgggatttttatttttattgggatggagtttcaccatattacacaggttggtcttgaactcctggattcaagtgatgtgtctgcctcgacctcccaaagtgctgggattacaggcaagagcaactgctcctggccaaaagtggccatctttaaaaaaatacgatctcacacaagcacatagaacaatgcaggatatatagcaaatgctgtgttagctgttaatataaaaagtagaaacaagatttagagtgccttttgctattttatatagtaggttacataattgcttttttccccttaatagtcataacctgtaacaagcaaggttgttaatggttttctttttcttttttttttgttgttaatggttttcttgaagtacctgtttcatttggttgttttaacttttaatccctttgtcaagcctagactaaatattagggcaaataattataatctgttccaatgaatggagacgagaaatggtaactcaagtaaagaatttttactcttagagttgtgcattaggtgtacaacttcagagttcttaagatataggggattcttaaatgcttttgcaatgttttgaattttaccctttaagaaattgattataagggcgggagagacatagtgtaatctttctagtataagtggcagttttatagatgaaaggaatatcacctgttagctgaatgatagtttacctgttaatatgattagattaggatttcctttgtatcattgtaatgtttacctagtttgataaataggcctgtgaaaaactattatagacttacgttcttttttttttttttttttttttgagacggagtctcgctttgtcgcccaagctggaatgcagtagtagcatgatctcggctcattgcaagctccgcctcccaggttcacgccattctcctgcctcagcctcccgagtagctgggaccacgggtacccgccaccagccccggatgatttttttgtatttttagtaaagatggagtttcactgtgttagccaggatggtctcgatctcctgacctcgtgatccacccgcctcagcctcccaaagtgctgggattacaggcgtgagccaccgtgcccggccgacttaacgtactttcttaaaagtttttttgtagagatggggtcttgtcatgttgcccaggctggtctcgaactcttggcctcaagcagtcctctcaccttggcctcccaacatgttgggattataggcatgaaccactgtgcctgacctatatactttctttttttttgagaaggagtcttgctcttttgctcaggctggagtgcagtggctcgattgagctcagctcactgtagcctccgcttcctgggttcaaacgattctcctgcctcagcctcctgtgtagctgggattacaggcacgcgacaccatgcccagctaatttttgtgtttttattagagatggggttttgccatgttggctaggctggtctcaaactcccaacctcaggtgatccacccgccttggcctcccaaagtgctgggattataggcgtgagccaccgcacccggacaaatgaatttaaatttgaagtgggtgtttgtggatgatacatgtttatgtcagttttagcatccagtttctttctttctttgttttttgagacagagtattgctctgtcacccgggctggagtgcggtggaggcgggatcacagctcactgcaaactccacctccacggctcaagtgattctccccccctcggcctcccaaagtgctgggattacaggcttgatccaccatgcctggcccccagtttatgtctttattctgttttggctgcttggttctgcaaatctgatttggagatatggacagtctccatgtctccatgtgtaccttagtttgttcttttttaaaaatggagacggggtctcgccatgttgccaggctgatctccaactcctgagctcaagccgttcgccgcctctgcctctcaaagtgctgggattaacagatgtgagcaactgcgctgaccacattagttctactgatttaggaacagggattagtagtaaggacgttttatttggaagacaacattgtttattgactttaattgttttcacttcctgtcacaaatgcaaaagtgaccagaacctcacactgaactcttaatactgttttatgtcaacttttaattgttaccacacacacacacttggctagacccttaagtgaagggaggattcacaaagtaattgtggggaaaggtctttaattggttaaggtataaggtatacgatttgcaagcatgattttatgtgaatgaagatgtgaaggcttaaattagggtggtagaaacaccagtgcagcagagccgtagcctttttactcagtgatgtattcatagaaaattctgaaattcgtagattttagtttttttgaatgtcaataaattatgcttgatttcaggttatatactctaaatccttcaagtccttgtcctctaccttcctttaaagttagatattacagtgcttgctttggcggcacatacactaaaaaaaataaagttggacatttcagtaggctagacctcaccaaagatacggcaggtgggtggaggggggagaacgacccaaagttaccaaggaggagctacaacacaaatgaatttgctcacagaactgaaaagaagactgccgataaggcttgcccctatccatttgacctcagactgaatttcaaattcagcagttaacctcagaataaaataaaagtattcccgtttagaaacatattcttttgatctgttttagggaggtgctcaagctttggtggttctcagattttttttttttttcatgagatagaatcttgctctgtcatccaggctggagtgcagtggcacaatcatagctcactgcagccttggacttctagcaatcctcaccttagcctcctgtgtagctgggattacaggcacataccaacatgcccagctaattttttttttttttaagagacagggtcttgctatgttgcccaggttgctcttgaacttccagcttctagaaatcctcccgctccagcctcccaagttgctgggattgtaggcgtgagccactgcgcctggcagaagtcatatttcaatagccctttaagataattgtgttgctatttggtaataagacaacacttggcaagtggtagtttcttaaagattatttgcaatgtgtaatcagaaaccatgttagtgaacttttctcagttactttaagaccatagttttgtccttctcagtcatggtaacataagcatccatgtattgcttcctatgctcatgcaccttgtcatttagcaaagtgatctttataactttctcagtattggcaaccctgtcagccctggtcacgtccaccaagcagatacttgcctagaagtaatttaagactcaaagttggggctgttctggatgtatgagtgagacaggcttcgaatttccaaaggaaaccatttttataaaatcatacagttgatcgctctagctgttgggtggaaaactggtctgctagatagtttctaaactaagggaaaagaggaaaaggagaatgttgttgatgttgaaaatatctcaggttgctccctaaatattccattgacatctctaacaacgtgtgtgtaggtgttttttaaacttaaaaatttggtttaccattttaccatatgaaacaatttcttagatggtctcatcagtttcagttgggtaacaatactagtcaaagagatctttttttttttcctcattaaacttttttaggggctctcaaaattccttgacaaatttttagtcaagttgtttccattaaaaagtactgattttaaaaactaataacttaaaactgccacgcgcaaaaaagaaaaccaaagtggtccacaaaacattctcctttccttctgaaggttttacaatgcattgttgtaaccagtcttttactactaaacttaaatggccaattgaaacaaacagttctgagaccattcttccaccactgattaagaccggggtggcaggtattagggataatattcatttagccttttgagctttctgggcagatttggtgaccttgccagctccagcagccttcttgttcactgctttgatgacatccactgcaactgtctgtctcatatcatgaacagcagcgcgacccagaggtgggtagtctgagaagcactcaacacacacgggcttgccaggaaccatatcaacgttggcagcatcaccagagttcaagaagttagggccatcttccagctttttaccaacatggcgatccatcttttccttcagctcagcaaacttgcatgcagtgtgagccgtgtggcaatccagtacaggggcatagccagcacttatttggcctggaaggttcaggataatcacctgagcagtgaagccagccgcttccattggtgggtcatctttgctgtcaccagcatcattgccatgacgaacatccttgacagacacattcttgacattgaagcccacattgtccccagaaagagtttcactcaaagcttcatggtgcatttcgacagattttacttcagttttaatgttgactggagcaaaggtgaccaccataccaggtttgagaacaccagtctccactcggccaacaggaacagtaccaataccaccaatttttgtagacatcctggagaggcaggcaaaggggcttgttagttggatgagttggtggtaggatgtagtccagagcctcaagcagcatggttccactggtattgccatccttacaggaggattttcgtcccttgaaccaaggcatgttaaaacttggctccagcatgttgtcaccattccaaccagaaattggcacaaatgcttctgtgtcggggttgtagccaattttcttaatttaagtgttgacttccttaacaatttcctcatatctcttctggctgtagggtggctcagtggaatccattttgttaacaccgacaattagttgtttcacacccagtgtgtaagccaaaagggcatgctcctaggtttgtccattcttggagataccagcttcaaattcaccaacactggcagcaacaatcaggacagcacagtcagcctgagatgtccctgtaatcatgtttttgatgaagtctctgtggttaagtctctgtgtcctagggcatcaatgatagtcacgtagcacttgctgttctcaaatttccacaaggaggtattaatggtgataccacgttcacgctcagctttcagtttatccaagacccaggcctacttgaaggagccctttcccatctcagcagcctccttctcaattttttcaatggttcttttgttgatgctaccacatttgtagttcagatggccagtagtggtggacttgtacgaatctacgtgtccaatgacgacaatgtggatatgagtcttttcctttcccattttggcttttaggggtagttttcacaacacctgtgttctggcggcaaacccattgtgaaaagaaaaaaaagctagtcagagagatcttttcggttcctactagtcaaaatgtcacagcagcatcaagcgggcacttgttagaaatgctttatctcaggacctaccctaaacctgctgaatcagaatctgcagttaataatactgaatgcagaatctgcatttgatttgtatacacatgaaagtttgagaaacactgctttagattatctaagctatctgcatagtgtgagtgtattgtctggcttaggtattcttccaaatatcagggtgtataggtcttcacatttcatgaaatcagtaggtgttcattgaaaaggagaattaactgtgtgaaaaaatttaacatatgtatggtcctagaaatactataagtttaggtggattgtctcttgttacataacgtattataggaggaagggcactgctttctgtgaaattgctatctagctcagggtcctgtcacaatcagaagttacctgtcatttgttttctgtcctctactgttgcatcaggtctgttgccttcatcagtcgagagaatggagaggaccactggtggcagcatgggtctggggccaaaagggagcctagaggcttaggattggatacttcctagaagttggaggagcctaagaggggttgtgaagcagaacttctgttggccctgttcagcttgggggagactctgtgtgggatgtcttgagtgttccaggacgtgcctctcaccttgtctgccattgtattcacagcttagtccccagtggtaggcaaagctcatgctcttaacatttacattatgttgtctttatgaggagctatatccacatgaagtattgtttcaagtgtgtgatatcacacatagactcaacaatgattaccgttaccagattttggacttttttatatggttccttttctttggcaaaggtaataagcaaaagtacatgaagtactatgtagacagacagattccataatgatgtttcgcagctatataaatctctcttaaccttactgtgtccagttaaaaaaaatcgatttggttttcaactaattttggactttttaataaaagcagtataggtacagcatggttaaaatggtataaaagggtatatacagtgaaagataagtttctctcccactcttcccttcccccaaatatttactaggtttcgtatatctttctgtgcccttggagactagctatgtctctgtctccctccccaacttaggtatgcaaattggatcatgactaccctgcacttgtgtgtgttttacttaactataccttggagattgttccatatcacattgagtttttattgcttttcctgagattgtttataaattggttatgattggttgttcacttagaattattagtatttgccttggagttaaattagtatagtttatgtaagtatgtgctttacagttgaatgttttaaaatatttaaagcaagtgatagggaaaataggtaaccatttcagggttaagggcctcatgaaacttgaaatttctttttttttcttttttttgagacagagtctcgctctgttgcccaggctggagtgcagtggtgcgatctgggctcaccgcaagctctgcctcctgggttcatgccattctcctgccttagcctcctgagtagctgggactacaggctcctgccactatgcctggctaattttttgtgtttttaatagagacagggtttcactgtgttagccaggctggtctcgatctcctgacctcgtgatccgcccgcctcagcctcccaaactgctgggattacaggcgtgagccaccgcgcccggccgggggaaacttgaaatttctagggtttaaataaaatatgtatttcggtatagaaaaaccaccatacccaaggttagtcttgcaacaacaaacaatatatgtatattcagatattcaagagctgattcacatttgagagttttacagagattacagagttttagaatgaagccttagagttgcactttagaatctatattgactaggcaggtaaatatatatttattgcatttaactaactaggtaggtagatagatgagcttaaatactagaatatcctttaaaggaaaacctgagacatttttcatatctgaagcatcctacaaaaatatctttgcttttaaaaatggatacgtttctagcatgggcagcaaaacaagactctgccgctacaaaaaaatagaaaaattagctcggtgcagtggctaatgcctgtagtcccagtactttgggaggccaaggcaggaggattgcttgagcccagcctggacaacataaagagacctcatctctacagaaatttaaaaaatttagttggccatagtggtgcacacctgtaggcccggctactcaggaggctgaggtgggaggatcacttgagcctggtaggtcaaggctgcaatgagccgtgatagcaccaccgcactataggcttggcaacggagtgaagaccctgtcttaacatccccccacccctcacaataggtacatttgatgttagacacagatcattataaagcttacttaagctaacaaaattcatgtaaattttctcaggtgtgagtgaataggttgtattggtatataggtgaacgttctttttgttttttgagacagagtctcgctctgtcgcccaggctcgagtgcagtggcgttaccttggctcactgcaacctcctactgcaacctcctcctcccaggttcaagcaattctctgtctcagcctcccgagtagctgggattacaggcgtgtgccaccatgcccagctgatttttgtatttttagtagagatgtggtttcaccatcttgatcaggctggtcttgaactcctgaccttgtgatccacccacctcggcctcccagagtgctgggattataggcgtgagccaccacgcccggcctgaaagtttttttttttttttgagacagagtctagctctgtcgcccaggttggagtccagtgccgctatctctgctcacagcagtctccgcctcctgggttcacaccattctcctgcctcagtctcccgagtagctgggactgcaggcgcacactaccatgcctggctaattttttatatttttagtagagacagggtttcaccatgttagccaggatggtctcgatctcctgatcttgtgatctgcctgctgcggcctcccaaagtgctgcgattacaggcatgcgccactgtgcccggcctgaatgttctttttttttaagaaggtatatactgtggttgattgtcatgatgcctgcaattttaaaatgattcagagaaacagattacagatagcaaatagggtaaaatgttaattgaattcagatttagctgtattttgtgtctttgaacttttccatgataaaaacttggcgggagggaaacatacctctttaaagttaatataattttcacaacttgacttgtgttgtttcttaaattgcaagcagatacacaccttttcatagatttaatctgaaaacattctttctcttgacccttatgattgaagtgactttcatgtaatttatttattgagaagattttgaaaaaagaaaataagtgaattgcttttaaaatgaaggcggaagtgtgatacattttattaagatgtgaatttttgagcattttgaccactagtatatactttttttagtaaataaaagagttactactgtgtaatactttattttattttttgagatggtgttttgctcttgttgaccaggctggagtgcaatggcgtgatactttattttattttattttattttttgagacggagttttgctcgttgaccaggttggagtgcaatggtgcgatctcggctcactccaacctccgcctcctgggttcaagagattctcctgcctcagcctcctgagtagctgggattacaggcacctgccaccacacccggataattttttgtatttttagtagcagtgggatttcaccatgttggccaggctggtttcaaactcctggcatcaggtagtccacccgcctcggcctcccaaagtgctggaattacaggagtgagccactgcgtccagccatatgtaatactttagtaaataaaaagtaaaagggattgattggcattttcagtctttttttttatggctagagatgagttaaaaaaataaaattttagggctaggaaaagattttttatttggactttagaaaaatcagagaccagttttctctcttctgcttttttatttagctgggaaaatactgcaaaatttccccaattctttgacatgaaaagaagtaggatgtggcagcagttatattttcagattaatgaatagaagagatttcaggtcaacaagtgatttgcagagctataaagataatgctttgattgtgaattatttacagctggaaactcttactttcttatgcttctttgaactgtagaagggatgagatgtgataagctgtgtgtgtgggggtgtgggtgtggtttgttttctgtaagatgtagtattgagttcatgcctgccaaaagttgcttaaattattccatttctgattttgaggtactgtcgtgtttctgtcttgatttgtacttcattgccaactaattaatttaaaagcattgttgttttctcatggagaatatggttactatgctttgttcacatggagcagaatgtcaagtggtaatcttaattaaatatttataagatcatattcatgttagtgaatttctaggaataacacagccttttttcttcttttgtagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggttggttttgtcatttctttttttcgctccctgttttcgttagttttattaatttataattgctagttaggcttttttgctgaaagtaatttgggattatttttacacaggcttagttttttcaagtgaatttttaataattatttcccatatacttgatagaatcaaataaaaatagggtatgtgctggattttagtttgtttttagatacgttattttgaagaaattagacttttaaaagtatagtaggtgacagtattattaatgaatacagtgtattccagggttctgatgttttgagttgagaacatttagaattagcactttcttgattttcctttgttagaggatcctaaattattcctgacgcttaaattaactggggagactattggtaccaggattagtgtatgcaattctattaaataacaacctgaactcattatttgtgagtgagaattgatcatctttcccaggtcttgtcagagctgatttagatggaaagttctgattagttagtattgacctatatgtcctttcaggaatacatttaattgtgtcagttcatgtaacttctattaggtactgaataaagagctaagcaaattgggtaagccaaaagtaatgtgccaaaatattaatttatacattgtttcaactttacctagaattttgttgaatagttatcacacttagtgcatttttcagaaattaatgtcacagtgtaagggcaggtaatttattaatattaggccacacatttcctatcagcctggcatcactattgaagaacagataactaacacagtaaaaatcatcatggtttaagttagtgggtaactgtttccaaggttctgttgatatttagagtatagtattgatcttttttttttaaacatccaaccgggtcaacgtttctaacattttaagcagtgatgtcatacttgaattttttttttttttttttttttttgagacggagtctcactctgttgcccaggctggagtgcagtggcgtgatctcagctcaccgcagcctctgccccaagtgattctcctgcctcagcctcccgagtagctgggattacaggtgcccgccaccatgcctggctaatttttgtatttttagtagagatgaggttttgccatgttggccaggctggtctcgaactcctgaactcagttgatccgcccacctcggcctcccagagtgctgggattacaggcgtgagtcaccgtgtgtgaccgaaatttcttttaagacatattcatccctgtcacaatatattataatgtgtcagcagttttttgattactcaaacttgataagtatagcaattgtacatttgtcttcttgttagagttaatatgtatgatgtctgagtaaccagtaaaatgttatacttacctatgatctgttaactaactgtgtccatcatatggtattttcagtgtaaaacccagctcagtggttgggctactttggtaacccagtcttctcccccaagccatatgtcagatacttagtgtgaagtatcttagcaagttggttttctggcttttgtagatctgctttttgtgagccagtgcttgatgtcacttggtatataccatttttgagcatcatggcatgatgcttttttgtcacttgacttagcaactgtgtatagaatcatgagctatttggaagatcactgggcttctcttagtagatgtgggagagggagaatttcacatttctgagtcttggaatcccacaagttgagctggcatacaacctgatgagaatttcagcccttcccagatttgtagaaaaaatgcagttacagtctgatttttattttatttttatttttttaaaattaattaattaatttttttttttgagacagagtttggttcttgttgcccaggctggagggtaatggtgcggtctcagctcactgcaacctctgcctcccgggttcaggtgattctcctgcctcaccctcccgagtagctgggattacaggcctgagccaccatgcctggctaaatttttttgtatttttggtagagatggggtttcaccatgttggccaggctggtctcgaactcctgacctcaggtgatccacccgcctcggcctcccaaagtgctaggattacaagtgtgagccatcgcacccggccaagactggtttttaaaataattaaatatgtcatgtaatcacagtaattatatacctgtaccttattgatattatagaattagacatgaaatgttggcatttgtcccgtaagtgtaatattgaaatgaaaaatctcccatgtgatttcttgaacccttattcaaaaatatcacttgattaccaataataagattctctagctgattttaagagtgatgctgtttggccgggcgcggtggctcgtgcctataatcccagcactttgggaggctgaggcgcgcggatcacggggtcaggagtttgagaccagcctggccaatatggtgaaaccccgtctctactaaaaaatacaaaaattagctgggtatagttgcgtccccctgtagtcccagctactcaggaggctgagacagaagaaccgcttgaacccgggaggcggaggttgcagtgagctgagatcacgccactgcactccagcctgggtgacagaatgagactctgtctcaaaaaaaaaataaataaaataaaaagagtaatgttattttgatcaaagataggagtcctgatctttgaaggacattatttgctaaactataaatgtaaaggatcaaataatgtaggaaatgcatcccagttttttcctacataccagtcattagaatatagactatggtttgtttgtttgtagagatgaggtttcaccatgttgcccaggctggtctccaactcctcgactcaagcgatctgcccgccttggcctctgaaaatgctgagattacaatagactatgtgttttgaatgataaaatatgaatgagagtttggaaacttagtactactataaaagacaagaaaacttgatctgattttgtgctttgagattggcttttgtgattgttttttcttttttttttttttttttgagatggagtgttgctctgtttcccgggctggagtgcagtggcacgacctcagctcactacagcctccgtctcctgggttcaagcaattctgctgcctcagcatcttgagtagctgggattacaagtgtgcaccaccacgcccagccaatttttgtatttttagtatagatgggatttcaccatattggacaggctggtctcgaactcctgatctcaggagttcctgaggaggacttgatcatcctcctcagcctcccaaggtgctgggattacaggcctctgagccaccatgcctagcgggttttgtcttttgaagagtagttgttggtaggaacatcagatttttttctttgaaatgaactttaaaaaaacaaaaacattttcggctggtcacagtaatcccagcactttggaaagctgaggttggtagatcgcttgagctcaggagttttgagtccagcctgggcaacgtgacaaaatcctgtctctacaaaaattagctgggtgtagtggcacacgcctgtggtcttagccactccgggggatgaggtgggagaattgcttgagcccaggaggttgaggctgctgtgagatcgtgccaccgcactccagcctggatgacagagtgagatcctgtctcaaaaaaaagaacaaaaaacatttttaatgtatagttcaggggctttaagtacattcaccttattgtgtaatcgccacccgctctctgtctccagaacttgtaaattatcatcccaaattgaaatctatacccattaaacaaacttactctctgctcttactagctcctggtaaccacagttctactttctatctctgtgtgtttgactgttgtaggtatctaatataagtagaaaacacctgattttgttggcctaattatttttttagatttcttatttcttctttctctcttaagtgttaaagtgtcatcatggaacagaaacagatgaggaaaaaattggtaaccctagaagattttatgcttctgattattgaaagatgacagttttactggagcagtaagttagcaagatctaaactatattaatttctgttctttttctcattccactataatctttgccctggggagaaaagcaaaaccattatatatccacttagcattgtttttttcccccttttaagttgtttatgttgctatgttcatgtggacttctttggaggctgaagtcaagtggagtttagattttcctggcctgatttctacattaaaattaaactaatctaaacaccaaattatgaatacacttttttttcttaaacagagatgaggtctcactgtgttgcccatgctggtcttgccttggcctcccaaagtgctaggattacaggtgtgagccaccatgcccagaccaatacacctttttttttaaaaacatcatgagagtgctttctgcaatttcaaaaataaaaacaaaacaggcaaagagagaatcaaacctatctctagtgttaagtatgatagaattttgttattgttgcccaggctgaaatgcagtggtgcaatctccactcactgcaacctccacctcccaggttcgagtgatgctcctgtgtcagcctcctaagtagctgggactacaggtgtgcgccaccacacctgacttacttttgtatttttagtagagatggggtttcaccatgttggcccgcctagtctcgaacacctgacctcaggtgatccacccgcctctggctcccaaagtgctgggattacaggcctgagccaccgtgcccggcctaggtccgtacgtctatgtgtgactggtttctgaagattagactctgagttatcttactaatcgaatttcaaatcccagtgtcctcttaatataagtcttggaaagtggggaacttgtaggactttagaggctcagtgtaaaatatattactgttctttcttagctatttctcacataaaaacaatttctggaaagaaagccagaggtttaggtttcttgatataggatttattttctgtgtcatttgaggtttacttttgcatatattctttggtgtgtttttttgttgagaggcaaagcgaggagattgtgggcaagggaggaatatggtacagtattattggaagacttgaatgagtccagttaactatagcactcaggaggtcaaggttgcagtgagctataattgtgccactgccttccagcctggatgatagagcaagactctgtctcattaaaaaaaagaaaaagaaaataaaaattgggcttggtggtaccgtggaatcatccatccaacccctctgcctgactttgtgtgtgtgtgtgtgtgtgtgtgtgtgtgtatgtgtttttaatgagacagtcttactatgttgtccaagctagtcttactatgttgtccagctcctgggcttaagcagtgctcccatctcagcttcttgagttcctgggattccaggcatatatcaccacactcacctggcctatctgactttagatggtgtctctcttttctttttgtgtaattttactgaaaacaagatcatttactcagtataattaggcctttattttggcatgtagattattctgttaacttgctctgcatttagaatatatttggctgattttaatttactggtaataactgaatttccttgtgcatacttactctgacagattaacattgcacttttttgcagtggatttttcatttatttacagaaagatttcatggattcatttgtgttcttcaggtgcatagatgtttgtgcatttatctatattatcatacaagccattttaagtataggccattcaaatacattcagatacatacactggtacaaggatacactggttcatacactggttcaaggatattgaccaaagtgaaggagactcagactacccttggctcctaggtttgtaccattcttattcactttgggcattttggagaagattcccagaggcaaaacctgttctgacagaaactcagtactttgtagagttctcaacagaaagccaaaacctccctgtaacactgaaattttagacatctacatcttacatgtaaggaacttgaagatttctttagcagtccaaaaatatatgtatgttttttgagatggggtctcactctgtcacccaggctggagtgtagtggcgccatctcagctcactgcaactttcgcctcccaggttcaagcgatcctcctccctcagcctcccaagtagctgggattacaggcgtgtgtcatcacacctggttaagtttttgtatttttagtagaggtggggtttcgccatgttggccaggctggtcttgaactcctgacctcaagtgatccactcacctcggcctctcagagtgctgggattacaggcgtgagccactgcacctggcccaaaaatattcttttaatggctgtgtgggtttaaaatttttttttcctggacattctggcaggaaaacctgatggcagttactttgagaaggaaccttcagtgtctaatataaacccagttgtttcattggctggtctttctgagataatataacatcttatattttcatagtgttttggacttaccacgtgtgctcagagtatttctgatgaaaaaggaagtagatgattcttccaagattacatagctgcaaagtgaaagaactggattgaattcagtttagcagtggcatgatcttagctcacatagcctcaaactcctggactcaagcaatccttctacctctagtgtagtagttgggactacaggcatgcatcaccacgtctggctaatttaaacattttcagagttgggatcttgctttgttgcccatactggtttgaaatctgtcttctagccatcatcttgcctcagcctccagagcagctgggattctacgcacaagtcactgtgctcagcaggttgttttctatttctgttatgtctgatacaacctaatacaacacaatttgctgtaccatgagagactggacttgggacccctgtgtcttattctgttaaaatagccagaccttaattcattttaaaatagaagaaccatggcaaattatattcttgaacatacttcttccaaatttggatgtaattggaatcctttggtatttgatttttcagggttaattttaacagtaggagagtttctaaaaatagcataaaaatgtttttcagatattatacgtctaaaaagtctcagatttgaagaagacccttttgtcagatttgggagtatttttatcaaaacgtcgtcctaatacaggctaagaaagaaaatatagcctcgaacagttttgtgtatttttgtggatctttcttttttcttttttttttttaagacggagttttgctttgagtgcaggtttgagtgcaatggcgcaatctcagctcactggaacctccccctcccaggttcaagcgattctcctgcctcagcctcctgagtagctgaggttacaggcatgtgccaccacactcggctaattttgtattttcagtagagacatggtttcaccatgttggtcaggctggtctcgaactcctggcctgaagtgatccacccacctcggcctcctaaagtgttaggattacaggcatgagccattacaccaggccttttttggatctttctacacatttcaccccaatatagctaaacacagttaactttgatctctttacgcctacttcatttggtataaaattcactaggctgaagattttggtttttctttgaatctgaaggtgttgccttaatcgtgttactagacattattccatgtagagtctaaaccatacttaataaggctgtatcagatgtgatttcagacctgccattatctctatagtcatgtttgctcataggaaaaaaattagaagccagatactgctgtttctaccaaatttagtgattgagtgttgttaggtagaggcagtgcttatttcgaaggaactaaatcttatctttaagagtatttcagagtagggcgggggggtcacttaagaatccttttaacattaaggagaatccttctgtcaaaaaagttgttacaggaatgatgttgatattgttcccaaatactttctttaaggcatttctgtttacgtattaggttggtgcacaagtaattgcgttttttttcaattaatggcaaaaacggcaatgacttgtgcaccaaactaataatatgatttctgagagaattttaaaccaacccctgattcctcctctttgttacttggattgcagagtaacactttgaatctagtagtagttgtgtttttttttcttgagagatgatctgtctcttactgcccaggctggagtgcagtggcatgattatagcagttcattgtagccttgccctctccagtgcaagcaattctcccacctcagcctcttaagtagctgggaccacaggtgggcaccaccatgcctggttaatttttgtatattttgtatagacagggttatggcatgttgcccaggctggcctcattcctgggctcaagcaatcctcctgccttggccttccaaagtgctggggttagaggtgtgagccactgtgcctggtgagtctagtagtcttgatttcaaaaattgatagcattaattacccatgtgtgattattaaacaatattgaattaatttctatagcatttaagtttttttttttggagagaaggtctcactgtgtcacctacactggagtgcagtagtgccatcatggctcactgcagcctccatctcttggacttaagcaatcatcctgcctcagctgctagccctatgccccaccaccacccctgagtagctgggactacgagtgcatatgccattatgcctagccaattttttttgttacttttgtagagacagggtcttgctgtgttgcccaggctggtctcgaactcctgagctcaagccgtccccctacctcggtctcccaaagtgctggaattgctggtgtgagccaccacatcgggtgcatataagtattgctttgtattttttttctgttcctacatttatttttaaaagttacttttaactctgagaaccttggccattagtttataaacatgttctagggttgggaattttgagtatgaaggaggaaacgttatgacttcctttatctcatacttaaagaaactagcaaattcgttgtggagtcaggatatgcagtaacttctctaaacagtcttgtcaaatggcagtggtggtattgccttgttatacctatttgacataagatggtattgtttttgagtaaaaattgacctcaattatttgtttatagactgtcagtttttctagtctattaaaaattttattttaggctggctgaagaaagattcttcagttctttgtatatctttcttgtgttctatatgtatgtagtatattacagtcttcaaagtgtgactctgtaattgttcttaaccttagaaaagaacagagcctttcaagataatgattctttcaagataatgattgtggtagacccttctttacctgatgttgggaagcagttttcagtgtttggtttgatggaaatagcatcagttaggaaattgacatgtcactggtaggaagatgataaagattaatttgttagttttggtgctttccacacctagttatacttagtaccctgaacctagaatgtggatctgttatgaaagtagggtagctcatgtctgttgtttttattactatattcacttaatatttcgtattctatttgtttcattacaaaatttcatattccagacagggtctcaaatatctctctatgtcataatcgagatagaaataattcttcatgattagaacaatatgggaacaaatattgtcagtatgcatgtgagaccaggatatcaccagtaaaagattgtaatttgataattttcattcattctttgaagttgaaaatatcagtatcttctaattaacatttattggtcatttcattaatttttttatacctttaaaaaggtatatttttacaaaatatacctttcataaaaggtaaaaggtgtatttttcctatttaaaattaatagatgtttgttcttttgtgcagtaaatacaaaaatgtaaataatggcccatggtctcagttccaagggatatattgctaatattatatatatttccttctgaatggtattctgtgatcggtgtgttaattccttatcgaaggtgtggacagtagcattaagggtggcttatactaggatgttttgacagtttatgtatattaagcattttgattggcttgtacattcagtagctcttgtcagttgaagagttgtaacatgttaatttgaatgtatgaggaatcaaactcttcttgagataagtcatgaaaattaatatggttctgtttttcttaacaggtatttgtttgcttatggaaaggttgtaaagtatataacactccatctaccagtcaaagttggttacaaaggcatatgctgacacacagtggagacaaacctttcaaggtaaggatgcatgtatataaaatttatttatttatttatttatttatttatttatttatttatttatgacagaagagtctcactctgttgcccaggctggagtgcaatggtgccatcttggctccctgcagcctccacctgctgtgttcaattgattttcctgcctcagtctcctgagtagctgggactacaggcgtgtgccaccacacctggctaatttttgtacttttagtagagatggtgtttcaccatgttggccaggatggtcttgaactcttgacctcaggtgattctcccgccttggccacccaaagtgctgggattacaggcatgagccactgcgcctggctgttttttcttttaaatgttagcttaagctgacatgtttcctaataggcataattaaaagctcctctaaatttttttaaaaacaaccatttgttttaacattcttgtacacgcattgaatttcaaaagtagatggagataaagctcatttgatcaatttttttctatttgaagtacaggagaaatgttgctgttggattagggtcttgaaaatagctagtgggtagactaatgactggaagccatgttggttttttttaataccttgtggtctgattatgttttcttattgttaaaggtttcggcattttcattagcaaacaacattgactattatataaaataaataaattgtaggacattaaaggatttgattcctttcactcagttttgaggtcacactactgagcttagttgtaattagttgtaaatcacttttgtcaaattagatgtattctgggaaatctttataaagagcaagtttctgtaaaaatcttttccatttatctttatgaaaaattaagtattttggtttctatttatggaaagcagcatataccatagagattaacagtttatgtttaaaggagtttaatagttgttaaaaccacatttactggaatgaatactgtgccagttatttcccttgggttttgtagagagtgaggtaattcttgtggagttgcttttaaaaacaacctttttggaaaaagcaatcagcaagttaaaacattatagcaaaggtttacactaagaattatttgtctctctctttttcctgtttccccccttcctcccaaatatataattattatttgtttcttgtgattttttttctagtatttccttatgcaaccataagcagataaatatgtagtctcattctcctttctttcttacacaaagtctagtaaattaaatactgtctgtgccttgctttaaaaagaaacaaacttaattttagagcagctttaaatacacagattacttgtttttctatatacttgtttttctatataccaagtttcttccattcttgaaatactatattgtatatgggtaccttgcttttttgttttaatttgaatagtttttttttcccccctcaagatggagtcttgctctgttgcccgggctggggtacagtggcatgatcttggctcactgcaacctccgcctcttgggttccagcgattctcctgcctcagcctcccgagtagctgggattaccggcatgcgccatcacgcctggcgaatttttatactcttagtagagatggggtttcaccatgttggccaggctggtcttggactcttgacctcgtgatctgcccaccttggcctcccaaagtgctgggattaaccacacctggccctaatttgaatagtttttggggaacaggtggtttttggttacattggataaattccttagtggtgatttctgagattttggtgcacctgtcacctgagctgtgtacactgtacactgtacccactgtgtagtcttttatacctaaccacccccacccttccctcctagtccccaaagtctattatatcattcttatgcctgctcatagcttagctcctaattataagtgagaacaaaacgatatttgattttcctttcctgaattacttcacttagaataatggtctccaactccatccaggtttctgtgaaagccatattttgttccttcttatggcttgagtagtattccatggtatgtatgtatgtatgtgtgtatgtgtgtgtatatatatatatactgcattttctttatccacttattgattgaagggcacacttgtgtgtgcaagtgtctttttcatataatgacttttcccagtagtcattcatataatgactttttcccagtgtcattcatatagtgacaatcccagtagtgggattgcaggatcaaatggtagttctacttttagttctttaagaaatctctgtacggttttctatagtggttgtattatattctcaccagcagtgtaaaagtgttcccttttcaccacatccatgccaacatctgttgttttttgccttttaaattatggccattattgtaggaataaggtggtattgtgttgtatatcttcttttgagaaatgcttattcatgtaatttgcccacttttcgatgggattattattatttttttcttgttgatttctttgagtgccttgtcaattttgaacattagtcctttgttggatgcatagtttgcaaatattttctcccattctgtgggttgtctgtttattctgctgattatttcttttatgtgcagaagctgataatctgctgattatttctttttatgtgcagaagctttttagtttaattaggtttcatctgtttgttgttgttcttattgcatttgctttagggttcttggtcataaactctttgcctaagccaatgtctggaagagtttttccaatgttatcttccagaatttttatggtttaaggtcttagatttaagtctttgctccatcttgagttgatttttgtataaggtgagaaatgaggatccagtttcattcttctacatgtggcttggcagttatcccagcagcatttgttgcaaagggtgtcctttccccactttatggtttttagtttttatttttttgagactgagtctcgctctgtcacccaggctggactgcagtggtgtgatcttgacttactgcaacctctgcctcccgagttcaagcaattctcccgcctcagactcccgagtagctgggattacaggtggctgccactatgtctggctaatttttaaatttttagtagagacagagcttcaccctgttggtcaggctggtctcgaactcctgacctcaagtgatccgcccgccttagcctcccaaaatgctgggattacaggcgtgagtcaccaatatttggctttatttctgggatctctattacattggtctatgtgtctgttttattccaggaccatgctgttttggtaagcatagccttgcagtataaaaagtcagataatgtgatacctccagatttgctctttttgcttagtcttgctttggctatctgggctctctttcggttccatatgaattttaggatagtgtgtttctagttctgtgaagattgatgatggtactttgatgggaattgcgttgaatctgtagattgcttttggcagtattgtcatattcacaatattaattctacccatccatgagcatgggatgtgttttcatttgttggtgttgtcgatgatttctttcagcagtgttttgtagttttccttgtagaggtctttcacctccttggttaggtatattcctaagtattttatttttttgtagcttttgtaataggggttaagttctttagttgtttctcaacttcgtcattgttggtgtagagcagtgttattaatttacgttgatttttgtatcctgaaagtttactgaatttatcagattacaagctttttggatgagtctttagggtttcctaggtatatgatcatatcgtcagcaaacagcgacagttttatttcctcttacctattcggatgtcctttatttcttttctctgattgctctggctaggacttctagtacttatgttgaatggaagtggtgagggtggaccatccttgtcttcttccagttgtcacggggaatgctttcaacttttccccgttcagtagaatatgggctgtgggtttgtttattacgttaaggtatgttacttctgtgccagttttgttgagggttttaatcataaagggatgctggatttttttgttatatgctttttctgcatctattgagatcacatgattttcagttctttttatgtgatacatcacatttactgacttgtgtatgttaaaccatctctgcatccatggtatgaaacccacttgatcatggtggattatctttttgataggctgttggattcggttagctagtattttgttgaggatgtttgcatctgttatcagggatattggtctgtagatttatttttttgttatgtcctttcctgattttggtattagggtgatactggcttcatagaatgacttagggaggattccctctttctctgtcttttggaatagttacattaagattggcaccagtttttctttgaatgtctgatagagttcagctgtgaatccaactggtcccagaagggtcgtgtatttcccagagtttatcctctcctctacattttctacttcgtgcatgtaaaggtgttcatagtagccttgaatgatcttttgtatttctgtggtattggttgtaatatcttttgttttgtttctaattgggcttatttagatatcgttcttcttttcttggttagtttcactaatggtctgtcacttttgtcttttcaaagaaccagcttgttcatttaccttttgtattgttgttgttcttttggtttcatttagcaccactctggtctttgttatttcttttcttctactgggtttgggttttgtttgttctttcttgtttctctagttccttgaggtatgaccttagattgcctatttgtgacctttcagacttttctttttttttgagacagagtctcactctgtcgcccaggctggagtgcagtggcatgatctcagctcactgcaacctctgcttcctgggttcaagtgagtctcctgtctcagcctcccaagtaagctgagattacaggtgtgggccaccacacccagctaagttttgtatttttacagggtttcaccatgttgcccaggctggtctcaaactcctgacctcaggtgatccacctgcctaggcctcctaaagtgctggaattatagacgtcaaccaccttgcctggcatttgatgtaggcatttaatgctatgaacttttcctcttagcaccgcttttgctgttgcccactggttttgataagttgtgacactattattgttcaaataattttttaatttccaccttgatttcattgttgactcaaggatcattcaggagcagattatttaatttccatgtgtttgtgtagttttgagggttccttttggagttaatttccagtttcattccactgtggtctgataggatacttgatataatttagattttttaaaaaatttatagagacttgttttgtgacctatcatatggtctatcttggtctatccatgtcctgatgaaaataatgtatatcctggccaggcatggtaggtctcgcactttgggaggccgaagcaggtggattgctttagctcaggagtttgagaccagcctgggcaacatggcaaaaccttgtctcaacaaaaaataaaagaattagttgaacatggtggtgcacacttgtagtcctagctatgcgggaggctgaagtgggaggattgcctgagcctgggaggcagagattgccatgagccaagattgtgccactgcactttaaccagggtgacgggcctcaaaaaaaagtatattctgcagtttttggtagaatgttctgtaaatacttgttaagttaatttgttacagggtgtagtttaaatccattatttctttgttgactttcggtcttgatgacctgtctaatgctgtcagtggagtattgaagtcccccactattatttggaaaacttacttgaggggaataactgaggaaaacttccctggccttgctagagatgtagatatccaaatacaagaagctcaaagaacagctgagaaattcatcacaaaaagatcatcacctaggcacacagtcatcaggttatctgaagtcaggatacaattattattacataattatgttgctaggattattattattttactgtgtttattgtgttgctgtctatcctatttcttaggtttagtaattattttataaatttgggagctccagttgggtgcatatatatttaggattgttattttcctgttggactaattcttttattattatttaatgtcacctctttgtgggtttttttttttttttttttttttttttttttactattgttgctttaaagtctgttatatttgatataataatagctatgcctgcttgcttttggtttctatttgcatggagtatctttttccacccctttaccttaagtttatttgagtccttatgtgttaggtgagtctcttgaagacagcagatacttggttggtggaattttatccattttcccattccataccttttaaatgtagcatttaggccatttacattcggtgttagtattgagatatgaagtactgttgtattcatcatgcttgttgttgccttaatagctgtttttttttcttcattgtgttattgttttataggtcctatgagatttatgctttaaggagattctttttgtcttgtttttgtcatggagtctcactctgttgcccaggctggagtgcagtggcacaatcttggctcactgcaacctcagcctcttgggttcaagcaattctgcctgcctcaccctcccaagtagctgggattataggtgcccaccaccacgcctggctaatttttgtattttttactagagacagggtttctccatgttggccaggctggtcttgaattcctgacctcaggtgatctgcccacctcggcctcccagagtgctgggattacaggcatgggccactgcgccctgccaaggaggttctattttggtgtgtttcgaggttttatttcaagatttagaacttcttttagcatttcttgtagtgctggcttggtagtgacaaattctcttagcctttgtctgaaaaagacttgatctctccttcatttatgaagcttagttttgctggatacaatattcttggctgataattattgtttcaggcagcagaaggtggtaccccagtctcttctggcttgtaaggtttctgctgagaagtctgctgttaatctgataggtttttctttataggttatctgatgcttttgtcccacaactcgtaatattctttcctgcatcttgactttagataacctgatgactgtgtgcctaggtgataatatttttgggaggaatttctcagttgttctttgagcttcttgtatttgggtgtctacctctttagcaaggccagggaagttttcctcagttattcacctcgagtaagttttccaaacttgtagatttctcttctttctcagaaacaccagttattcttaggtttggttgtttgatgtaatcccacatttcgtggagactttgttaatttttttttaagtgtcttttctttgtctttgtctgattgggttatttcgaaagccttgtctttgagctctgaaattctttcttctactgttattgaaactttgcagtgcatccttttttttttttttttttttttttttgagaccgagtctcactctgttgcccaggctggagtgtagtgatgctatctccactcacttcaacctccgccttccaggttcaagtgattctcttgcctcatcctcccgagtaactgggattacaggtgcccaccaccacacccagctaagttttgtatttttttagtagaggcagggtttcatcatgttggccaggctcgtcttgaactgctgacctcaggtgatccacccgcctctgcctcccagagtgctgggattacaggcatgagccactgtgcctggccttcagtgcgttttctgtttctcttaagtgtgccttttatttctagaagttgtgattgttgtttcttttcttttctttttttttttgtgaggcagagtcttgttctgtcacccaggctggagcgcagtggtacagtcttggtttattgcaacctcccaccttcacctcctgggttcaagtgattctcatgcctcatcctcccgagtagctgggattacaggcacttgccaacatgcctggctaaattttgtatttttagtagagacggggtttcaccgtggtggcaaggctggccttgaactcctgaactcatttgatctgcctgcctcagcctcccacagtgctgggattacaggcatgagccacggtgcccagcctccagtgcattttctgtttctctaagtgtgacttttatttctagaagttgtgattgctgtttctttatgatattttttctctggagaatttttcatccgtatcctgtattgttgtctttaatttggttttcacctttctctgatatctccttgagtatcttaataatcaaccttctgaattctttatctggaaattcagaaatttattcttggtttggatacattactggggttatagaaccctgttttgtcatattaccagaattacttttctggttccttctcatttgtttagactatttcggtggaaaagactggatctcagggcctgctgtctcccacttcctctagggatggggcttcctgagagctggactgcagtgattgttattgctcttctgagtgtagccatccagcagcagggctactaggctctgggatggtgctggggaatgcctacaaggagtcctgtgatgtgattcatcttcaggtctccgagctgtggataccagcacctgctctgctggaggtggcaggggagtgaagtggactctttggtggtgttcggttgtagatatgttgagtgtacttgctttcttgaatactggttatgctagcaatgaacttgtaatgtggacacactcaggacctctggttggccaggatgtcgcaggcagtggaattagctgttgttttccgcttcctgggatctgggttattctgtcatgagttgctctaatggcctgaattggttggcctccaaccaggaggtgacactttgaagagtgcaccagttgcagtagtagttaagtagggagattgcttgccctaagttggcctgggcaagtattttggcttctggcgagatgggtggggctatgtttcctgttctgctaaaggggcaggtagagaaataccatcaggtgggagcagggttaggcggaactgggctcagactcactttcattaggcggggcttgccacagccactgtgggagatagggcgttggttttcaggccagtggggttatgttccataggggattttggctgcctctgctgtgtcatatagttcaccagggaagtggggggttgtgagagtcctggttgcgagagacctcattcagctcccatgcagtgggtgaagccactctcactcccttggtgtactgctcagaccttgccccaggcttccctgctgagaaagcaaggccttcagacctcgcccctccccgtctgcctactctgtcagcagctctgcgctggtatctgcagcagttcctgttccctcgccacctcccttttctgctcaagaaaatccatgtccagctgaaattgttactatctcatttagaagcttcttttgccctgttacccttccctaattctactggctgtcttctgctagtacccttgtgagatatagtcggggatggcttccctgggctctagctagaggctgggaatgcttacaaggcatttcccactgctgcttctacttttatattttgcacgttcccttaaatctgtttcagccctaggtaaggttaaatccgtctcgtctcccatgatctggattttcagattccccagtggggttgtgtgtgtggaggcaggttttctctctcttacactttgggaactcacagttttttacctgtctcacggaatttgcagcagtgtaccgcttctttgaaaggatctgtgaattttttcggtttgcctggtatattcctggggtggttcttgaagcaaaagttcacggtgcgagtctccacatggtgttctctctgccaaagtgggagctgcatgttagccctttctcctatctccatcttcctcctcccgattgtaccttgctttttgaatatactttatgctgggatcttttcatatcagttcatagtgaatagtctcattttttcagcttcatcgctttccattgtgtaatattagcggtttaaccaaactttgtagatacacttgggttgcttcttgtcttattgttacaaatagtgctatagtgatgaatcctgaatatgtatcattttgtacatgtataattatgtatgtaggaaaaatcccctaaaatgatgtgagtgggtggatcaaaggttaatgtaaacattgctaattttgataacttgccaaattgtcgttccctagagctagtgccgtcatcagtaatgttagagtgtctgcctaatgttggagtgtctccaaggctttgctgagagaggattgtcaaacttttggatttttgctaatctcataggtgagacattacatctttttgtttgtttgtttgttttttgttgggatacagagtttggctctgtcgcccaggctagatggagtgcagtggcatgatgtgggctcactgcaacatccacctcctcagttcaattgattctcatgcttcagcctctggagtagctgggattacaggcaggcaccacaacgcccagccaatttttttttttttttttttttttttggtatttttagtagagatggggtttcactacattggccaggctggtcttggacttctggtgatccgcctccccttggtctcagagaagttacatcttaatagtttatttttttgagacggagtcttgctgtgctctgttgccaggctggagtgcagtggtgtgatctcggttcactgcaacctccgcttcccatgttcaagtgattctcctgcctcagcctcccgagtagctgggactacaggtacccaccaccacgcccagctaatttttgtatttttagtagaaacggggtttcaccatgttggccaggatggtctcgatctcttgacctcgtgatccgcccgccttggcctcacaaagtgctgggattacaggtgtgagccaccgcgcctggcccatcttaatagttttaattagtatttctttcattatgggttaggttgaacatcttttcatatgtctaaccgttcagattttttttcttaattttttttttaagtaagtggtctctgaagaaaaaaatgaaggaggtagtaaatgaataaatgaatgaataagtaaatcaatggtctaattaattttctggggcacaggtcctattactttaacaccccagtgtttcctgtagtcatactgcagatcttggccgtgacatttgctggaaatgtgactgcgaactgcttttttaacttcctgtctaatgtgtagttggtagtactaattacatcatgaagttcttgttcagtgtgtgcacactaaatataagagattatttattaaagtaaaagaatcatttaaatcatttacatcttcattgtatttccatgtgtgtatgtgtgtgtaagtatattttaaggcagcctttctgctggttgatgatgatgtatatgcaggttaatttcaaagcctatacaaatgttttgtgttttttgttttttccaaatcctcttctagaaactgtagacgtttcctattggagaggggaaagaaattgtctttgaaagaaaaaaagttaaggtatatgatttagtgaggtattgttccatacatgaatcataggaattatttaaatcaacaaaacattgatgtctgaagtacctggcactatgctgggcaatatggaaacgaggtaatgagaaaaacagagtaggccgggtgtcctggctcatgctgtaatcccagcactttgggaggctgacacaagcagattgcttaagcccaggagtttgagaccagcctgggcaacatgacgaaaccctgtctgtacaaaaaaaatacaaaaattagccgggcgtgttggcatgtacctgtagacccacctactcaggaaggtgaggtggaaggatcacttgagtctgggtgtttggggctgcagtgagctgagactgcactccagcctgggtgacagagagagagagagagaccctgtctcaaaaaaaaaaaaaaaagaaaagcaggcctctatactcagggaacttgtagtctctgggtttatacagatctaaagaaacttaaataatgaaatgtaagttcttcaatagtgacctatgagattctctgggttagggatcaattaaattataacaggggctgggaaaggatagtagaagatgagtggcaggtgactatagagagaggaagtgataaggtgatgtttgaggtgagcctctgcttttttttttttttttttttcattttgtttgaaggtctgatataatgtatagttgtgtctaatgcacacttgtttaacagtttaatgatttgtttcttatgttcgtatgcacatttgtaactaccatcctgatagagaatatttcagtaagacaagatttctaatgtccttttctggtctatctcttctcctgccctccacccatctgcccagactatattctaatttctttcatacttactttatgaactcttgtatgaactcttagttgtgtgaactcttgtatctggctttttgttcactcaacaaaatatcagcgagatttgtacgaattgtatcaagcagtcatttaaaaacattgctctgtagtattccactgtacagataaatccattcacttccttttgggcatttggattgtttccaatcattggctgctatttttttttgttttgttttttgagacggggtctcactctgtcaccaatgttggagtacagtggcctgatctctacgcactgcagcctcaatctccctggctcaggtgttactcatactacagtctcccaagtagctgggattcaggcctgtgctaccacgtccagctaattttttgtagagagagggttttgccacgttgcccaggctggtttcgaactcgcaggcccaagcgatcctccccctgtgacctcccaaaatgctggcattacgggcatgaggcaccatgctcgaccatctttggctactattaaccaagttgccccatggacattcctttacatgtcctctaattacacacacatattcattcctcttaactatatgatatcttaatactaccagtcctttcttttcttttcttttttttttgagataaagtttctgtaacccaggctggagtgcagtggtgcgatctcaaatgtaacccccacctcctggcctccaacgatctacccgcctcggccttccaaggtgctgggattacaggcatctaccgatccttttaattttggccattctagtggatgagtagtggtatctcactgtcgctttaatttttgtttcagcaatttgcaatgatgttgaccacattttgtgctatgggtatctgaatattctattttgggtgaagtgcctattcaagtctttgccaattgtgttcattgggtggtttgtcttttattattgagttaatagaaattcttcagaaattttgaatatgtcttgtgttagatatatgtattataaataaccttctcctagtcttcggttatccttctccctgtttctaatggagtctattgtgttatggtgaaaagggggatcatttcaggtatttttttttaagtacataatttatatacataaaattcaacatttttaaggttactgtagttcagtgattatttagtatattcacagttttgtaaaattattaccactgtctggttacagaaagtacgtatgcttttgaaagagaaaaaaggggccaggtgcagtggttcacacctgtaatcccagcactttgggaggccaaggcgggtggatcatttgaggtcaggagttcgagaccagtctgaccaacatggtgaaaccctgtcttttctaaaaatacaaaaattagccaagtgtggtggcatgcacctgtaatctcaggtacttgggaggctgaggcaggagaatcccttgaagctgggaggcagaggttgcagtgaaccgaggtcacgccactgcactcgtctgggtgagagagcgagaccccaccttaaaaaacataaagaaaaaaaaagagtgaaaaaagggagcatttaaaaaagtgaactgtttagggaagagcatgtagtttcatatatgtaagcgattattgtagcaatttgaaaatatttaaaaacaaatatttctgattagtgagctttgattatctagaagttaaatattaatgcaattggtgaaaaaagttgagatctcatgtttgttttgtggtgcgcaagatgaagtaagggtcagaaagaattatagcaaagactcgattgatgcattgcagagccttgcacattgcatatgtatattattatattacatattttgactaaattaattcttacaataattctttgagttaattactgttgttgccctcattttttacataaggaactgaggcaagaacagattaaatttttttttttttttgaggcgtagttttgttctgttgcccaggctagagtgcagtggtatagtctcagctcactgcaacctctggctcctgggctcaggtggtcctcccacctcagcctccaaagtagctgggaccacaggcacatgcctggctaatttttgtattttttttttttttttttgtagagacagggttttgccatgttggctaggctggtctcgagctcctgggcttaatcgatccgctcacctcggcctcccaaagtgttggaattacaggcgtgagtcatcgctcctatccatattaaatattgtttgtggtcatggtcagtggcagattctgaatttcagaggcagaaagaatccggggttgttaattatgttactctggtgtatttgtcgaaaccaagaaatcaacatttctttttggaatttttcttcctttagatcgcctcctcattatttgtaagactggtgctttctgatttgtgttctgatagccccttgttgatcttcagaaggacttctgggaatatgaataagatgatcttagcacttacaaagacagtcttagtattgcttcgtccaaataaatttgttcggaaaaagaaaaaaccagttcagtaattctgtgtttcaaattttagaaaagctacttggccaccagcatattttttttttgttatttgagatggactcttgctctgtcacccagagcaatggtgcgatcttggctcaccacaacctccgcctcccaggttcaagctattctcctgcttcatcctccaagtagctgggattacaggcatctgctaccacgcccggctaattttagtatttttagtagaggcgtggtttcaccaagttggccaggctggtctcaaactcctgacctcaggtgatccacctgcctcggcctgccagagtgctgggattacaggcgtgagccaccatgcctggccaacatacattaatatatagggtatttcagtgggagaccacatttaaaacagtcaatgtttgtattagtccgtttttcacactgctataaagatactacctgagacttagtaatttataaacaaaagaggtttaattgactcacagttctgcatggctggggaaacctcaggaaaactacagtcatggtggaaggtgaaggggaagcagtatctcttcttcacaaggtggtggcagagagagtgcaggggaacctgccatttttaaaaaccatcagatcttgtgagaactcccacactatgacaagaacagcatcggggaaaccgcccccgccatgatccagtcacttgggaggtttctcacccagtacatggggattataattcaagatgagatttggatggggacacagagccaaaccatatcagtgttcaacaaccagctttcccctcatcattgaaatcggtttctttttcatcagaacaccatgtgtagtggcttgagttcagtgatgatatatttatgagtgaaaatataaaacatatttgaaaactaaaaccatactcagcaacatgaaatgctcatgtaaagaggatggtactagactatttgaagcaacagcagatttgtctctgcctcatattctgtgtaggatgttgattagttgatgcctaaaattattttttcctttagcagagaagagtttgtatttaagtgaaatatgtgtgattctattatatttttctttaatgtaagcactctttagttctaaattttacttctgtttttttttaatgatttttgattgataaatgaccaaaatcaaagataaaacaattttctgttagaattctcattactggtttcatttctagagactgaatcattgataattaaaataaactttttttttttttttttttttttttgcatgggggaggttagagatggagtctcccttttttgcccaggctagtctcaaactcctgggctcaagtgattttcccaccttggcctcccagaatgttggaattgtgcgtgcacttggactaaaataaactcttgatggtaacattactctctgagttctagatgctactagggcctattctttgctgtctggaaggatgctgggacaaaatgactcttaagacttacaacatttctcaattcagactagccaagtttcaaatgcttagaagttacctatatctaatagatgtacgtattgaatggtacaaaactaacccattagggtaattaaacactctcaattcaagtatcaagcaattttgagtatcaggttttttatcgtgactgagtgtcactctgttgcccaggctggagtgcagtggcatgatcttggctcactgctctgcatcccaggctgaagtgattcttgtgcctcagcttcctgagtggctgggttacaggcttgtgccaccatgcccggctaatttttttttctttttgagacagagtctcacttctgcccaggctggagtgcagtggcatgatctcagctcactgcaacctccctggctaatttttgtatttttattagagacagggtttcactgtgttggccaggctggtctcaaactcctggcttcaagtgatccacccacctcaacctcccaaagtattgggattacaggcatgagccactgtgctcggctcaggttttaaattaaaagttaaattggccattatggaaatgcagttgaaaaccacaagataccacttcacactcactaggatgattttaataaaaaaatggaaatagtgttggcgagaatgtggagctagctggtgattatacaacattgtgaatacactaaattccactgaattgtacactttcaaatggttaattttgtgatgtgaatttcactttaatgaataatattaatttaaatgaaataaagttaaaaattcatttactcagttacaataaccatatttaaagtgttgagtagcaatatttggctagtggttcgtaggtttgcagtgaccttggcagtggaccaggtagttctgtggcaacgtggtactctacagaagagatggcagctttaaaaagcgttattatttcttggtactcaaaatatgtgtggtaaaattttaaattttaaatatagaaatcattaaatgctgacttctcatggtcagagtctgtaggtgaaaattcttgatgcagcctatttgaggaccatgccattcttagggttgttgtatgaattaaatactaatttcagagcaatgaatatggctaattgcctctattcagggtttcccatagccctgtgctttagttaggccttactgtactcctttgaagttatactgctttatatgtatgttttgcggaacatatagaagctcttttagtgtagtatctatatcttattcatctttatccttctagcatattatgtaatactggacatagataagtatttgaactaaagtcttgaatcatttctacctcttttttaacttagtgtgcaccatagagtaagtaaacatttttcatagagacgctgagggccataaggagcccccaaaatatattttgtatgtcaaaatagagtaattattaatggataccatataagaagaatgtgtgatttttttttttatcagcatcagtaaacatataactgttctgctaatatacttagtaatatctatgatttgcaagatgcttctgggaatataaatattcataaatatacatctctgtgttcaaaatggaaagtgtgagttgacatagatatgcagtgaagtgtgaggacagcctcaagggagaattagctcttgtccatttgtggcagatttagagagactttatgaggaaagttatgatttttacaaataaagggctgtgttgtgattttagcagcttacaattggtagaggtacctcgattgaaggaaagagcctgaggcatgtgatttttttaaatgctattatctagatgaacttttacaagatgaaccgcctggggataacaagatgaatatatttggtttttaacatgacacatttatatgcttagagtttggtaagtcaaaaactaagtaaattggttaaatgactaatggaaaagtcattatccatccaactgtggatattttctgttttgttttgttttaattaccacgattcatttgttagaagacctgcaaatttttttcccccaagatataattagaaatcacacacttataccgcagttaatttgtatatattaattctggtgctacctgaacattctgcattctttgttaaaatagcacatctgtcaggtgactcgggtagttaaccttttgatttcttaacattgcaagtacagaaggctaaagaggcagtatttaatggatattgtagagggcggcatatgaccaacactgagcatgtcttttctaagagagaggctagatctaattgtttaacaaattaaaaaatttatacaaacaaaatataaataaaaaaacaaaataaaataaaaaaaatttatttatttttaaaatattaaatgtagtccgtatgggttttcatttgaagtttaagaaatttataagaaagtaatttacaaagacaaggcaggtgtggtggtgcacacctagctctgtggggggcctaggcaaatggatggtttgagcccaggagttcaggaccagcttacccaacatggtgaaacccccttttgacaaaaaatgcaacaacaacaaaatattagtagagtgtggtggcgtgtgcctatagtaccaccacctgggaggctgaggtgggaggatcacttgagcctgggaggttgaggctgcagtgagccgagatcatgccactgcacttcagcctgggtgatagactgagaccctgtctcaaaaaaaacaaaacccaaaatacaaaatacattaaaaagtcaatattgaacttttctctcacctgttttaatagtgtgtaacactaggaagtctgctgaaggttttgaagtagcatgtaacgtaaaaaaaatactttaaaaatccagaaatacagctggcttacacctgtaatcccagcactttgggaggccaaagcaggcagatcacatgaggccaggagttcgagaccagcctggccaatgtggtgaaaccatagctctactaaaaatacaaaattagccaggcatggtagcacacacgtgtaatcccagctactcgggaggctgaggcacaaaaatcacttgaacccaggaggcagaggttgcagtgagcggagatcacaccactgcatcccagcctgggcaataacaatacgctgtctcaaaaaaataaaaataaaattcaggaatccagtcattgccaggatatctaattatttgttgcaaaaacagcttagtgcttctgctataacaatgattaattcaaaaccagatttttctgggaagaagatcccattatttttgtattgcatatagtggaaatagcagtaaactgggaggtcgtgaaacttgttgcattttcaagctttgtctaatgtatgtcatcttacttggcaacttacttcgtaaagtgaaaagactactagtcccttatgcttcctttctggaattagttctattgtactacttatttacttccgaaaatactagatattcactcattgatattcttctcgtgccctacacagcatgcctgacgttatttctgttttattttcttttagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattacgtaagtgttacactgagaaaatctggtgtatttcatggttttaaaagatatcttagacttttatgcaaatccactttgaacttcaactcctcttctattaaaagtaacaaacaggtaggatgcctgtctgtcagtgagagtgagaattcagtggcacatgtttgtagtagctaagggagtatatgtggccttcaaatataaactgtataaaattagatttgggggctactctgattctcttccaaaataacatttaaaatatagtaacattggtatttctagaaatattttagaaaatttgaacatgttaaaagtaaatatcaagtgaaagttaagtaatctatctactccaaagtagtgtgtgtacctgagctgggaggtagaggctgcagtgagccgtgatcgcgccaccacacttgaacctgggagacagagtgagaccctgtctcaaaaaaccaacaacaaaaaaaaccaccacaaagcaatgtgtgtggataacaaagcagtgttgctttttttttttttttttttttgagatggagtctcgctctgtcagccaggccggagtgcaatggcgtgagacagggtttcactgtgttggacgggctggtctcaaactcccgacctcaggtgattgcctgtctcggcctcccaaaatgctgggattacaggtgtgagccaccacacccagccgatagcaaaacaatttgaatgtaatgggtgtcatagtacctagtctattgtaacatatgtataatgtttatgtgtttacttaccaaaatgtatccttgatgtttaggatagaaaataagtagatgataaggcttgtaaatgctgggagtaggaacagactttgcaacctcagagtgtagctggtcactgcttctttgtgtcagctggttagtttgtggctttattttattattattattatttttttgatggggtctcacactgtcgcccaggctggagcgcagtggtgtgatctcggctcactgcaacctccgacttccgggttcaagcagttctctgtctcagccttccgagcagctgggattacaggcacccgccaccacgactggctaatcattatatttttagtagaggtggggtttcgccatgtggccaggctggtcttgaactcctgacctcttgatccacccgccttggcctcccaaagtgctgggattacaggcatgagccactgtgctcgagcagctggttagttttaactacatatcctcaatgaagaaataccaatgggtgaatgagtgaataaagctttcattgaaagggagtctactccaaaggtgaattagaaagaaaaaatagattgtactttaccctttttctctggggattgattagtatagacaagactccagacactaattccagactacgaaattagtctgtaaaacattgaaatctttttgttactacagatttatagcggacaaatgaacaaaccagaaaactttatatttcgtttttattttttttctacctcattaactgagaaaagtaaactttcttaaactctcttaaatttcattcttgcttttttttttttttgatacagggtcttactcttgcccaggctggagtgcagtagtgagatcatggcttaccgcagtttcagactcctgggctcaagcaattctcccacctcagcctcccaagtagctgggactacaggcctgagccaccatgcctggctagtttttatttttggaagagatggtgggggtctctctgtgttctccaggctggtcttgaactcctgggctcaagtgatccttccacttcagcctcccaaagtgctaggattacaggcatgacccaccatacctggccttaagtttctttttgttaaagtaatcatgtttaattttaatcaacgttggctatttatggtaccattttcattttgacatcctttataaaaacagaaatttagcattgcgatcattttacttgtgttaatatcaagtagcttgcagttgcacacagaaaattgctaaatatatattatggtactcaaaaaccagatgacttttccaccagtttcacctatcctcattattattttagtctcagtgtatacagtaatcatttaaattttctgacttttcacattatatacttggaaatatctatgcaattcgctactctttgtcttgtaaagagaagagagattcagttaaatacccagttcttgcttagaaacaaagtactggtgccggcttaagtatatgtttcttttgacggtggtgtttttcctcatattaacttagctagtaaggcaggctgcgtagggagagttggcagagagaggtggtggatgaaaatacctttttgtcatctgttttattgaggagaatggggttagtcctgaatatattactttataaactttaaaaaggatccaaggccttttcactgtggggagccattgttaagacagtgctgtgatttgaattagcatggttaacagctgctgcatttcactctttctttaaaagcatacatatctgtagcagttaactttacctagtatcttcctcatgtaattcaagaagacagtttttacgaaactgtgaaaaatataccttataaatagcagcactgcagcaaatgtaattttctgtttgataaaatttgttttttttttaacctttttttttttttctgagacagggtctctctctgtcacccaggctggaatgcagtggtgcaatcatgactcactgcagcctcgacctcctgggctcaggtgattctcccacctcagcctcccaggtagcttgggctacaggcacacaccaccacacccaactaatttttgtatttttttttggtagaagtggggttttgtctttttgaccaggctggtcttgagctcttgagctcaaatggtccacccatctcagcctcccaaagggctgggatgacaggtgtgagtcaccgcacccggcctgataaaatttatatatatacatatttttaatttttatttattttttcattatttttaaaaatctttaaaatatatttttaatgctttttaaatatactttaaagtggaaagaatagtataataaatacttgtattgctcttcacttagagatttaccaatatggtacatttgttttatcttcctacctatatacttttttggtcatggacccaaaattcttaagatgcatctcctaagaataaagatatttttctgcataaccacatcatcatcattacacctaaggagaagataaatcatacaatatatgtaattttgaaccatgggaaaatagtttctatttttgtggtttccaaaggtgttttttttttttttttttttttttgagacagagtctcacacttactgcccgggctggagtgcagtggtgcgatcttggctcacagcaacctgtaatgttaggttgtcagtttgtgatctttcaacctttttgctttgttctgtttttgttttttgtttttttgagacaaggtctcactttgttgccgaggctggagtgcagtggtgcaatcttagctcacagcaaccagtgcctcccaggtgcaatcaattcccgtgcgtcagcttcttgagtagctgggactaccggcacacactaccatgccgggctaatttttgtatttttagtagagatggggttttaccatgttggccaccaagtctcaaactcctggtatcaagtgatccgcctcctgccttggcctcccaaagtgctgggattacaggcatgagccgctgtgtccagcaccaaaggtttttgattatatatcttattagttaaaaaaatactgagcacacagtcttaacgtatgtaatttatacattgtatacgggtaatactactactgcacattatacaaaattgccaagaaggaatattgaaaaagaatgagatgaagaaattaacaagggtattctattctttacgtactctaatggatcatgacacacacctactttggaactactgttctagtttggtattcttgataaatgcagtggagatagtgtggttaaggtctgaatgcataggctgaagattgaggactcctttcattattgtgaatttaagtgatggcttcaatgtttaaatttgagtgaggagtggttaattttagtgatttagagtgatgagttattattttccccaagtgtttattcttaggaaaaagcatatatttggagagcttggagaaagttacacattttttttcgagtagccacttatctaacaggaaagtgatgtatttctcagaactctcccttgctcacccctggaaatgtcaagtacttttttctttctgatttctcattgtcactgccttcttagtcttttggcttctgctcgtttattactagttggtgttttgtttattttttcttgaggaaatatctagagaaaagacctgtttgtttaggtatgttctatttgatgtgccaactggtgaaaatattcccccataaaagctatggtggatttgtgtagatgttttgagaactctttgaatagccatagtgtgggaaatcagcatatatgtaattcagaatatgctgtaccagggaatcaagccaactcttttattagtgaaattgaattttcaattacagatcttgaaaaattacatgtattagtaagctccacaaatgtaaaataatcaacttattttgagcaactttcttattaggaataagaatagaataatttattataattagtgggatgaaaattgaaatttgaaaaatgttcttaccaaattaaatcttcagtgtataatttttttgatcacactaaaatactgcctactctatatttgtgaaacgttttatcctttaaaaaaaattccatggtggaacatgcctatagtcctagctactcaagaggctgagacaggaggattacttgagcccagaagttagtttgaggctacagtgagccatgatcacgccactggactctagcaccttgggcagcagaatgagactgtgtctaaaagaaaaagaaaaaaaccagttatataagctgattaatacaaatggccttatgatttataaggcatttttatatgcatttgttttatttaattacaattgaaaattgttacaataatttacattttacaaataatccacagtgtaatgcaggttaagtagtttgcccacagtcacacacgtgataactggtggagctgattggcagctttggtggactgatcggcgtccaaaaatttgtttgtaattttattagatcattgttcaaatagttgttcataatcaagaaaatacttgtcaaaaacctcaaaataggctgggagcagtggctcatgcctgtatacccagcacttttggaggccgaggtaggcagatcacatgaagccaggagttcaagaccagcccagccaacatggtgaaaccccagctctactaaaaataacaaaaatcagccgggcttggtggtgtgcgcctgtagtcccagctacgcaggaggttgaggcatgagaattgcttgaacctgggaggcagaggttgcagtgagctgagatggcgccactgcacttcagcctgggtgaaggagtgagactctgtctcttaaaaaaaaaaaaaaaaacctcaaaataatattattgtattgtcagatttgtacaatttgaaattacatggtaacacaaaatgttcacaaaatttattttgtatgtttggcaatggtgagtttgaaatcctgatatatagatggtgttcctcagatcgctgataacagaccttatgctgaggcgagatgttggagtaaaagataacattttatgaaaaatgaagtagctgagatgtggaatcatgaggtttgaggttagaacttaactcaccaagggtcagaattaacccacattcactcatttgttgaaataatgcttttgcatattagtcttcttatctagagtccatgttttgtaagcaaataataatcttgaatttaaatactattgatagatatgtatttgttaattgtttccatctttattacttattactgttatgtttttctaaatattctttactttttatgttgacttttagcacggccacatgatttcttcgatgcacaaacactggatgcgataagacatcgagccatatgctttaacctctcagctcatatagaaagtttagggaagggacacagtgttgtttttcatagtactgtaagtattcttttattttttcaaattaaatataaaactttgcaaaaaaatatttccacaatcatttctaaatctctcaaaatctaagaaagtacaatttaacagaaatcacaaaaccttttgttttatcagtatttaaaacattgtattattggttataaagcacacatttcttataattttacatgtttgtgattaaactgaatatgttagcctttagtttgagttacttaggaataatgggatgacacaccatacagtgttactaggcattactggtctctgacattagctaaaccaggtgtcttttctcacctggtttcctcatttgcaaaattagaacatgagactccttttacctctaaaaagtttcattcacatttctgtgtactgcatggagccacctcttaccccacgtacccatccaaagtttatgttaaacagaatataagattatatttgctatcagagcttcatgaaggaaaggattttagtctcttttgttccactcatctatcccaagtgcctagaattttgcctggcacatggtaggcactcagtatagttgttgaatgactatgttgtcaacagagaagaagaaaagtaccaaatttgaaaaagaataaatacattttattttttggttaattaggagttgtaatagagagttattctttcttccatgcctcttctcattttgtttttcagtcatttttaaattggtgtagtttggtgtaattaagttaataaatgtacattgtagatcatacttttggtgatttgaatctctgaaaaatatgtgtttaatttaggctgacaaaatacaggccgggcgtggtggctcatgcctgtaatcccaaaattttgggaggcctaggcaggtggatcacctgaggccaggagttcgagaccagcctggccaacgtggcaaaaccctgtctctactaaaaatacaaaaaattacctgggtgtggtagtggtcatctgcaatcccagttacttgggaggctgaggcaggagaattgcttgagcccaggagttggaggctgctgtgagccgagatcgcaccactgcactccgacctaggcagcaagagcgaaactccatctcaaaaaaaaaaaaaaaaaatacagccaggcttcatggctcacacctataatcctagtactttgggaggccaaggcaggcagattgcttgaacctaggaattcaataccagcctggataatatggcaaatccctgtctctacaaaaacatgcaaaaaattagccaggcatagtggtgtgcacctgtagtcccagttacccaggaggctgaggtgggaggattggctgagcccaggaggtcaagggtgcagtgagctgtgatcatggcactgcactgcagcctgggctacaaagtgagaccctgtctggaaaaaaaaaaattatatatacactaaatttgggttacttttattttttatatttcaattgaaaagtgcatgaaaattgaaatacaaaaggtccttattgatatcaatatgttgtttggtttgaacctctatttccgtcgtctcctataaaaatgagtttgttttttttttttttttttttgcattttcatgttttcttctgcgtgcagtcatccctctgtattcacaggttctgcgaccgtggttacaaccaaccacggattgatcatatttgcggggacaagaaccacaataaaaatcatacaaattaaaaagtacagtgtaccaactatttacgtagtatcgacttaattatatgggaggttttgcatagattatatgcaacaccatgttattttatataaaggccttttagagcatccttggatttcactattcaaggcaattggacatgtccttacttacttcccaattatatatgttttcctgttatttgtacctacttttttttcttttgagacagagtcttgctctgttgcccaggttgaagtgcagtggcatgatctaggctcactgcaacctccaccctctaggttcaagcgatccccctccctcagcctcccgagtagccggattacaggtgcatgccaccaagcccagctaatttttgtatttttagtagagatggggttttgccatgttggccaggctggtattgaactcctgacctcaagtgatctgcctgccttggcctcccaaagtgctgggattacaggcatgagccaccatgcccggcctatcttgagttaattttttatatggtgagagctcagtagaggtccagtttcattctttggcatatggttagccaatttctccagtgccatttattgaattagggagtcctttcctcaccgtttttatttttgtcaacttttttgaagatcagttggttgtaggtgtgcagttttatttcaggggcttctgtcctatttcattggtctgtttgtctattctttttttttttttgagatggactttcgctcttgttgcccaggctggagtgcaatggcatgatctcggctcactgcaacctctgcctcctgggttcaagcgattcttgtgcctcagcctcccaagtagctgggattacaggcgtgtaccaccacgcctggctaatcttgtatttttagtagagatggggtttctccacgttggtcaggctggtctcgaactcccaacctcaggtgatccagccgcttcagcttcccagagtgctgggattaataggcgcgagccaccacgcttggctgtttgtttatttttgtaccaatgctgcactgttttggttactgtagccttgtagtgtagtttgaagtcgggtaaggtggtgtctctggctttgttctttttgcttaggattgccttggctctttgcgctccttttcattccatgtgaattttagaatacttttttgtaattctgtgaaaaaatattggtagcttgataggaatagcattgaatctgtaaattcctttgggcgttgtcaccattttaatgatactgattcttccaatctgtgagcatggaatatttttctatttttttgtgtcatctatgatttcttttagcagccttttgtagttctccttgtagagattgtttacctccttggttagatgtattccttggtgtgtgtgtgtgtgtgtatgtgtgtgtgtgtgttatggtgaatggaattgcattcttgatttggttgtcagcttgagtgttattggggtatagaaatgctactgatttttgtacattgattttttttgtatcctgagactttgctaaagttgtttatcaggtttatgagctttttggtgaaatcttcaggtttttctaggtgtagaatcatattggcagtgaagaaagtaaattcgatttcctcttttcctatttggatgccttttattgatcttacctgattgattgctctggctaggacttccagtactgtgttgaataggaatggtgagaggagacatccttgggtttttttttttttaaacatttatttttatagagacaggatcttgctgtgttgcccaggctggttttgaactctttgcctcaagcagtcctcctgtcctagcttcccaaagtgtcgagattacaggtgagccaccacgccctactgatatcctttgtctttctttccctttccaagacagggtcttactctgtcatccaggctggagtgcagtggcacaaacatggctcactgtagcctcaatctcctgggttcaagagatcctcccacctcagtcttctgagtagctgggaccacaggcatgagctaccacacctggctaatttatttttggtagaggcaaggtctcaccatgttgcccaggctaaccttgtcttgtttatggactaaatttaaatggaggcgtgcttgacataatgtaggttattaaatgtatcatttaaattaatttatgtttttagttactgcataaccaatgttgtcccctaacttgaatttttcagataatgaaactaggaactaaaaaggttgtattgtctttcctattgtgatctagtatagttgtatatatttttttgagacggagtcttgctctgtcgcccaggctggagtgcagtggcgcgatctcggctcactgcaagctccgcctcccaggttcacaccattctcctgcctcagcctcccgagtagctgggaatacaggcgccccccccaccacgcctggctaatttttttgtattttttttagtagagacgggatttcaccgtgttagcaaggatgctctcgatctcctgaccttgtgatccacccacctcggcctcccaaagccctgggattacaggtgtgagccaccgcacctgactgactagttgtgtacttttattacatagggtttatggacctttacccacaccctattcatggattccaggatgagaactcttgtggtatttagattgatatgtgtgatactacagggaagatagatcctgcttgagcctggcaggagagcctggttaggagctcacccttttgttcttccttgtgttgccaatttattgacagcaaatataccaattaaatggacactattaaataactttatttaaaaaaaggcaagatagaaaatggagcaataggtatcagtacattccactcaagttttagaatatttaaaggtagaattgtatattttagaaattagataaggatataaaggagagagtgatagaacaaaatttggagtcaaaggcaagaaagtggaaaattagatgcaaaggaaaggagactttttctgagattggaagacacaagagacatgaatttgaggaaaggtgtccttattctcttttaaataacataggaaatacatttatctaaataaggatgaaagagttggcgggtaaaatacaggatttggagaccagaaagagttaatatggctgctctggggactttgtggggattcagcaaggttagagccttgctcaccgaggctggttgaagtcctcctttgaaatttgggaacatagttttatgatatggtaggtctgtaatacagattttttttgttttaacaggtcagtaagatgttgtcaccatgtccagagtgtggcatcagagctagtttgttcattcacttattaaactgttttaaatattaaggtgatcattaaatattgagcacctactgtgagccaggtactaatgtaatgacatagcagtgaacaaaacagattaaaaccaaccaaacaaaaaataccatgcagctactctaatggaagagacatgataaaacaagataaattagtaaaattgtaaaaacttgtaatgagggcataagccattcaattattagtggggtataagcattttagctagagggaagatgaggtgtaacatcttgaggtgggacaacagtgagtaggcagagtaggcagcgtagctggagggaacaagggaagaggagagagtaggagttaagtttgagaggtaataggcagaaccttggtggactaagaccttagcttttattctgtgtgagatgggaagccattgaagggggttgaataggcatggtctgattttgtttgtttgtttgtttgttttgtttttttgagtcagagtttcactgtgtcacccagggtgaaatgtggtggtatcatcatggctcactgttgcctcaaactcctgggctcaagcagtcctctctcctcagtctcccaggtagtttggtctgtaggagcacaccacgatgcctggctaattttttgagttttttttttattttttcttgtagagatgacatcttgctatgttgcccaggctgatctcaaactcctgggctcaagtgatcctcctggctttgcctcccagagtgctggagtgagccaccgtgcctggcctagtttttaaaataatatatataatatctttttgagacagagccttgctgtgtcacccaggccggagtgcagtgacaccatactggctcactgcaacctctgcctcccaggttcaagtgattcttgtgctgcagcttccctagtagctgggactgtactaaattagcgtccccatgcccagctaatttttgtatttttagtagagatgggatttcgccatgttggccaggctggtctcgaactcctgaactgtagtgatccactcaccttggcctcccaaagtgctgggattacaggcatgagccacggtgcctggcccttttatttctctcttagtaaagaaacttgctgtcaataatttttattgaggtacaatttatatataataaactgtacccattgaaagtatacatttctgtgagttttgaaagttgtactcactgaggcaagcaccaccacagttaagatagaatagttccagcactctgaagttttctggtgtagctttgtagtacattcctacctccacctcctgccctagaaaacctactgttgttcttttccctcatgcaggctttaacatgttcactttggtttctgtgttgagaacaaattgtagaaagtcaggggtgagagtaaaggggaatttgtcttttcagtatttcaagtgagaatgatagtggcttagactggaatgtttgcagtggagataagggttggattctggttatcttttggagttactatggacaagaattatggatggatgagatactgggttttagaataagaggtaacagcaactccaaggctttttggcctgggcagctccgtggcagagccgtggaggctctcaggcaagcagattggggagaggggagtatcaagagatctaatttggacatatttagaggcctatagggcattcagtggctctgtcacttaggctgatggctataaattgagagctcagaggagagaggtgtggctacagatagaaaatatgggaatttttagtgtatttgtggtatttataggtatcagactggatgagattacctaggaaataagtgtaaataaagagaaagttagcataaggattgaagtgtttggggcttaccaaacatttaatgatttaaagggcaatagatttagtgaaatggtggtctagtaatgagctagtgtctctacagataagggagaagtgatgtaaaagggaagcactaacttgcatatgctttcattagagcagctccttttgatgaaatccttagcttcaccatgggaggaatagcgatggctccaaaagaaggaaaatgaaggaaccaaaaatagtggtaataatattagaagtctagaaagaaaataaaaaatttgcgcagactcaaaatagtccatgaaaatgaaaagcttttgagctatggaaaacatctgagagggcttaagaacattgacacttacatatattgtaagcttaaaaacctaggaatgagtgatgtccacccttaagtcacagtgaggaggcagaggtaccttaactgaggaaaagtcacaaaggtggaatgtaatctgaagaatgattttttttcctggggaaggaaagtggaaggaagagacatccataatgagataaggtcttcgctggacacaatagaaaggaaaggagctaggtgagcaaattggagctccaaagttctataactgggaaggttttgatggaggcagtacatgttaaacagaatcaattctgttagtagtaaaaaacattcagtactaactgcaaatttaagttactttgttatcaaattaacttttatagaaaataatacaaataatgaaacaattggttaaaagaaggctatgaggtactatactgtttggtttgcctaatgtgccttatttcattaattgaaatattttctttcgagccttctccagaagaggtcagcaaaatcctagttaccaatcagttggcttgctgtgcttggttggcttgcattgtttttgtgtattatttcattgtagaggtattttgttttagcagctccagacctgtgtttgggcttttaaattttgttgccaagtctagaatcagagtatttatttgactacagactttttttgttgtttttaaaaaaaccatattttaaaaaataaaaactagaaacggggattcaccatgttgtccaggctggcctcgaattcctgggctcaagcagtcctcctgcctcagcctcccaaagtgctgggattataggtgtgagccactgcgtctggcctcaccataggtttttatatagtggagacagtgttttgtttttgcttaaagctctgcttttactcagtcctaatatgttttcaggattacaagattattttgtttgggtggttggaacttgattaaaaaaattgagattaagactattaaaacactaaagttctaattttgtttatatggaaattttaagagtttgacgttattgttttgcctgattttattttatttaagcattatcttaattttcagaatctggtaatgaaaggaaaatatattgcttttcttatacttttttgggtctttctgttagatcgatgttaacttgcatagattccttaagcttaaacctagactgattggcctacctttcatttaaaataaaaccaactacagcaaaaaactccaggagataaacaaatgccttaagttgtaaattagagacttttccttctcattagtattttttctttactgtttattcatttaaaaatatttcaaaggctttcttcttcctcttccggaacgttgtctgcaggcactcagaatggtccagcatttgacatactgtcgtaggcttttctacaatacagcctctaacaaaacaagtctgtcccagacccttggtaatagagttgtttacctttttactaagaacgttgggaaagcaccaaaatctgcatgtggcatgtgcccaggcagacatggaggggttcgtgctgtgagacctaaagttcttaatgagattgtccaaagcaaagaacatgtcagcagggcctgtggtggttccatgtgtgctaaatgtgtttgtgacaggatcaaacatgctttccttattaaggagtagaaaattggggtgtaagtgttgaaggcacaagcacagagtcagctaaattgaaaaatgcaacttttttaagtaataaaaatgaaaagacttgaaaaaatttcatctactatgaatgcttttggttggctaagctaagccacatacttagtaaaacaaatggcattttcattctcttaataataacatggctttggcttgattagttaaagcttctttaattcacatatatttgtgaaaatatatgattaaaagtgaagttgaggctgggtgctgtggctcacacctgtaatctcagcacttgggaggctgaggtaggcagatcagctgagctcaggagtttgataccagcctgggcaaaatggtaaaaccccgtctctagaaaaaataaaaaagacatacctaggcgtagtggctgcgcctgtggttctggctgctcaggaggccaaggcgggaagaatactcaaggctaggagacagaggttgcagtgagctgagattatgtcactgcactgcctgggtgacagagtgagactttggcttgaaaaataaaagtgaaattgagacagggttgttgaaaaaccttttacttcgataatattagtaacatggctactttcttttttttttttttttttttttttttgagatggagtctcactcactttgttgcttggactggagtgcagtggcatgatctcggctcactgtagcttccgctgcccaggtttaagcaattctcctgcctcagcctcctgagtagctgggattactgacgtgcaccatcacacctggctaatttttatatttttagtagagatagggtttcaccatgttggccaggctggtcacaaacttctaacctcaagtgttctgcccacctatcacttgtttttattagtgtgtgtgtaaacccaatgttaaatgactgcatagtattccagtatattgcattgcattctccatttattggaaatgtttgggttagtacctaaggtagagactgaattgtctaccatattctacattccacactcggtgagggaaggtaggcacataaagcaatggcagtacggtgtaatacatgctaatgtagagtaagcactcagcattttgaagacatggactagagacttttcacccattattggagttgtgggggaggggcaacgcagaaaaggtgataatgcatgtgtcctatgtataattgtgtatgcgcatgggcagacacggcatatgccaggcaggaaagtgttgggatggtgggagtaaaaatttgatgtgaattttatttgacttaactgagacctatagttgcctaggttaattgcctgagttaaaatgagtaatcaaaaaatgaagcgtacgtaacttaaacatttttgctgaatatgtaaatgaatgtttagtaatttgttttatatagagccaaagtcatactttggagtctagatatgttaattggggtttctggtcacatttcttgaataaaacacatttaaatgtgtacataatctaatggtttgcagcttttatttattaaagcggagccagaacttgtagacaattgaaaagctattagagataccctaatgagacatgttacagtttttgttctcaatttttactgtaattctgcagtacatcgctttttaaggtagtgactttttttttttttttttgaggtggggcctctgttgctcagcctggagtgcagtggcgcagtcacagctcctgggcaggtgatcctgtcacctcagcctcccaagtagctgggactacaggcaagcaccaccataacctggctaattttttgtattgagacaggatctccctatgttgcctaggctggtctagaactcctgggctcaggtgatcctcccaccttggcctcccaaggtactggtattgcaggcgtgagctactgaggaaatgacctttagtaagccttccaaaagctatgaactccagttttcatataaataagtctttagttttagtagagtgggatttgttttgttttactgttgtgtgcccagcactctaaaatggtatctgaatatgataactgttcttctgtaaaacattaatgctgctggtgcacagaaagccccggagagttggttgttccattaagttagagagcaggacagtatttctattatgttccatagtttgggaaactgttctcagtatgaggctaaaggcgttcaaggcagaaaaccatgaaatagctgaggcctagagaggccagatcctgaagagttttctgcaccatactaagagtgaccctttcctaagtgctcgggggaactgttgaagagtttgtcaggaaagtgatgctactgaatttgtactttggaaaaagccttctgggcactgagtgggaggtagctttgatgacttgaggaggtccagaagaatggagacctgaacttgggtttatggcagcttggatggagagaatgggtattaatgagtacagttcctagatcttagtgttggaatatttgctgtcccctttttgggcctgaagtgctcgaaggtgttcactgtaacacaaacatccttggccacagagcttttactgaatctaggtttttttttttaggatagatttccaaacaattaatttattttatactaaacactactataggtggtatgacacaaaggttcacaggataagaaatattcctgtgtcatggagttttcagtcttgtgggaaagacaaaggtttgagtgctacaagacagggaagaactacaaagcaggcaggattactatctcttccagggtatgaacacttaagttcttgattaggggtgaaagtttttttttttctctgagatggagtcttgcccaggctggagtgcagtggcgtgatcttggctcactgcaaccgccacctcctgggttcaagtgattctcctgcctcagcctcctgagtagctgggactgcagaagcccaccaccactcccggctaatttttgtgtttttagtagagacggggtttcaccatattggccaagctggtctcaaactcctgaccttatgatccacccgccttggcctcccaaagtgctgggattacaggcatgagccatcgcgcccagccccaaaagtgttttttaacaatacatgaaaatgatgttttacacattgtttttatgatttcttttcatgtcattatcaggtaatagctaagagaaaagaagattctgggaagatcaaacttttgcttcattggatgcctgaagacatgtaagtatttgaaatattatgccttagtaataagttcatgttttatttttgttaaaatcttacacacaaaaattatttattaaattcaaataaaaagaaattacattttacaacgttttgaggttgtcaggattaaagagataatctgaaaggtcttacactatcaggttcacgttttacgcttcaaaacttaagccccccctctttttttttttgctggaggcggtggctcacacctgtaatcccagcactttgggaggctgggggaggccggcagttcgagaccagcctggccaacgtggtaaaaccctgtctctactaaaaatacaaaaattagccgggtgtggtggtgcgcacccataatcccagctgctcgggaggctgaggcacgagagtcacttgaacccgggaggcaaaggttgcagtgagccgagatcatgccactgcattctagcctgggtaacagagtgagactgtctcaaaaacaaaaacaacaaaacaaacaaaaatcttaagctttttaaatcttgtgtggtgttttttgttttgtttttgtttttttgttttgttttttgagatgctcaacctgggcatcagtgagactctgtctcaaaaataaaaaagtagttagagaaaatttaaatcatttttagcatttttagtgacctccaagcagtatacaagcagccatagctgtgcctttgtttgaatcttttatttaaaaaatttgtaaatgttctttagtgcacagtgaatggtattttatagaaaaagcaattgactaattttctagcagtgattacatttttctttaagttttagtgcccatttagagcttagttcatatatttcatgtatttttttatctttcttattaaaattttctttttataaaaggaaatgagggtatattatagacatattggacaaaattaataagcatcaagaatagaataaatttcattgaaggagatttcattatgtgtacctaattcacgtatgtggccaatggctgggcgcagtggtttatgctggtaatcccagtgctttgtgaggctgaggcagaaagattgcttttagggcaggagtttgagatcagcctgggcagtatagtgaatcctcgtctctacaggaaaacaaaaaaagaaattagctggttgtgatggtgtcgcctgtagtcccagatactcaggagactgaggcgggaagattgattgagcccaggaggttgaagctgcagtgagccgtgattgtaccactgcaactcaagcttgggtgacagagtgagaccctgttcaaaaaagtcaaattcaaatgtgtatattcctaatgttttggaaattgattaatccaaatatcaaaatacattcatttgaattttcttgtagagttgaatttctttgaattcagtgttatggccgcatgcatttttttttttttttttaatggagtttagtcttacagggtttttatttatttcttttttttttttttaaatggactttaatcttacaggttttgtttctgttttttgtttttttggttttttttggagagagagtctcactttgacgcccatgctgcagtgcagtggtgcactcttggctcactgcaacctctgtctcctgggttcaagcgattcttgtgcctcgttctccggagttgatgggaatacaggtgtgcgccaccatgcccagctaatttttgtatttttagtacagatggggtttcaccatgttggccagtgtggtcttaaactcctgggctcaagttatcttccccccttggcctcccaaagtgctggaattagaggaaggagccaccgcactgggcccttttatttctctcttagtaaagaaacttgctgtcagatttccagcaagtcaaaatcaagtatgaatttcactcattgagttaaaagctagccagtgtgttctgacaaatttctaatttgataagatattgccactgaaaatgtttaatttattcctcaattcatgtttaaaatttaacactgccatttcttatctgggactccaagtcctgctattaaggttgatagctgagcttccctggcttctgggaaacttgttcacttaacgtggactgatcaaagtagcagaaaatgccagaatgtgaaggcacatggaagtgtaaatctaaaattaatgttactttattattgacttgttttttaattcatagtctgcctgatgtgtgggtgaatgaaagtgaacgacatcagttaaaaactaaagtagttcatttatcaaagctacccaaagatactgccttgcttttggacccaaacatatacaggtaatttaattcttgcctttatgttttactttttgatttgtaattttctctccccaaattttggataaattaggacttagttttaagtgctgaattttaataccaagcatatctcattacttcctggcttttttttttttggatgtggactcacaaagagttaaaaattgtagaatccagaaaaacagtattttgctaataaagtttatatgcttgtttaatcccagatttatcttaagtatgttagattgtaatatacatagtaatttgaaaataagtgccctttaacaaggtaattctttttataataacagacttttgtggacctaagaatatgttgcatgagtctgaataccaaaactgtttgattttttttagcttaccctttctccaaactttccaaaagagcaattcaaatattatttgttttttaagacatagcttagagtgttcacatttctagtaattttatgttttgagctttttttagtgtgctgtgcttatgaaggtatgtgggggaaggagaagagaccaacatttctcttttatgtgctgagtcactttgctaggtgctttgcgtatacgtcatcctcacggctgctctgtgaagtaggttttactatctctgctttacaggttggaaaactgaggcaagaggttaaatagttaatctgcccaagtttgcacgaatgtggttgaactccatagtgcctgtatccaaatgatgtacacgagagtgattaaaaaagtggtggaaatgcttaaaaccagcttttaaaaggcactcttattgaaaggactttatatcttttttcaatgaaactttgtaaattttagctatcataaagatagcaaattttatattaattaagtgctttgaagggtatattcattccacgatgcacctttttggagtgctattcacctggagatttcctgtaatttgagacattattctgtgagtgaaattccaacataatgggcattgctatgtagaagcatagttttccctattacaataaaaggtttttttggctgggcccagtggctcatgcctatcatcacagcattttgggaggctgaggtgggcaggtcgctgaagtctaggagttcgagaccagcctcggcaacatagtgagaccctgtctctacaaaaaatacatggtggcacatgcctgtggtcccagctactcaggaggctgaggtaggaggattgcttcagcctggaagttcgaggctgcagtgagccaggattacaccactgcactccagcctggctgacagagcgagaacctgtctcaaaaaaatttttttcttctcaaacatcttttggtgaaagtgctaattaatacaataaaacttattctttgtggaatgaactagatcatcaaggagaagaagattgagagtaatctaccaaaaatttgggaaggttacgagttacttctctataaagaaaaataattgagtgttgttgatttatttgtacctaatttagagttatttctgtttactctttggagagatgaattaaaattagcatcctaaaagagtgatattttgggagagccactcttgccttttagaactagtcgtaaacctctcttagagagttgtcaaagggccatgaatcttaaattaagattaatctgtgtttctgcctgcatcctgcttccttctttccaagagtcttgctttctcaccaaaccagcttattttttttctgttcttatgccatataggaagcaatttagacattttagtgaaagtgacttaaaacaaaatttaagcttgaactgatgttctgaagtgcataggaacaatgttgcatatactcaaatttatgtgtgtgattccacaagtcttgttgattttattcttggaaatgaggttgttcttaagatatattaggtgcttctgtagatttaattttccttacctgtatcaaaaaagccgtcttggcccggtgaggtggttcacgcccattatcccaacactttgggaggccgaggtgggtggatcacttgaggccaggagtttgagaccagcctggccaacatgatgaaaccctgtttcaactaaaaatgcaaaaatcagtcggacgtagtgttgcacgcctgtaatctcagctactctggaggctgaggcacgagaatcacttgaacccaggaggcggaggttgcagtgagccgagatcacgtcctacactccagcctcagctacagagcaagagtctgtccaaaaaataaaaaaggccatcttaaaacttaattttgactctaaacctctgtgctttcactattctggaaatcagaattgagtgtactgtaaagtggcatagagtcatagaagcccctacatttgtcctagtgtacaatcttttcttaaatttctggattttgactgggaaaatttgtgaaattaattaaaagaagaaaaacaattattcttacttgtttttaggagaaataacttcctgcttgtgcacatgtcaaaatgaaagtatggcaaaccttctgcaaaatagatatattccttcaaaatgagtctaacaggaatatacagttggtcctgtgtatccacaacttccacatccatgaattcaaccaactgcatatcaaagctatttaggggaaaaagataacaatacaacaatacaaaataatacaaataagaccaatatagtgtaacaatgatttacatagcatttatattatattgttataagtaatcttgaggtgatttaaagtatacagaaggatgtatgtaggttatttgcaaatactgctgtttccttggattttggaatctgcaggggattctggggaccccccactcccactgtgcatgccgagagacaactgtatttatttgggatttaagcactggggtttgttgtttttgagaccacttctctctctgtttctaggctcatcttgaactcctgggctcaagcagtctttctgccttggcttcccaatgtgctgggaagattacaggcatgagcctctgggacccagccaagcatcagttttaaagtattagttggctaaaatatatgtattacacatggaattctttcttagaaatgcactagcaggctacatttaaaacttttattaaacaactatattatgtaactaagtatagatccatatgtataaatgttttggaaatacatttttattataatctatgatcatcacattgcctgtatcttattaatatttttaatgtctcttgaagcactcaaatgtgtttgattcagttgaataaaaggatttctttttctctttttctagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctgtgaatgaagtagactcttcggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacattgcataatttatttattgaatcaagtttacgtggtctaacacatggttctgttaatctgaaaattgaaaaggatttgtaagcaggttagagcaggaattgcaacccagatttttttttttctaggtcagaattcttttcactataccaaactgctgctcacagtgtgagaacatgaatgtacattgtgataccactataaagttgtgtccagtgtttctgccacagccagtctagcatgatcattcatggcacaaaatagtctgtaaaatttgttaaatgagtattataggtgagtaatttttacagtaaaatactttggagaattaacagtgataaaacagtagtagggttgaagtgacctggcttaagccacattctgtgatagtgtcaggtaccttttcataagaaccttatatacggatatagtggttcatgcttgtaatcccaactacttgggagggtaagaagggaggattgcttgaggccaagagttccaggctacagtgagctatgattggaccactgcattccagtctgggtgacacagcgagaccccacctctttatttttcgctacggagtcttgctctcttgctgaggctgaagtgcagtggtgtgatctcagctcactgcaccctctgcttccggcttcaagtggttcttgtggctcagcctcccacgtagctgggactacaggtgcgtgccaccatgcccagctaatttttgtattttttagtagggacggggttttgccatgttggccagcctgggcttgaaatccttaccgcaggtgattctcccacctctgcctcccaaagtgctggcattacaggcatgagccactgtgcctggcccccgcctctttaaacaacaacaaaagttctaataaaaggaactgtgcttcagtttgtttagacattcttagtgtaaagggttattgatgttatgtttttacatattggatgtaatattttggcttacttgattttatttaaaaatgttcctttttgtcctgttttatgatgtaaataacttttttttttttttttttttttgagacagattcttactctgtcgcccaggctgtagtgcagtggcgggattgtagctcgctgcagcttcaaaacgccttgggctcaagtgaccctgtcgcgttggcctcccgagtagctaggcctccaggcatgcaccaccacgctggcttttttaatatattgcccaggctggtcttcaactcatggtattacaggtgtgagccgagccactgcacctggcccaacattttttttttaaaaaacactattttgaaggagctatgcagtatttggtttcctgttttttgagatggaatctctctctcttgctcaggctggggtgcaatggcacaatcgctgctcactgcagctgctgcctcccgggttcaagcgattgtcttgcctcagcctcctgagtagctgggattacagacacacaccaccacgcccggctaatttttgtatttttagtagagactgtttcaccatgttggccaggctggtctggaactcctgaccttgtgatccatccacctcagcctcccaaagtgctgggattacaggcatgagccaccatgcctggccagtttctttctcccttcctccatctctccctccctccctcccttccctccctccctccctccctccctcgttccgtctttctctctctccttccttcctttttctttctctctttcttcctttttctctctctttctctctctcttctctctctctttttttttttttaaacagagtttcactcttttgaccaggctggagtgcagtggcacaatcttggctcactgcaacctccacttcccaggttcaagcaattctcttgcctctgcctccgagtagctgggattacaggcacgtgctaccatgccgggctgatttttgtatttttagtagagactgggtttcgccaggatggtcttgaacacctgacctcaggtggtttgcgcccctccgcctcccaaagtgctgggattacaggtgtgagccaccgtgctcggcctggtttctttatttgaatgttttgtcttgatcccagagcgttgctgctttcagaggaccttttttcctcttcagtgttcagatgcttctgctaaagaatacctatgtttaactagtctttattatgaaattgcagtgaacttacgtatttctgttgaaaactgaatttatatttgcatgcctaatgcatcttgtgtgtacataagattattatattttgggggccttttttggttagaaaaactatttttagaggaaggtgtgtagctaggaaatagtaatagattgtaaaactgtgatagcttactcttgagagctgggctcagtgcaagtaatttagtatagacatcatcgagcattgcaggagaatgggtcataaggttcccagcttgtgtctgcttgaatttcataaattaaaagagagcctagttatttttttaatgcccgtaaagtaaatgtcagtctttgtagaagttagcttatttaaatttcagacttttgaattcttacgtgacctccacaaatctgaaagatctgatttctttttaaatgtaatttcagaagtcagcagttttttcagaatttgtcctaaggatcaatagtattttttaaagtaactttttatattaagttataatgaccaaattgaagaaatcaattatagaaagtaggaacaaaatggaagtctttactttcagttaaccacaccttcctggtctcctgattaatatttttcttttgtgctttttaaaattgtttaacactcagttctatggtttggcctttttttttcttttctttcttttttgtttttttttgagacattcttgctctgtcgcctagtctgactcggctgtggcttgatctcggctcactgtactctccgcctcctgggttcacaaaattctcatacctcagcctcccgagtagctgggactacaggcacggcttactcagggcactcaaatagatcttcctttcctttccctttccctctttccctttccctttccttttccttttcccttcccctcctttcctttccttttttttttttttttttaaaaaagatactgtcaccgaggctggagtgcagtggcatgaatatgactcattgcaacctccacttccctcatttaagtgattctcctgcctcagcctcctgtgccttagctgggattatgggcatgtgtcaccatgcccagctaatttttgtatttttggtagagatgaagtttcaccatgttgccaggctggacttgaactcctgacttcagatgatccgcccgccttggcctcctgaagtgctgggattataggggtgagccaccacgcctggcctgaaaatatactttgaatgatatttgtgtagtttaatttcctagaagacactgttaactgacttaaagaattttgttcattataagttgtgagttgcattataagttttggcattgccaaaatgttttccttaaaaggtggtaccaacataaacttccatcgactgagtgtgagtaaatattgttgctcacactgtgttactattactctagtctaaggtggacaaatgacataagtatctttcagtccatttaggttgtacagttagatgagttttgacagatgtctatgtaatcaccaaacaagatacagaacatttccatcaccttgcataggttcccccatgcttccttcctttgatccttagccccaggcaaccactgatctactgtgtggcactagagattggttgcattttctagaattttatataaatggaataacaacagtgtatactcttgtgtatgttttccagcataaatgattttgaaatgcatcacatactgtaaaaaatatttgcattttttacttctccagtgatattgaacatattttttcctgtagcttttagttatttatacttgaagtagatactggagacactaaaaattatctaaactcttctgacttcagattgccctttaagatttactaaataaataaaaaagacttcttgttctggagtatggctgggcagcattaaagacattaaggcagcttaaaaatgaatttttgtctgtttaatcagtttcagtttattatcagtttttaaggtatttatgtggcttatgatgggggtctttatgtttctttgtgctggagatgttaaaacaagtataatttgttactgttatactagcaatgttatcaagtcaacttttagcctacaaaataaaaatcctattaatagagagcaaaatcttagaggacttggaaatacatttaaaaactttccagaaagataatcctcagactacccaaatggtataaattgaaatatacatagaaaaatgtacccattcaatatcaagcatccgcaaattgcaaggcactgttctagatgctacagattcagcagtggagaaaataaacattcttgatctcacggaccttagaattgtgtgtatgagagatggcagacaatatgcaagtgagtgaaacgtatggtgtaaatgctatgaagaaaaaatggggacagggataggggaagtgaatttgtgatagaattttaagtagggtgcttggtaaggccttactgagcaaagccctgaaggagctgagtgagaatacatgcaggtatctgagagtagagaacccccagctaagagaacagcaactataaagccccttgaagcaagagcatttattaaaatgctttatgcttgctgttcttttatactgtcccaagcgtgattacaggtgttggaggtgctgcactgaacaaaacgttaaaatacaattccacctttttggagcttaacatttcatcatgcttggtgtgtttgtaaagctgaggttgatgtgaagagactgaggaggtggaaagccttaggagagttttgaggagagaagggttatgatctgaactatgtcttaaaaggatcactgattactctgaagaattaactaataatgggagcaaaggcagaaacaggaagagcaataaaaagtctcttttttttaagtcattgattttttaatcagtggcttgaaccagaatggatggtgttaaataatggttggttttgctgtgaacctaaaactgctgtaaaaaaaaaaagcgatttggatttggattttcatttgaaggtagatttgttgatagcatggttatagtatgagagagtcagggtggactgcagcgtttatggcttaaactactggtaggatggaactgctgtgagatagtgatagcaagaaggactgcagtgtggagcaggtttggggagggatgagtttcagaattaagctttgaatgttttgtgattgggatgcttattagatatccaagttgggggggtatcatgagtcagagatgtataatggaaatgatgtcaggaaggctgaggatgtaatttatatatatttttgaaatctgtggtaagtcattacacatgcataaaggtaagtttatcatttcacctccagtgaacagttctaactgcttgggatcagcttgaacaagagcaggacgctggacacttgagttgcaagcagtacggatttaacctaagacctagtagaaatatacttctgataagcttatcagctgccaagtggtggtcaggaatgattggtccatggttcaagttgctggtgattaaaaaaaaaaaaattagaaacagaaagaaaactgcttagcttttatttcctgtgtactgaataccaatttaaatcagccatcctgccaggcgcagtggctcatgcctgtaatcccaacactttgggaggctgagatgggtggattacttgaggtcaggcgttcgagaccagcctggccaacatggtgaaaccgcgtctctactaaaaaataaaaaaattaggctgggcgcggtggctcacgcctataatcccagcactttgagaggctgaggcagggggatccgcactttgagtggtttacaggcacgccaggcatggtggtatttctattatttttttgagacagaatctcactctgtcgcccaggctagagtgcagtggcgcgatttcagctcactgcaacctccgcttcccgggttcaaatgattctcctgcctcaggctcctgagtagctgggattacaggcatgcgccaccatgctcggctaattttgtatttttagtagagacagggtttctccatgttggtcaggctggtctcctactccccatctcaggtgattggtctgccttggcctcccaaagtgctgggattacaggcatgagccactgtacccggctagcaggaagtgatttttcaaaagatgtaggaagaataaggtgaaatttgcaagaggaaacaggaaatgtaaaaaaatataaaaagtttaccacaattttatgaatttttagtacccagcatatacttggtacttgggatataaatgagtaaggtgttttgtttacactttccagatgtgggcacaggaagagcatagtgacattagcgtaatttctatacagtgtgaagtgccctgttggaggtacgcctggagtaatgtggaagcacagagagcacttgacccacctctagagcattcaggcaggctcacctcagaggttacctttgaagtaatacctgggacttagtgatggggaatggaggggaagatggaggggtttaagacagggatttctgtgactgtagagtggaacaagagctttgtgtctaggtgacggccaggagtggtgggagctaagtctgaagaggtagagaggaccagttgttgagggccttgtgttccaaataagctagagcttgggctttatgtgaaagatttactggtaagataactgttttgatgtacctacgtgactggtgatggggaaactagcccaaaggctgctgttctgccctgctccccagtgagggaaaaacataaaataaatcactttttgaaaacattcaagacttactgaagagtaagatttgaaaatattagaattcattactggggaaattaattttttttaacagttcttaataaaatatgttacctattaaatcagttccaacttccttgggtatcgtggggggtacctgaacttactcatgaaggtggtggcctttctggctatgtattggtcttatagtagccatatatgttttctttctatgtgggatgttaaagtactagaatagcagtgctagaataaatttcccattttatctttgtgagaagtaataaaacaccaaaaacatccttaaaacactaaaatacacaaaaatatggtatgccattatggtatgtcatattcaaactggtagagaagtccagcctacacctatttccaaattgggggaaagtaggctcattaacatgggactgagccaacaattatttttttcctccagcatgatggatggcttattttgtgacattgtgtagattgtataggaacttagcaacataggagatatttcctgaaatagagaatgacatttggcatagagagttagttgatatttactgtttataacgaaatttgaacattagacatgtattccaagcagattgtacaaacaggaaataattgattttttttttttttgccagaaaagggaaaaagtgaaagtacagaaatgaatcatataacaaatatgtgtgtaccaggcacttcctgtggctgggaatatggactagcaggcctgcattggatacttgattatgaagattagaggttgagatacttctagaacgctgtttctggcgttgtttcatccatctcttggaaaaaatataaaactattagtttggtatcttaccttttaatcttctcccacccgtaattcaaaaaggtttcatgatacagcaagataacaatttaaaaaatgaatagaaataagagaggaaaaattttaaagtaaggcgcagctggagtgatctctacgaaatgcatgctcttaaattttatatgcttatcagaggttggccataaacttgctagctttgaactaatttatgaaggagtgcatgaggatgttggaagattcatagcatttataactgggtagtaagcatttagaattagctggacagtgggctaggggaatttgtttagccttcacatttagtccttacagttaatgtatgaaatgtgggttttactatttttgttttacaaatgagatacttgggtaacttgtccaaga

SEQ ID NO: 225 - DNA, 124371 bp, Homo sapiens
tagaatgtaaaatcaccctaaatagaaatacagaagggtcctcagaccacagcaattttgttcatggctttgtggaccagtattactatccaagtgactcctctgggggttccctggcataggtggaagtgagccactggttcttggaacagctctgaaagtggtattatattactgagaggaagggagcttagtgaggaaatccattatcaaggtggcccaggggaactgaatgtttggcagggatcacagaaaacctttggcttttcccagtaggtgtttgttcttctgtatattttgtatatcattgtattccactacttccattttttgacctagagttgttagaagtcatgagtcaaggaaagtagaaccttgtgttcaccaaaatgaatgaataaacagagggcaggattcatgacaattttctataacatgtaagtcatttgaaacacacttctgtctgagggcaagcagagggtttgctagatctcttaatatattattgccattcctgggtgagaaatgagaaggtccagtagaagctggatcataggagaaaacactatagtattacaaaacccagtccccaatggaggtggtaaattagattactgagaacaaggagaggaaacatttgccatgttctggcagaaggggctggaatatagattctgtatggtgtctaagaatcaagcatcatttctgtagagagggctctctgtttgtaggatggcatcatccagtcatatcttaatgaggggatgctgtagcagacagctgcactgaccatgtagctagagaccaggcagaaatgtgggtacttcagtggaggctgatgtggaaaggtagtaatgatcaagaaacagatagcatagtatacatttcagtggacttcagtggaggactttattccttcctggaacttaggtgagaattcttagaattacataaagagtaaaatgagcaagaagtgttcacaataatttttttaaagttacaaaaatatagactaatattaaacttcgaagagcatagggtttgacactgaaacccaagtagcaccttataaatgttggcttctctttcacagaaaagaaatgccgtttcctcaaaccatacatgaaaattagtatgatattttatcagaccttattttactgcagatattactttcatccggagtttatatgcaatttcagaatagctactgaccatctaaaaaggatagaaaaagtacaggccattatactattaagctagagctctgtaggaatcttaatatacccattatagtaagcttataggcatactgtttgaagataacaaaatcattgtaagattattacaccaactgataaggatactaacctgcacaatcaaatgtgagtaaggacacacttaaacaggaagaatggtaaaatcagtttagagataaagagcagaatatgacaaattatacatttataatataaatttatgaattataaatttgggctctacaaagggaattttctaaataaattacaaaagtgccaagaaatttgacacccattgtttataaagataacccatctatttgaaaaataatggtaattattatttttccccctcacattgaacaaaaatctgtcctcttcctctggaaggacagaggaagcctcagatagttctcagacattagcatttcaacctcagtttactatatccctctgagtctccccttcttcaggttaaataccaacaagataagtttcacatatgagatattcccttaggctcctcacctctggtcatatttcactatggctaatgcaggtgcatactgactagttagagtacagtaggactagcacctcttttgtcttgagcatcacactagcattcatgtagcctaaagttgcatttgccatgttttggtagctgcatccttccgatgaagaagattggactaaccataaagggttgcaggccagtaaaccaataaatcagaaatggttggctactttgatgttcatgaagattggctatcaagaaatcctagtctatctttcagaagcttagctgatttcacatattccattgtggtgaaggggaacaaatgtgttcaagatgactttgggcaatccaaaataaattgggatcaaatctagtaaggggacagactggatatctctaacgtagtttagtggcttaaaattgcaaatagagcaaggatttcctacagcctgggctaggaggcatttgggggtcttaaaagttctaccacttttcaacctagatttttaccccagtgtttaatgactttctgtaccgtatgtaagcatgtattaataatattcatgtttcatatgcatgactattacctcctttaaagatctaatcacgtaaggatatttctgttaaatttcatgtgagctaactaatgaataaggatgctctgactgacactttgaattaatgtttcatttttcaagcaaagcagctaagcaacaggaatgacagacccagaaataacttgttctaagatctgttttatcttgtcataaagttaggacaatattccaaaagctgaccttgtcctttagatatataatccaggggaagtcatctaacatcttttttaaagcagtaagcatgtatgctattggctcacatgaagaggaagtctatctcactttttgcaaaagacattttttaaaagttgtgtataaattttatatggtaaattaaactattatttacttatgctaaatgcttttgaaatgcttgataacattcatgcttctttgaacttgtaatgtctgtaacataagctttttataataccttgcacttctaatttaactataaaccagtcatgtaaaatcagcagagcaatgatatttaaataaactcttttatcttatcaactagttacatttaggcataattacttgtttttgaactttggacaagtatatattacattttcttaaaagaaggtacatctatgttttacatattagaagtattataattcagtaattagctatgatttaaatcagaagaatcattatatttgagtaaaatatatagtaggactcagattgattttgctgttcaagaagtgtttaatttggattggcacttctgaattatcatttgtactatatttactaattagtatagttaggattctatgattttagcattgaacagttaatgagtgccaccgtgtattaaaatatcactaggtataattttaacagtggttaagatgtgtctctatccttataaagacactcgctacaaaagaattaggtaagtgctgtgaaattaaatcatttaaacttaaagctgttggaactttacattattctgtgccttgagaggaacatggctctgcagcctgagtcacacggcatgcagttgcaacttctgctcttttttttctgtaaataattagtaagatcaaaaggcaccagatataagaccctctcagatcactactcttactcacagagtaataaagtcatcttccttggaatgtagcaatctataaccaatcaaattgctgtaatacactggtctcctgtggaaaatgtgataatcctgctaaaatttctctctctgagactatgtaagtgaaaccttaacttctccactttggaatactgaccccattcatctggaattgttgttcccaggttgtcatcctcaagctttatgctcaaataaactccatactgaatcatattttctgaatctcattaaggttgacagtatgtacattataaagtatatagtagactgtgatataatatataggcattcaaaccgaaggcataaaagaggtatttcacctcttgaacttaaaaagcacctttacatatttaaacagctgatgaaactgtaatttccacatttttcccctttcagaatgttttattaatacattggtttattaagtattaacaaatttggctggatgcagtgtctcacgcctataatcccagctctttgggaggcttgagcccaggagttcaagaccagcctgggcaacatagcaagactctgtatctacaaaaaattttaaaaaatagccagatgcagtagtgcgcacctgtagtcctagctacactggaggtaagtggggaggatcacttgagcctaggagctcaagactacactgagctatggtcactgcactacagtttgggtgacagagactctgtctccaaacaaacacaaaataataataagttaaataatacatgtaaagcaaccatcaaataactggtctgctccattattttttcttgtattttctaatgttctatataacgtgtgtattaattcataatcataaaaaacaaagtcctaaaactgaacaatgtagaaaagaaggacttgacatctcacttttacaagtgagccaccagctgggaccatcactcaggcaggaaatatcactcaggcaggaattcagcaagtgggccaaagggagactcaagttttcaaacaggaagcgatatggaatctgctcttggctgtcagaggctgctactgtaaagctccaaagctcctggggaaagatgatgcctgcctttgtagtcagaaggtcaccaagggtattaagctgagaggctagctttgtgtattaggcttagttttgttgaaaggtaggaccagaccgaactagctaattttagtctgaactattccatttagtgccccatgtgatccagaataaatcattcaaccttgctgggtcataattctttcatgtgcctataacccaaatgtcttgtttctattacagtatgtctaaaaatgaaagaaatatttccattaacttagaaaattacagtggaggagacaccaccaatttgattgctggaaattggcccactaaaatgtccctaggagacacacaggggttcccaggcaccctcttgggtgcccttggacacaggctgtgttccctgacttgccaccctgctgccctggctcctttgtacaccactggtctctcctctccctaccccgtttctgtgaggagtatgagcaggggacacctgttttctccctgctgcaacatcccaagcatgggacatgccttgacattcatttcccttaacatagcacagatttggcttatagcatttatcaggactttactgaggactcctgacaatacaaattaaagagaataaagaatagtctggtaagacaccctccttccccgcttctctttttttgaatagttattgagtacctactatgtgccttaggaactcctaagcaaaaacagaaacagcccttgctcatggatctcacagttcagtggaggagggagacagacattaactaggtaaccacacaaataaaaattgttataagttgataaatgcgttgaagaaaaagtagggagtcctaagtaaaggggatttacttagtctggggagttaggacgaaagttcctgaggaagtgacagtagagttgaaaggtgaaggattcttgggcattcagctgttaacagggatggacagagaaagaatattggatcctgaagaaacagcctgtggaaggtgatgaggcaggcagggtctggtcctattttgaggaactgaaaaggggacagtctgaaagggagaatgatatgaaagcaaaggagaaaagcagattatgaggaaaaccatgagaagccactgaaggattgtaagcaggggaatggcatggtcagatgcagtagaaatggcagccctctggagatagagtgcacatacttcaaccagcaggcaaaaaagacaaatcctggaagcaaaggaacggtgctaggaggagaaatatgaactctgtaaatgggataaatagaacgtcttctattttttagagtattaaaaagaatcagcaacatccacacaaaatttgtataggaatattcaaagcagtattattcataatagccaaaaagtagaaacaactgaattgtctgtcaactgataagttggccaataaaactgtgctatatacatagaatggaactgttattcggcaataaaaaataaatgaagtactgatacacgcttcaacatggatgatcctttaacacatgctaaatgaacgaagtgagacccaagagaccatgtattgtatgactccatttatatgaactgtccagaataggcaagtcttttttattttttattttatttttattatactttaagttctaaggtacatgtgcacaacatgttacagaggtatacatgtgccatgttggtttgctgcacccatcaacttgtcatttacattaggtatttctcctaatgctatccctcccccagccccccaaccccctacaggccccggtgtgcgatgttccccgccttgtgtcctgtgtccatgtgttctcattgttcaactcccatctatgagtgagaacatgcggtgtttggttttctgtccttgtgatagtttgcttagaatgatggtttccaccttcagaataggcaagtctttatagacataaagttgattggctgctactgagtatgtgagtttcttttagggaggaacaaaacttctaaaattagattttgatgacagttgcacaactgtaaatctaccagaagcactgaattgtatggtaaatggattacatctcagtaaaactgttaaaaaacacagttttaaaaagaatccaggaactggggacacagcagaactggatctcaatcctaattttttctcactttgtattaatgtactgcaaataattgtagctagcacaagagagcacaatgactgtcttgctaaggtgagttgggaggatttatttcgggctctgttaatacatgttcgattgggagagttgggcccagagttcatctaaattagtagtaccaagcagctgtttcagttaatcattatgagggctgtaaacactcaaaaaatactcaattaacattttaaaagaatggtcctactttgttaaaatagtactttttctctttttggcgtttttccttttaaaaagtagccctatgtatcttgaaatcttgctttcgttaaaattaaggtgttagcttaactttaggatattgcctcagaccttttaaaaaatgtatttgctatctagttcttaaactctgattaggaacacatgaatcattatttaatactacacaggttcaaaatagcttaagagagatggaattcgaggttgagcaggtggcggtgtttccgttttcacactctgagaaggccaaggtttcttagggaagcattcctggtatctgtatcaaccgttttcagagttattcagctggtgtgtgtgtgtctaatttcatttgggttgagccgctgactctgttaggttttcataaaaaatcatttcatttccctttccagcttccgtcctactggtatgtgcatgttaaagtgtaattcaggcttaactactttaggtgtaggctagttacattgctttgttttatgtatgaggaagctgagactcagtggtgataaggaaccttgatttggttgtatcactaatgacagagcttcgagttggaactcatctcctgattcgtttcttttggtgaaacatcctcttgatttctgagctttcaacctctatcttttcaaatcttacactaaagaataagtatctgcgtagaatttcattttctgttcccagaattgactttaagaatagacagaagaggtggttgtcagtgtagcataatggagggaaaaaaattaaagatgggcccttccttttcagccatttgttttcccccaggtaacaaaagaaaatcctccattttatttttcctagtaattaggagaaatccacatgtttcaacaaaggcagaaacagcatgaggactctgacctaatggattttagaaatgttgagatcataggaaattaaattaaatttcatgactgtctctcacctggcctataaatctcctaatctcccttacttctgctttggcctctttaagacccattcttttcaaagacgagactttttttttttaaaaaaaagtaaactctgggtgtctctcccctattaaaaactctgtaataccttatattgcgtttagaataaactttcaattcctttcttggctaacaaagccttacaggatctggcccatgctagtttctgacagagcaagagcatcaccatcttggacaagcaccgccattttaagttccccttgattaaaaaccgcctaaatccagccccagaaacatcagcctaatggctaatgtcagcatgaccataaaccacaaataacacttctgaccagaaactttccaaccctgagataaaccccactctgatcagaaatatgcctcccctccaaccagagacattacacccctgacaataaaactctcctccacccagaaacattccaagtctacaatatgctctccctccctaaaccactaaatacctttagtctgtaagagagaacactcctgaccgaaatcggccagaagcccctctcaggtttattctccaaaataaacctgtctctgttaagctgctttttgtgtttctttctttaactcttacagtttccatctccaggctcaagaaagtttactttctcatttcttcttccctcaaatgcactagaatagatccttacttagggcctttgaattagtgttatccttttcctggaatgctctatgctctgatttttgcgtctgttattcaaatcgctgctaaaatatctcctccttaaaagggcatcccctttactagccactcagtcaccatcaccatcacgtcacttattgtaacttctttgcatacagcttaaaaccaacagattttttttcttttcaccctcagataagttccctagaatctacactacttgtcttcatcattgttcaatcaacagcctagagtagtgtttgttgaatgaagaaatgaacaaacgaatgcaccctttcttccgtgaccctctcctctgaacagggcaaaacttaactcataacgaggatacactcaaaaatgtctttcttattgccaggtgtttccactcttgaggaacagatgccctttaggagacagggcaatttgactggactggcccttccgattttaggtgaaaataatcaccataacagcttttcatctctggctaggcttcccagtgaccaaagctttactttccgatttccataccacgtaaagacatcagggtgagcactagggccctgagaaccctggaagctacttcttggctgggatagggctggttgcccggtgcgctgtgagtggtcctccccggagatgctgggagaaggggcggagccatcagaaaggatgagccttccttgggccttcggatctggtggggctgccactttgggaagggccccgggcttcggaagaaagcaaaactagccttgtggcgaagaaggagcccagctggccccaggctgttaagactaaggggtcgagggaaaagaggcagagcctgaaaccaaatctgcggagcaagccaaggcctggggacttgccagagggaagggttaagccgtttccaaggcaacggaccaggaagcgcgcaagacgtccgccgcaggttcgtaggtcgccctcgaatttaaagctcccaaggctgagtgggtcccggccaatggagaggccccctttaagtcatgtgaccagcggggctgccccgcgggctgctccgcgggctgcactggagcacgtgggaaggctttttttcctgttccttctttccctttttaaacgcccacccacttttgcgcgggctcggccgcggaatttttctcgcgagaggcgcgctgccctctcgcgagagagagtgggaggcgtggagagtaggcggtgttgcgggccggagctgcggcggcggcggcggcggcggaagccgaggggtgggcagggcgggggcgggccgcggggctgggagggggagggctgggggtcagcgcgggagggggccagcttgcttgcccggctcgctcacgggtcgttgaggccggtgacatgtctgtgagctgcggaggctgcggcccccaggtgagccgggcgccgacgtgctcgccgcggaggctgcgtttagatggggtggcggcgggtgtgcggccggcatggatggagcggcccggctccggcgctccagcccctccgcctgccgctggtcccccttctggcttcggggccgcccgagagctgcgccttcgcatggcggagggaggagggcgggaggagcgcggccgaaggaggaaactcaccgcaccgggcccagagtagagggaggtgctgggtctcgagacgcgtcttcctggggtcccaagtgtggcggtggagctgccgccccttttaatgacaggctgtttccatccccggggtggtcttcagagacggccccccgggtgcgtggtgcgcgtgcttagtgtgtgttcgtggtgtgcgcacaggaacatttgcagcggttgggaggacgttgcactttgttcccgaacagcatccttcactgtcagacccccggagccttggaagcaggcgctgctcagatcttgtaaacggaaggcgtcaaggggctcctcagagtattgatatttggatttgctgtcaaatactctcctaggctgttaatggcttaaggctggccataaagtaccccgaatggattgagtatactgctgttaatccaggcatctaagctgctttataaaaaatatgtagatgtaaccgaagtattaaaaagtgacaatgacagtaaaagctaacattttttctcttccccatattaccagctttcattttttttctctgctttgtctgtcttctaaaaccatataaagttggatgtggtttagctttagatgttaaggagtttcatggtgagaaagactgctgagatacatacctaatagctttagtacaaactggagttaattcctgttctcttttcagcttttcaatcgcttgcaaaatgctcgttttgcttagctgcttcccactgttttagaaatgtcatgtcgattgttattttgttatgtctgaaaatactcaaaatatggagtactaagaaaaaatggggtatcagtaatgcacagatatattttttttaatgtcatcattttaggatggcagcccagtgcctggcatgattggtgtcagttaaaatagtgcaattgaatgattttttttttttttgaaaaacacatttactttttcaaacggtaccctgattattcattttttcttgtcgttgttcctcctgacaaaactgacccaggggtggacagtgaatgtcactattgtagctgtaacagtaatttatgaaaggtcaaagaatgtaaggaaatcagggaagaagtgggttcccaagctgagctagagactaatgtatgtacccacataactgcagtatcgacaatattgataagggcctagcagtggactcctaggccagtgatattttgcagttgttgaggatatgggaagttgcctaagacatggaaccatagtgagaaattctctagccttctctagccccctgaactccagggataagtctagaagctgaagaagtcctcttttgcctttagaggctggaaaaaatacggtacttttaatttttttattttttaattttaggaacttactgtctggaaaaggaactcaaaccaatttggacaatatattaaaggccgttttaagagaaaatgccagttgtaaataggtagaggaattctgtctatacgtgacaaaaatgtgaaagacttagaaaatatctctttgtgaatgggcagaggagaccagtgttgattagaaaaaattccttcttactccatcttagcaaactaattttcagaagtagaaaaataaattttttggctggtcttcataaccttttggcaagggtttcaaacttgtagggcgtgtggtgtttggtttttcaaaagtaattgaagtaactttggatagggtaactgattttgttttttttcctgtcttgtggtctgcattttattaatcaactacctggaaggattgaagggtgaggacaggtcgagaaaagctttaagttaagcctgggcatgagttaagggtcaatgagctggtaatatggggaagagaaagaaaaatgctttatcagtttaaaaacagcctggaaagatccaagtgtctcgattctcccagtcatccttacatataaaagtttattaaaaaaatacttctgggccaggcttggtgccttacacttgtaatcccaggactttaggaggctgaggcgggtggatcacttgagaccaggagttcaagaccagcctggccaacatggaaaaaccctgtctttactaaaaaataaaaaattagccacgtgttatggcacatgcctgtaatcccatctagtcgagaggctgaggcacaagaatcgcttgagcctgagagatgggagattgcagtgagccgagatcgtgccactgcactccaccctgggcgactgagtgagactctgcctcaaaaaacaacaacaaaaaacttctggagtaaaggcatttgaaatttgtagattagagactggacatggtaaaaggagaaaagttatcatttttagaataatctgagaatgtttcttgggaaataaatggggtagaggcctggaacagagaggatgttacttgactgaaaatgaggtatattgtaaagagtttcggtttgggagtcaggtctattaattaaatgagcctcattttcttcatacccacctcaaaaagttagtgcgaagcacatagtagctgcttactcagtgtttttatttttacctcccgtaatggtttgaggattctttgattgcaaggaagaaaaagccaatttaattagcctacttaaaaaaaaagcatttgtcatacagtgctgctgaagtccattgcatgattccaattcagcgttttgggaaccagaaagtcttcaggcagttactcttccagtttttctctggaagcacatggtcttatgtctctgctactcacgcaggtctgttccagtttctttcagattggccttctctttaaagctcttggtttccacttccccaaaactttgatttgcatgagactttggtttgccatgatgccaacatcagactcactgactatgcaacatggttctcagcaaacatctccaagtctcagttatgtttctagagagagaatccaattggtcaggtttctgcttctagcacagttggctggagagtgaggaaagataggaatgggaaaaatggatgaggaagagacttagatttgtctcacagtttgcagggctgctccttttaaactggccatgccaacatatttaacaaaaggagagtggacagggaggaagtgatggatacctcaggtgtgctttaacatcctgcaatttgagttcttcctctggcattgcattgaacttgctctcagcttggtaatgttctaaccagatctaaccagtagtctctttacaggacagattctcctgggtgtgggagttcaggcaaattactgaaatgcttgatgactcagttttcctatgcgtagaatgggcataatagcaccttctgtggtgagaattatgaattcatgtatgtaaagcaattaaacagtgtctggcatatggcaggcacaatgcaagggtacggtattagtatttgttgagagcataccgtgtggcaggtactgtgatacaggcttctggtcgtgttcagagaggaaggaatttctgccctcaagaagtctagaagtccagtgctgaccactcatgcttaaaaccatttcttgacttcagtgacactaaattcttctaaatctctacctcacctacctttctgactgccatttatttgtggttccttttatgccggtcctggaaccctttatcatggttgtcttcatagatgctctcttgaatttctgttctttcccagtcgctgagaccagctttcaggttctctatatgtggattattcttagagtaacatctccatctctgaccccaagtaaatctcttaatttttagttctttttttgggtattattatttatataatttatatgttttgagacatggtcttgctctgtcacccaggctagggtgcagtggcgcaatcttggctcactgcaacctcctcctcccagggctcaagcgattctcccttctcagcttcccgagtagctggaaccacaggtgtgtgctaccacgcctagctaatttttatatttttttagaggtggggtttcaccgtgttggccaggctggtctcaaactcctgggctcaagccgtccacctgccttggcctcccaatgtgctgggattacaggtatgcgcccactgtacctagcctcttggatattcctatgttgatataaaatactgtcttccagttaccttctaatttgcaaagccttctgatttaccttctgatttgcaaagaaaaaaattttctttcagcatcccaggcttaaaaccttaaagttatttttcacattcttctttttttatgctgtaatataccctgttagttaataggttctgtgtgggcttttgggtgcttcctatgactggcccatctgcaaagtagatctgttgacttatttcggctactggcagcttaggatagatccttatatctgtaagagctacttaaatgccttttcagcaatatactcttagagtcatggcgtcatagatgtcactgataaaaagaaatgtgttcctgggttaaaattctgaacatattttctgttagaaatagtcttgtggatagggctacgtacaagattaagaatgttactccattttctagggagcatattcatgttgaaagcacaatctcaagattttagttttttgttgttgcatttttttgtaggtattcaattacatagcattttaattatagcatatcatccttataatattgccatacacatatacaaagttttattataaatcagttgttgaaaatatttttgaaagtcaaatatattacagatgcacactcaatagtgaaactaagataatcatttgagggcatatatcctttacagtgatttcttaaaactgtattcaaatgtaggtctaatgagttttttattatgaaaatgttaactgttttatcctcctgccttcatctgattattctaattaacttctaacaatggaccgttgcatgtttaaaagttgtgtttattgttgctgaataagtagttttgaagtcagtagccattcacacttagtactttgtcaactagacccatgttattcctttcaataccagtggctagttgggctcaaacataccttataagtagatctcaatctggaatgcagttgaaaaatcaataatttttctctgtgactgtttgggaaaacaaaagtgacagaacaaatattcttggattaattttgtaaaaagtcattaggtaagtggccctattttctatttggtgatgttgcttttgccaccaaatgcctgtctgcattcacgtcattgatgaaatttctcttcaccgtacagctcgttcacttcagtaaatctatagttgcttattatgagtaaggcctttggggaatgcagagatgagtaaggcatggcgatggaatgaaattcactgttgtatcccaatcactgttacttagacgcttggtgaatgtatgtgttgaacgttggtagtacttacagtccagtgcagggcatagacatgtagacatttaactgttacataaggcactgtagtctaaagtgctaaaatagggtaagtggtgattttgctccccaaggaaatgtttggtaatatttggagacagttttggttactgcaactgagtgctactggcatctagtgggtagaggccaaggaagctgctaagtgtcctaccatgcatacacagcctcctacaacaaagacttatctgacccaaaatgttagtaatgctgagattgagaaactctgtagcggtaagaacatatatattgtgaatgcaggaatgaggttgaggattaaaaaggaaaaaggcagaaactataaagaagcaaatatcttaatagatattaagacatactaaaatcattttatacgattgactgttgttttgaaaaacaaaatagtatctgatagctgtagtagttttagattttgtaagtcaaataacaggtctgtacccaagaaaggaacttagcttccttatttgcaaaaagggggataacatcacttttattctgctgttcacctattaggtattattctgttttatttttctagtgtttgtgttagggtttacaagataacttattacaggttttcttcaaataacatcacttcatgtttaatgtagaaatctatgacagtctttttttgtctccatctcccctgccacattttttatcctattttgtcatacattttatcaatatgtctgtcttaaaccctctaattaattgttactatttttaaacagttatattttaactgtttaaaagggattgaaaaatgaagaataacttctgttaccctcatatttaccatttcagatgttctttattccttcgtgtaagattcagatttccatctggtattgttttactttgcctgaagaatttctttccatagttactctagtggtggtcaactggtggtgaattttcacggcccttattcatgtgaataaatttattttgccttaatttttgaaatacattttcattgagtatatctgggttgatgcttttttttttttcttcttcttagtactttgaagatagtgctccattgtcttgttttccggttcatatagatgtgaagtctgttgtccttggttcctctgtatataatgtgtactttttttctggtcaattaatattttttctttatcactggttttcagccatttggttatgatttgccttggctttctttatgtttattcttagggtttgctgagcttccttggtactgtcagtttacggttttcatcaaatttgggaagttctctgctattttgtcttcaaatttttttttcttctgcacccacttccccagtgcacgcacgtgcacacccacacacacacacacacactctctctctctcactcactcactcgcttactcactatgtctcttcgtggaactccagttattcaccttttatggtgcttaaaaagtcacttacactctacgtttgtttttaagttttgtctctccatgtttcattttggatagcttctattacattgtctacaagttcactgagcttttcttctctagtttaatctgttaattgtatccagtatggttttcgtttcagtatatttaattttcatctctaaaagttcaattttggtgtcttttgtatcttctccttctctccttatggtgatgttttcctctcacttcttgagtatatggaacatatttgtactatagttttacaatccttttctgttcctgccatcatcactgtcatttctaggtcttcatttattgcctttttttctcttggttatggttcatatttttctcttcctttgcatgcttggtaatttttattgtatgccagccattgagtttatactgttgcttgcttgatttattatattactgaagtgtgttggatttagttggggtgcacagttacttggaatctgttgggttgtttcagggcttgcttttagaatttattagtgtgggtccagaacagtttttaacgtagtgctgaattattgtctctactaaggctgcttctactaaggctgctacttcttctgaggagtctatcattacctgatacattacaaggtttttctattctggtggaatatattatggtttatctctagggctctcacttactttcagctctccctccagcttaataccctgtaaattctagccatcttggtctctccaaactgatctgtgtttaaaactcagtgaaaccaccagactgcttggctttcctgtccctgtattgtgacctggaagtagctggcagccagtgtttcccttctctcagggatcacaatcccgtgttccctgttgtctgatgtttaaaaccaatgtttcatatatattctgtcctgttttcttgtagttatattcaacagaatattaatttttaacacttggccatttggcatttggtcaaaatgtgtatttggagtgtttactctaaatgtgatctcagatactataaagtagaaattattggaaacacaaatgtattttcacaaactcattaaatgtagacatactcatttaaatatttgaaggcatactttgctctttattctgttttatatttttcagcctacatcatgctttgaactttgttctttaaatatgttactttttatttattagttcagcagatgtttgaatgcctactatgtaaaaatacataaaacacttttgtcctcatggaacttacaacaggagggaagtatgcaaacagtggcaccagaggattaaattataaaccacttagagagcacaaaggaggtggttactatttgggcaaggagggataaaggagagatatgagccaagcctattttagggagggaagtttttgaactggtgcgtgaatagtaagtagcagttcagctggtggaagagagagggtagatttgagagaagtttaggagaatgacaagtcaggatttggcaatttactaggcgaggtagtctgtaggaattgaggggaagaccagtttccagcttggcctactggttgggtttggtttaatggctcttactgagatagagaatacaggaggagatcgtttagggagaaagttttatttaccttttgaacatacaaattttggagtaactgggatatttagttggaagtgtctaataggaaattagatatacagaactgaagaataaattagggagttatttgcatagttaaaaccagaggtaaggataaaatgtccttgaaaaactaaataaaatgagacaagaggataaggatgaagactaagaaatattagtatttgagtaacaagttatgaaataatttaggaaaggaaacttacatacagagagacaagtttttctcaaccagaaattacatgtggcagttgttaaaagtacagattcctatgttccatgtagacctgttgaatttggatcttctggtgggggagttgtgtgtgttagaaataagctgatgtgtacaggtactgaggtttgagaactagtgcagtaggaagagagtcaagatatggcaatattgttgacaggcgcttcacagactggcatagttaattctcctgatacaaaaaaggtcaagtaataggtgatgtcaacttgaacatttcttaggtcagaggagataaggaaagacttggagaatatatattttttaattataaaagaatttatgttcattcagaaaagtacaaaactcaacatacatagacacaaaatgaaacacccatgattgtatctacccagatgaaaccaatgtctgtactcatctagtgtatgtcttcttttatattacatatatagatacacacatgtagttatacagatttttcacaaaatgggataatgctaatatgccagaacctgtcttattttacttaatgatctaccatcttctcatattgtagatagatgacattttataaaatttaaaagtcccacttgcatgggtgaccactggcatcagtttagtgtacctccttcaagtcatttcctgtggatgcacaaatatttacatatgtgtgtcagagttgtgtctgtatataattttttctttcttttttttttttttttgagactctgtggcccaggttggagtgcagtggtacaatcttggctcactgcaacctccgtctcttgggttcaagcaattcttgtgcctcagcctcccgagtggccgggattacaggcatataccaccacacccagctaatttttgtatttttagtagagtctgggttttgccatgttgcccaggctgttcttgaactcctggcctcaagtgatcttcctgccttggcctcccaaagtgctgggagccactgtgctaggccagtcttttttttttttttttttttttaaattacaagtgagagcatcctattaacaccattctgcaacttgctctttcacgccagtatggatcactctaactcattatttccaatagctgagtaataatcatgtgaatttatttgaattgatgaacttctagattattttcagttttttcattttatttcagtgaatagtctttcacatatctttgtgaattttgtgcaagtatatatgtaggataaattttaagaagtgaaatagcaggactaaaggatatgtgtatttatttaaagtgccctatatctctgttctctgtattctttataattgtttctgtaattgctttcatttgtttacttttgcattctgtgatttttcttaaaatcttcttggttttccattgtttttagcaatgtctgttctgcttttttgttatttctaaggggatttcatttgtttagtgatagttttctgtgtgtttcctgagctatagtggttcacttcgtagttgtttgccttgtctgcctctttcttgtctctcatctgcttttttccaagccatgtaggttcactttaatttctttgactatagataacgcacttagttattctttgcttaggactcttgtttcttcatccagaatagggcacaaagcagtaaagcactaaatgaaaagtttatcataatacaaatgtattttaggtgaatatactgtatttttgttcttcttgtgaaatctgtcaaaaacgatgtgctctctaattatataagatgctaaagaaatcctgctctagtagctgttatcctttcttcccccatcaatctttgcatcatttccaaagatgatttttttctttgctttacaaaagtatgtcatatcatctcatattggattcacttttatgttgcacagatattctctaatagatttctttcttcctgagacagtattttatttatgtttaaatgaaaaagtggtggagtaaggcagtaagttgtttttcttccatgagtgaaacagagtgtaaatatagaattaaactgtttctctttcattaatttcaaacaatgatttgaattctgagataatgtgagtctcaggggcatgattatatttgtctggattttttctttttatgtatattgtatgttgtttgtttttcagtgttccttcgcagatcccatactgaattccatttgctttattattcaatcttgaataagggtgttttatctggatctgctattcaggaaaattgtgggtaaagtgaactggggtagccagccctgtcaaatcccggatgttgtttcagagcactcccacctctccctgcccaactttgaaactgtttcttctaccttaggtgcttgttgcacctgagggtgagcagctcatttagatagttggtcccatttatttgatggtgaagtctcctgggagttaatgtttatctttgctcagttgactttagtcagcagctgcaaaggtaattgttgtttcctatctcttttccctacttcccttttaggcaaggttaggagcagactcagagaaagtgatgtaaggcgtgccattcctttgtcctgcagtattgtttttaatggctgccatggcgtcattgtgggaatgaacctaagatcatttaattactctcttgtttctggcatctagattgcttcgtatttctattgtgagttgtaatgaaccagactataaaacctttatgcactgtagaggagtggtgaagagccccagtgctggagttagaaaatttggacttgaatcccacctgtgccatttatttactctgtgggcctgggcaaattgctaagcttcctcttgcctcagtttttctcatcgtcaaaccggggtcctattctgtagtcttaaggacaacatgagatgtttacataaacctcttagcaaaacagaacacttggtgcattatgagcccttgttaataaactagatgctctaggatcattatttgctttgatgcattcccaaaagcagaaatgctgagtcaaagaagtatttccagggttttgacacgcattacaaaactgccctgcaggtgccactttacttaggagccttctttgacagtctctggtttcttggaacccttatgttggcttctatgttttatgttacatttgagaaaagcccacttgcctctgaggctttctggcagttgaggagaacactgtggagaagaaaggagagtgaagtggcctgggacaaataaaaggattatctttttgctttggccactatacatttttatacttaaactttgttttgataatttttggtccacttgatcattttggtccttaggtaaatatttaagtcttcttttgcctgtgttttatagttttcaaagtacctcccataaattatttttcatttgagtctcacagtaaacttctctggtaaatacggtatcatatacattgaggaaaaagttccagagacattgcagtttacccagaggaaacaaagctaataagaggcagcacagggagacgcatgatcgtcttctggattctggggtatcaccctttaccttgtgctgttgggaactccttgtgttaggctgagcctttctcatgctgctgcttcaatttcagtaattaatcagattttattgttatagagaccactagggcttatcttagttcagaatagaatacaatcatacttctttgtctaaaaattaaaatgtagaaatctctaaagaagtgtgtgtgtttgtgcactcacgctatagtcttatctgcatagcaaaagaatatacaatttgaacttcactaaaatttagttttttaaaagttctgacggtggggggctagattgaagtttgtttttgcgtataaatctcctcatagtataaatttatgttaaccaaatgtcttggaaacctcagctaagcaattcattttttgtctttttgtttttttcagaaactgggtcttacaatattgtctagactggctttgaactcctgggctcaagcagtcctcccacatcagcctctcgagtagctgagactgcaggcatgcaccactgtgcctggcttcaactaggcagttcttgataagaccagattgattttctgaaaatacttgaaactaagaatttcttaaatatttatttgactttttaaaaaaagtatttagttccccacttctactctttattgtgatgaaactttttcctttgaaggctttgaatgcaggagggccatatctatcttgtttctcttgtatccatagcatctagcacaagtagattttaaatgaatggacaagatactgtggtcaaatgcagataccgagtggttaatgcctggagtggatttaagttctcaaagatgttaaagcatctttaaaaagttgagacttagttttgagtgtttcacctggcaggtgttgtgtgtgttaagtactggtaatcatttgacttggatgtcttctgaaattttgtcaatggtatgctcttaagcttcctatacaaagaatgtatctaatttgatatgtacagatttctcattcgtctattatcaaacccttctgcccaagaaataagaatgtcaagagcattcactgttgccatagagataagagtgtcttgggaggcagggaagttggaattctttttgtaatattctctacttaagcttctatttttaaaatgttttttaaaaaacttgtttttcagatctttctctttgacactttgcaataaaaaagggcagtgagattgaataggtaagggtgtaaactattttataattttgaaccaaaatataagatttttataataattttctatctcattaaggtaccaatattcatatatttttcaaatattcttgctggattgcaagtaaattggggggggtgctcagattatttttgttttcatttttatttttcttttaatgactgagttaaaataaattaatttagcacaaaatgcttgcctgaattgttaagatcaataaataagttgttttaatatgttttctttaggtgttttgtggattaactcttcattgattatatacaacaaaaaatagttatggcgactttcagaaacaatcacatgaagactaaagcatctgtcagaaaagtaagttcactctattaggtttcttttagtgaaagttttaattaaaatgttgatttttttttaagtcctacagctatgatgttttgtttaaatgaatcttattatttgaattagtaacattgaactactgcaaagattggcatgtatgaaaatagtgatacaaaatcatgattacagtgattttatttcctaaagatcacagtgctttctccccattttttctctacacatagatatccatgtgcttttttgcaatataggctgtcaggtgtaagctttcttatatacctttagctttaccattcattcattccttcattcagcaaatacacacttgagttcttataagccagaccatatgttagatgttgggtaatcagtaacaagcaaacaaaatatgattcttaatcctttcttccttctagtctaaggaggaacctcctcacttcctttcttaaaacaatttggttaaccttccatttcttgacatttttgtctttgctaaaactttggaggcactacccatgaacaaagaagggaagaatggagcctggaagataattaacagtctttgttatttctttttctggacttcatcttctgcattatatgacaccattgaccaatccttacacattaagacaatatttgattttcattataggtttttcttggtttccttctcttttatggtaactcttgtctcctttgctaatctttccaaattctaattatcagtgttcctatgagcttctgggcctgccattcatttatgtagagagctaaaagatgtataggtttgactgctaagtctaagaggatggcttccaaatctacaggatgcctgcaaaatagaaagtaaacttatccttaaacagtatgttaattacttttttttttttgggacacagtttcgctctgttgcccaggctggagtgcagtggcgtgatcttggcttactgcaagctctgactcctgggttcatgccattctcctgcctcagcctcccgagtagctgggactacaggtgcccgccaccacacctggctaatttttttgtatttttagtagagacggggtttcaccgtgttagccaggatgatcgcgatctcctgacctcgtgatctgcctgcctcggcctcccaaagtgctgggattacaggtgtgagccactgcgtctggccaattacattttaaagtaatatgctccatatgttttgaggtaaattacctttaaatttaataggtccactttttaatttgaaaaaagtacaataaaaactattttctgtttctactctttgtaaactatagtgtatttattatactttttcagattagcaactagacccatagctttaaattgattatactgctggctttaaactaataactaataatatatacaaaatataatagcaaactgataaccatggtcttcaagaatgatgctacctgacttgaatatttaccccatacattgccagagattcagggattagacagcagctgaaatttcatactattattaccaggttagtgtcttttgttattcaacgtattgtccatattaggcactcagtaaagatttaatttgaattcaacttgaattattggaatcccttttagataaaagtatgtgaatccagatattacatactgtttatataaacagttatgcacacacatacaccaccttctacatcttggtgcatcttaatgtcagacacttccctattggctactgtggaaattgaaagatatacttgaattctttagatttcactttaatttgcattaaatatagagatacattaaatatttattgggaattaatgttgcaaaattaaaaatagctatagtttctaccccagtaattttttctaacattttattatgaaaaatttcaaacacatagaaaagttaaaagcataatacacacacaaacccacgtacctaccacccatattcaacagtagttaataatttgtcttgtttgctttgtgtctgtgtatgtgtgtatttactttcaggcagtaccatttgcaagttatgatcataatgtttcttcaccctgaacacttcagcatgcttctcccaggaataacaacatcttcccacataacactaataccatgaacacatccaagaaaaataaattcccatatatctaatactcagccatactcagatttcctgtattacccccaaaatatcttttatagttcactctgcccctgtttggatccagtctagcctcttagtctctgttgcctttggcagttaggacttagcatttcttttggtttgaaagaatttttcctttttttctttatattcaattctgacatcttgaataggccaggctagttttattttcttgtaccatgtttcacatctggatttctctggttgttttctcatattgctatttaatttgatcctctcccttgtatatttcacataaagtagaagttatgtttaaaggtttaattggatcaggttaagcatttatggcaagaatactttatagggtgatgtgaggacagaatttcaggttttcccatgatcagtgatgctatgattgatcagttgactaaggtgataaccctgctagcatttccattgtaaaagtacattttctgttttttggttagcacataatctgtgatgatacttggctgtgtgcaaatatcctttttttcccccaacaaccattgagctaatgtttttggcatcccttgcttactctttcctgaattcattatttcatgggagttgcaaaatggtgattttcctaattctaccattcctttcacatttatttgctggtattaaagaaaagcttccctcattcaccttagatgaactatataatatctcctatagaggcagggcaaatgccctttaattaccagttttcagattaatgacagggcatcatagttaacaccagtggtagcaagtgagtttatttccccacattaattcactaatttatttgtaatgctctggactcatggatttttgcagttctatattttataaccttttatttctttacagtcattaattcatctatgtaagttgctcaaatttttccaaaattgatacctgagagcccctccaagtaggtacctatatccttttgtctcaggctcataactttgattgctttttcactttcgggttgtatccttttggtacaggatgacctaatttcacctactttaccttcctcagacctgaaattggctattttttttttaaagaaccctgaatagtatttaaaacccaagatctggatactaggagttgcctttgcacttaccatgtcatgagtttatattgacagttcacgttcagatttcacatattttttcctgttttgatttcctgtttctaaattagtgtgaaaatccccgtttattaaggaaaacaaaattgtttaaaatattgaatattttcaagcccacagaaaagttgagaaaaaaacctagtacaatgagcacctcatatagtcttcactcagattcaccctcggttagcatcatacctttaagtatgtcagtatcattaccacctctttgaaaatcattaattcagtaacatcatctagcatgcattccaaacacagatttccctgtgtctcaagtatccttgtaactttttccttgcttctcttctaggatccacactgtatttggtcaaggttcacacactgtatttggggattgtatctctttggtcttccccattctagaccattccaatagtctaaattcttttctcatgcagcaaatcttctgaagagtctaggccagttgtgttgtagaatatttttatatttgggttcatttgtttttccctgtaattagattcaacacaacacctgaaaggtgatgttgtgttcattccggtctatcagatctgaagtccatattgttgatgttaggcttgactaggtggttaaggtaataaccaccagatatctccaatataaatgcacataatctctttatgattaatacacttaataaactataaggtgatcctctgagacagtatgagtgtccttttccccagcttttaacccagtagatttaggatacatggataatcctttcctaaatcagtaattgcattgggagtttacaaatggggttttctaactttgtcattctgtccatactagccagcatttttaggtaaaggagctcctctgactttgtctcttttaatggactcacagattttttttaatccagtagtcataattcattaccattttcattcttcttgattccacattgtcccatatttggccagtgggaattctttcaagctggcttctgtgttttttgaaattaccctattagtctttgagcatttccttgcattctggcacagttagatgttccaggctcgcttcatacattctcagcctcagacctggaaccagccatttccccagggaaatctagttctttttattggtgatagatatttacagaccaaaagctgggtgctgactatgctcattgccactgaaggtcattgtttctaagacttttcagtggaaaaaaggtagtacatgtattcaaagaattacgaatttgtaatgacaggtcagattcaaatgtaacagtacagctttttatcataaattctttgagtttatatttgtacctcttagactaaagatttccatttattttaatttattaagattgcagctgtttgagttaatctagtgtgaggttctgaaatatggggaaacaaagtgagtgaaacacagtctgtgacttccataatttgttttaatgggtaggaaagaatctgattatagtaattatatgttttttgttttcgagacggaatctcactctgtcgcccaggctggagtgcagtggcgcagtctcagctaactgcaacccccacctcccaggttcaagcaattcttctgcctcagccttccgagcagctgggattacaggcacgtggcaccatgccaggctaatttgtgtatttttagtaaagacgggctttcgctatgttggccaggctggtctcgaactccttacctcaagtgatccacccgcctcccaaagtgctgggattacacacgtgagccactgtgcccagccaataattataatatgttttggtgtggattaaatgatcttagtgcacaacatacagcaggaactttgagagagatttattaggactaaggaatggaaaaatcttcacaggtcttgggatgggtaggatttctacatgggaagactgggaagtaaggacatttctgattgaagagcagattgacaagtcagtggaagggggcataaggtagaaggaaataagtgttctatttatgcctgactataatactcattattttctttatgtaactttttccttgtacttgtgacaaacatctcaccctgaaatttggaatcccctctcattttcatcagacagcttccttaagatccatggaaaaccttattttggattattatcttatttttctgtctccaactttgttaatggagtaatcactgttgttaagggagtaatcactgttgtgcaccttaccatagctcccacatcatctcattcaatcatataaattgttgcttctgttctacgccagtgacttggaaatcagatatgcagtttgttaagttttagtgtaaggtaagagtaagtgaacctggtatgagatctcacgtgatcttctagtgagttgaatgcccaggctccagtagtatgtgttttgggcatgtgaaactctgcctaaaccttttcagctgaatggagcttttcttctcagtggaattgagttccgcattcagtatcaaaaggtgccagtgaatattagttagagaatgagtgactatctaaaacatctccaggatctcttacccttgtcttagaattaaataaatttgaaatatctttgctttctttcccctgcagagcttcagtgaagatgtgttccagtctgtaaagtctttattgcagagtcagaaggaactatgcagtgtaacagcagaggactgtttacagcaggatgagcatgccaatttaactgaggtttaacatactactttctaaaccctttcctaataatgcacagcatattttcatgcatctttgtaggactctatgatctatttttaaaatgcctaaaatctctatttgttgttacatgtatcagaagtacctgttttgtgggcgggagaggggaaaaaaaagaagtacctgttttaaatactggctaaaataattttcttaattgacaatgaactcaaacaaatgagcacatttattttatgcagagtactaattggatatatagcattacattagatgatgcctactatattcagcaactgatactttaatatgaatttttctactctgaaacatagaacaaatgcatgattcttatgttgattttttgggttattttcttgactgtttaaattcagtgctttgattaaaaatgaaaaagtagtgataaatttatctttgaaattaagatacttactctattacttgaggataagataatataccttgctcacctatttctctgctacatccagtgtttcaaatctttgtttgaatttattattataaaaagagtaagatccttttctataatatatccatacttcatcatcacatttgttaccaaatacgagatgtattaggtcgttgcagctcacaactgatgaatatttgaagttaaaacattttattttgaaataagcgttctaataaaatcgtggttatagatagatgctcctggacttatgatcgagttacatcctgatagatccatttttcatcaaaaatattctaagttgaaaatgcatttaagacctcataaatccattgtaaagttaaaaagtcagaagtccaaccatcataagttggggactgtatgtattctctttcgggtggatgattttcttaatattccttgagaaattctctatttgacgtcatttcataggaagatgagcatatgttttaggcctgtagtgttctggtgcctcatcctctttttgtgtcagcttaatttcactattattttctttgctaacctttttcattttactttagcaaaaccaagccactcttaatctacttggttgtttccaaataaacagtggcagaacataacaggcctaatacatatgctcatcttctatgaaatgatgtcctgtgtcctgtcctccagtggttttccagctcggataggtcgcagtgcttttccaagcccacattccttggtgaggcctttcttgaccaatgggaaagataaaactcccccggcatcttcaaaaccctatgccagcttattttctctcttgtattcagtaaagcaaacttgaaggaatagatggaatttctattccattttagggtgtgcaaatctctgagtatcttttcaaataaaggaaggaaattagttatttgcctatctgttattgagtgcctgtaatgtgctaggcactttcctctacattatccagttaacctcagaactatgagagggaagttgtattgccttaagttttacagataaggagacaggctcctagaggttagcaattcacctagatgcctagaagttaactgtatgtaacacttacatgaagtaatagccataattaatcagaataaagatctcagagtaatataagattctgacttgcttctgaatcatcagaaatagatcgaaaatatattcagtgttgctatattctgactatactattgtccccacattcttgagaatcgattattaatattgccgtcatttaagtattgcatattttttagccacagtggttgcttagtggacagtttactacactgtcttcaaatggaaaaaatgtcttactatgatgccaaatacatagagaatataaatgtaaaaagtaacactttttcaggttataaaagtagtatatatatatttttttcttttctttttttttgagacatagtcttgccctgctgcccaggctggagtgcagtggcgtgatttcagctcattgcaacctccacctccagggttcaagtgattctcctgtctcagcctcccgagtagctgggactataggcatgcaccaccatgcctggctaattttttgtatttttagtagagacgaggtttcaccatgttggccaggctggtcttgaactggcctcaagtgatccatccacctcagcctcccaaagtgctgggattacagacatgagccactgcacctggccagtatatattctttgtagaaaaataagaaatactcaaagtagaacaaagaaaatgactatcattgatcttatgacttagggaaaaaatgcagaggggaaaagaatgggaaaaaaatagctccatcatccagagttaatcactgcttatagtttggtgtattgccttccagtattattttccatgcatatgtttttaaaaataaggttgaaattgtatgcaggctgtaaatcatttttctatgacttgtcctttttacttaataatgtgacagttcttcatgcattaggtattctttagaaagtctgtttatataaagttctgcagagtaatctctacataaggatattgaaggaaataaatggtggtatcacagagtcaatgaagaagtagcctcaggagtctacccagggggaaggcctctctgaggaggtgacacttgcatcgaaacttgaagaatgagaagccaggcatgtaaccatccaaggaagagagatccagattgagggcgcaactgtgaagtccttaggcaggaatgtacagggcgtgttccagacccagaaagggggctcgtgtgtaagtgaaaatggtagaaggatgaaagcattaggtaacctcacttaggattttgccatgggaagcatggaggagtttgaatagggaggtggcatggtaataggaccaggtgggagaggattgtactagtgtaggtgagaagggtggctggggaatggagagaagtggatatatttgaaatatgttttggggttagaattgattgaacttgctagtgagggagaatggatgaggtttaagaactgcgttttggagcccaatctttggtgaaaaatatttttgggtcatctttgaaaaaaatccttttcaagcagacagcattttaatgctttgtctgttttttcctgtttgtcagctctgtcaccagcctgaaagatttaaaaattcaaattaatggaggtttatttgttctttactcaggtcacatttctgggttttaatgaagagacagatgctgctcatatacaggtatggtgaattttagcatttttactgagtattcttgtcatggaaatcagctttaggtttgaccacaaaagtcatttatctgagaaggttgcaaaccgcagactgactttttctgcattctgtgtataatacagaatgtatgacttgtttgtttattttgatggctttaataattttgaccttaacagtaaaaattcttatgtttttagttaagattgagttaaatttaaaaggtaagatttgtaaaaattaacaattagccaatgcaaaaatttagcctgtttgatttaggcagttattgacagagggactgatgtttgagattgggatcagcaaaggaaagcttcacagttacataaacagtggttgaagttcctgtacatatgataggcatacttttctttttccctcgtgctgcttcttaaaaatttgtgattcctacatatttccttttgtggcagtaaagtgtctcctcatagaggaggaaataacatttttaggtctttctgaataatgcatatcaggtgattatgggcaaaaactgctgtatattttgattgtggccttgcttgaaggaaataatttggacagaaggaacaagagaggatatattcttgagaacatacatagctggaaagagaagtattccaagatatttctttaatgttcttcttctcctttaagagttactgataaaaccatgtttataaaggaaagtactctacaaagggtcaaagactttaataattctttagctgggtaaaatatttgtgtataaagggcaaacaagaagaagaaataaaagcgattttcttttcctttaatcttcattaaaattatcagttaaagtctaatacaataccttggagaggaaagatagaaaaacggattatattgtacagagtttttaaaaaaaagtttttaagatgtacattctctagcaaaaaattttgtatgaaaaaaatttcataaagttaagttaagacctatatgttgacattgctaaaaactattaaatgcttaattgtcatggatgtgttaggtaccctgtacaatttttttatagcttgatatcagtacattttaaaggctacggggatagccagtatttaataattttagtatattttatttttgaatttttgaaaaattatctgtgaataataaactgtatatgttaactattatgaaccaggaaattcactagccagtagaccttaaaatttttggatagggtccacattataggaaccttaacaaaagtgttactctacagtgttacttattgttattattttaaatcaggatttagctgcagtttctttggaacttccagatattctgaattcactccacttctgcagtctaaatgaaaatgaaattatttgtatgaagaatataaataaaccattagatataagcagtgatcctctaaatcaggtaacttttgtagataatttctaatgagatttttagggcaaattttactatatttgataaagatgattaaacttttaaatgcttggatgacatttgttttttttaaatggtatctcaaggaaatatgattcataagaaatataactcatgaagcattgacatccctgaaggatataataattttggtcatatcttataaattatattttttaactgtgaagttccgtagatggtatgcaagtacatgttaattttttctgaaaatttattatttctggatttcttgaactacttttacctttgtataagctacagtgacttttccctattatggccaatttcaaatttatataaatgttacgctatatgttttagagaatgtacttcagttcattttctggtttaaaaaaattccatgtaaagtggacatctgatgtgttctttataaataaaaatgttaccatttcttacaggtggttagttttataatattcagcatttagttctttaccaagtatgattttgttgataatgcatcagagaaaatgctttgcattctaagagataagacatatacaattgaaccagaaaatttaaaatttggattattttagttttaaaaaaactgctatgttgttctttataaggtctgccaataaaactagaactgcttgcttcatttccttaattatgttctttattcgtatttgctttatttgctaggatataagaggtgataagctattatatttgatttctagttttttgaataaataatttcatcagtatttacttgaaaaaagtagtatgagggggaaaatctggttacttgtatttttaaagctataaacattgtaagttgtaatgctagggaaatttaagtaaaaggagtagacttttaacaattgtgataggaaggaagatggcatcatacttgaaactacgggaaaatgggattaaaaataaaagaaaatagaacttggttgctgcccccaaacaatttataatagttagtgagataggtgaatgattaaggaaaatcatagggctgtacagtaatacaggaaaacataattgctcaaaggaatggatagtaagtttcataacatttcaggagactgggtagaatttgaatacctggataaaagaagatgggagaaaaaaggactggaaagtgaaaaatgtagagaaagaattaagaagtaaacattacaaaaccaaggagcttttcaggatgcatgaatttcttgtttgtttttttctctgagattgtcttatatctaggctttacttcatgttgttttgtatttgaaattaaaattgtttttattatcttttatctttcccaagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggtttgtttttcattagactttttcctaaaatagggaattaaaatttttcagttttgaaaattttaaggcaggcttgttcagttgaaatttatgttgagatttgattcaatttaaaccttttaactttttttctgattacctaaggaaattccttatgatttttaagttcattgtaatctggttttcagttttgcttatttcaggttttcatatttagttggtgctgttcacgcactggttacatcattaagtgtctggaacattcctaggttccaattttggaagagttagctggcagagtctccacggtaatttttctaacatgcgtgacagcatgcaaaacatcccatagaccaggtatccctagacatagagtaaactgaaattattttataaacagtatatttactttcaaatgttacttgggtgaatctttctgttaaacatagtttagaagatacacataaatattatatgtttaaagtcagtttattccatggatttaagttaatttccaaaaagttttgttcaaaaataatttcaccatttcattcttttcctataggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctggttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcaggtaagtttcacgtttcttttggttgttaatgataaattaaaaagataaatgtgatcctatatgtcttaggtcctgttcataaaggaatgattatttttaaccctacataaacaaaagttttccctgttgcatttatgtattgtttcatatcctacacatgactttaatatattttggtctcctgatcccttttgagggaaggtgttatccatttacagagctggaaaatgagggttggagaaaataatcaccttatccaagttcatagagctatgaaataggtaaagttgaattaaataaatagctagagaattttatatagtagtccccccttattctcaattttgctttcctcaatctgaaaatgttaaatggaaaattccagaaataagcgattcgtaagttttaagttgcatgttctgagtagcatgatgaagtctcacaccatctcactcaggatgtgaattacccctttatccagtttatccatactacatgtgctgttcacctgttagtcacttagaaggtatctcagttatcaggtccacaaacctggtatgtacagggcttgatgctatctgcagtttcagacatccactgggtgtcttagatcatatcccccatggataaggggggactattctatagtaaatgtagaatattactatattaatttactattctgagattaaatttttgtacacctttcttcattcacaagggtaagttttcttataaagaccatggttaaactactctgaagaagaaagtgaaaattctttacatacttacaccatttctcttgattggttcacaatctaagaggacagttctttctggtagtcctacagtgtcctgtttttcagtagctatctcttgtgctcagtgattctttttttttttttgagatggagtctcgcactgttgcccaggctggagtgcagtggcacaatctcagctcactgcaacctttgcctcccgggttcaagcgattcctgtgcctcagcctccctagtagctgggattacaggcacccaccaccacgcccagctaatttttgtatttttagtagagacagggtttcaccaagttggccaggctggtcttgaactcctgaccttaggtgatctgcccacctcagcttcccaaagtgctgggatcacaggcgtgagccaccgcaaccagccatgctcagtgattctttaataacaacttagttacagtttttcagtttaaaccttctttgtccctgagaagatatcaggaccaacttgtgttattagttgataggatgatatttgtaagtcctgcttgaaagagaaaatgctttaagttgaggtggaatttaattgagtcacatgatattccagatttttgagtagcttctgttaaagccatgacatggtctgcctcttttcttatccatcttaaaatagggagatatagcttggccaggattcttgaatccaattgctccatagcgtctacttgagatgagagatgatgtaggtttctggtgaactaggagaggtctctatttgccctaatcaggcagccttctttctcctagaccaggggttggcaaactacagtctgtgggccaatgtggcctactggttgtttttgtatggactgcaagctaagaacagatttcatgtttttttttaatggttgaaaaaaatcaaatgatattttgtgatgtggaaattatatgaaattcaaatttcagtatttataaataaagttttattgggacaccaccatgctcattcaattacacatttctgtggctgcctttgtgctataatggcagagttgagtagttgggacagaggctgtatgaccagcagtgcctatgtacttcctgtttggcctgtattagttcattttcacactgctataaagataccacctgagactgagtaatttataaacaaaggaggtttaattgactcacagttctgcatggctgggaaagcctcaggagacttacagtcatggcacaaggcaaaggggaagcaagtgttttcttcacaaggcagcaggagagagagagaagggggagctgccagacacttttaaaaccatcagctctcatgagaactccctcactgtcatgagaacagcatggaggaagccgccctcatgatccaatcacctcccaccaggtccctccctgggggttacaatttgagatgagatttgggtagggacatagagccaaaccatatcatggcctcttacagaaaacaattgcgaacctctgtcctagatccacattttcgttttcactacataccagttcctagtatgataataaacataataaattgttaataaatattctcatgaataggtaataaattaggcctttttacaattgaaataattttcctcatacaggttgcttcaggctattttactttttactcctcctcagttcagtcctgtctgccctacggacccatccatccccctttcctcccaccctcatgggaagaaaagagactgtcctctaaagtttttaagacatcactctcaggggctagcaaatgcctttgttattgattttctcagtaatttccacttttccttcttagagttgggtgagtagatagcccctaaagttcttcctgtaagccagtgctgtccaatttcagctttttattaaggctggagtaattattttcctgcttctcttcttaataattgtgctagggttctgtaaatactgactaaggaaagctgactctagtgtgtagagtttacgtttaacattttttatttctaaagttaaatttgtctttcaaacttgaaaggagattcattcagatggattattctttaaggtattatttcacctgatgtccctttttgtttgattcatgaacatgaccataaatatttcacaaactgtaatgaacagagaggtggcatgtgaatgcaattgggaaattatgtgatagtacatttttattcatttttgtttgttgttgtttgtttgtagagatgagatctcactatgttgctcaggctgatcttgaattcctgagctcaagcaatcctcctgccctagcctcccaaagtgctgagattgcaagcatgagccaccgtgcctggctgatagtgcatttttagccaacaaaacgattatattctaagctatcattccgagccaaaataacctcacagtcattataaactcttctctggacctcatcctttgggtcatttcagccaaaaaccatgagaatgtggcacatattaggaaaagtattcaaaaaaacaaagtagtaatctatcaatggttcagaactataatgtgcctatgcttggaatgctcagtatcattctgtatcttacaaaattagaatagctgaaaaaatggggggcaattcaggggctattctcaggatagcactagggatacggaagtaagtaaaacaggcaaaaatctgcattctcttggagcttatgttatagtggaataagacaataggtaagtaaaatatatagtatgtcacatagtgataagtgctttgggggaaaaataaagcaaggtagggagttagggagttagagagtgctggtggtgacagtggcggtggccattagggctggtttacagttttggataggtagcaggggaaacaatactggcaaagtgatacttgagccaaaaaccaaaagtgaaatgagaataagtcatgtgggagtcaccgagaacagatttccaggcctaggggtgggactgtgcatgtttgggaaacaacagagaggcttgtattgctgaagtgggaggagtgggccagggagaacataggaggagtgggccagggagaacagtaggagttcagatggatgttataagaggggacaggcagtatgttttaaggatttgggctcttcggcttggtgggaagccattggaaggttttgatccgaagactgacattttttctttttatggaaacatcactttgaactactttgttgaacataaaatgtagtgggacaattaaaatagttgagcagtgaatggactttcttgtgatgatggaataaaagtataaatgcctcttattgagaaaaatgaaaggggttatgatctatgttcaaaatcttgaagagatttggttagtttgaatacaggcttggttgacaatactagaatttcttgaacgacttttttgttcttaaagccagaaagagactcctttaacataaataaaagtactgttttacaaagcagatgataacttaggaacttgtactgccccatggtatctcagttgaaaaatgaactgctttaagtagaatttagagaaataatgccctagggatagatccattgtagattaacaaagtaagttatggctgttggtgggtacctcagttaactttgaaattaatacgctatcctacagtctgtttgttggcagactcaaataaaggattacatgagccactggtctgattccgaataccatttcttgtttttatcatctttgtcatcaaattgatagtcttgtaagttcagaatctgggatgctttcaatttgattttttttctttttttcttctttttagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaaggtaactacacttttgcatataattgtgtagtttaggtcctcagatcttagaagtgagctataaatttacattattatttaaaaattctaaatttgaaaatatgctattactttcaaaatgtattttattattcacaatgtatttctaattgtttttaacacttatttaatacagtaagtagcccagctaattttattggggtgtgccaatagttgatttgaaaaatattgcatacatttaattttatgccttttaagcttctcccaaactttttatgaacttctgaggaaaaattttttttttcactttaaaaagggtacttttttttctttaaagaacaagaaaaaggacaggtatctgtaaaaggcatcaaagtagccctgtacttttcctgacattagttaaaatagtatctttttggtggggcgagggtccctgcttgtcctgctgttaggaacaaaatgacctggaagacttatgcttgaatgattgaaaatacgtaagtcaaagccattataaaaatgtgattttgtatagcacaaggcacttacctcatatataacttttcttagttaactttgttcataacagtggtgtttgaaatattttattaattatgagacagttgtttcttatagtcttaacctctacctaaaggcatttctgactaacctataaaattctataaactctttatccacattaagtgataactggaaataatagataccatttgtagcagagtcttgagggaggaaagggttcttagcatattgctggtttcaggcatgtgtggaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtcaaaaaaaaaaaaaaaagactgtgacaatttgaaaacaccttgccagtttcattataagcaggaagttcagtggagggcaacaactaaaaaacacactaatttcagattttcaaaagtgtttaggaggattatataattatttgatcagaaaagaactggtctctgtctgtgactgtcttaaatatttaggtagtttgttattctcttaggaattatgaattagattaggttaagggatggggccagatttgcagaatgtttcagataatttttataagatgtatcacaatcaagaccagtcttgatatggctaaaagctgcaataaagcattgcagtactggaccactgtagtacttataccactggttggagtactcctgtgctagacataggaaatatgaaaagacataaaagaaagtgatggaagcagggtagtgtttcaagagtgaagtaggaaaactcttaagtgaagaaattaagttttttaaatgttgggttaatacagggtgatcatacttcccacttaggatagtttggcttatttctgctgttctgttgtaattattaacggtgaggtctttaaaaaagtgtcctggttagatgaaaaatgtatacagtcacctagttagaagtggcattttatgaagaatgacttcaaatacccatttggaggcacaaagagggaggggtgataaggttagagggaatttgaatttttagtctttacttcgtttagctgtttttttttaatgtttatgtaataggtaggtgatggattttattaagtggaagaatctgtgtgatgggtagaaaaattttatatttttttgttataatcattctattaatagaagtaaatagagtgtttgagatgattaattttctttttctcctttgctcacagctgtctgtccattctttgtttgtatattttcttatttttagtttatctgacaatgaactacatgggttttaacagttttataatagagctatatttgtttgaacatatgttaaaaagaccctgctcagttttaacttttactctctaatacatcatgatttgtgacagtttgatcatgttagagtgaatataactatgcaaattatttgagattgcttggaagttttttagaacttgaagtaatcacctttttttgttaaccataccaacatttactgatgtacataaaatgattttatgtttacttttttagaaccaaaattttggtttgtataaatattactttttataattgcctagcataatattgggaaaaatcgctgcttatcactgcaaactaatgtgcttactaatgtttaataattagaaatgattagaatttttaaattgcatgctgagggttttaatctgaaaatttgaatttaattttatttctgaacatggttgctttttttaaaaattgctttgctgcagttttagaaagtagttgctttcttcttcagttgattaggtagtgtaagacattatctgtatgtggcatttgtgactggccaactagacaagtgtaatgcttgattaagccttggctattctagctgtattctgaagaaaatgtttgttatttgccatctactgaattatacataatatatgaaatgaagataattgacataatagtattttaaaatctgagaacatgttttgcccaaatagttagaaaaggtctgtttgggactatgtctttatagagtcttccatcccatctccccccaacatcccctcacccatacctgtcactgttttgcactatctaaagacctgagagaatgttaacctgttttttttaactttatccaaatagaaaggtattggcatttcacaaattatagttcaagattggtcctaagacattaattttcctgtgaaacttattacttcatgcattcatttgctgtcctaaaagtcattctgttaatctgtaaaatataagtttagataattttcatgatctgttgagaagaaagaaaaaactcccgaatctctgaacttgtcaggcaccttttagcataggagtgatggtcaatctcctctctggatgttccccttcactgtggcagcttcagaacatctgcagttatcaaggacagaagctgttccgaggaaacaaaggtcttttctactattcattttctagttcagctctgttcttttcttcctctggcagtaatggtaacagcagtagctggagcagtcttggtttagaaggagatttgtatgaggacaatttatcctttccaacatcagacaggttggtccagtctagaaacttaaaaactgatgagtctgtcaccactaatgcatgatgtcatattcttcaaagaatgtgggttacagtgccagtatgtatcaacctgcttttctcctatattttgacatgattctgcttgatgaattcacatctaatgaaaaacttcaactgtgctaagatatgactgacatctaattgcaaaatgtgtcactgttatgcatgtgttgctctgcttgctatttttcattctaccaattatttcattcaaaagagcttgcttcctacaggatttctgttgggtttttttgttatgttttatttttgtgtgtgattttattttatatataagaaaagtataggtaaaaagtgtttttactgtattaaaaatatatataaattgcatcagctaaaccattaacaaatattcctggcattttgtaatattcaaatgctacattaaattagtagactatttcaactttaaatgattttaaattgaatattatgaaattacatggcactatgtatcatggtaaggtaggatttcttggttttgataactttagggatcatttgcaattcagattttaacatgaaatgatgtgagaagcaaagcttccttttttaattgtcatttctcccctttctaaatgtcatatgtcatattgtaacattcattcattaccacatttttaagaatttgttttgataccattattaattaaattttttttgtaactgcttctgctattttattcataagtgatggaccagatgataaagatgaagagcatgaggacgaagtagaaggtaatttgatttgtttttcaaagtgttggcatgtgttttgtataaggtttcctagaagagtctttatgcattttcatcagataggctctaggttatcagtgtaaaacattataaatcagggtattcttgaactaattttgtttgtccacttttagatcctttgttgagtagttttatttgattgctacactaatgaaattgtcattggtataaagaaatactgggcaggcacggtggcttacgcctataatcccagcattttgggtggctgaggtgggtggatcgcatgaggccaggaatttgagaccagcctggccaacatggtgaaaccccatctctactgaaaatgcaaaaattagctgggcgtggtggcgggcacctgtaatcccagctatttgagaggctgaggcgcaggattcacttgaacctgggaggcagaggttgcagtgagccgagatcatgccactgcactccagcctgggtaacagagccagagactctgacttaaaaaaaaaaaaaaaaaaaaaaaaggaatactttatgagaattatttgactatttgagagagattaattacagtctctctacataattattttcaaaatacaaaagctaaaattcttactcatgttataagataatttattataactatggcatattattttcataatattttccttccaaactggtaacttgtagaaccagggtttcatgtcaaacttacgtgagtcagtaagtaatatttttacttaccttgttttctaaaagatatttctaaattaattattcttccctcccccagttccagtgcttcactcacgcatacacatatttgaagaaaatactcagatccttccttaatgaacatagttccaagtatgtcaatactagatatcactggccacagagttttggaccatagtttgtaatccttaattcatgttagagtatctgagtttattcatctgagtgaatttagaaactttactttgaagctgagttttcattatattcaggcggttgttgaatttttttctgaaagtctaatttttttcttaattttgaaaataccaataatgtcttctataaagtgcacttataaaagtatttgtactctttgagatatttgtttttgaactagtgatgttttaaaaattgcttctctagaagcaggcaaacagaaaatagctaaaaagaatttctcgaaatttactttatgacacctgaattttcagttagtttaacaccttgtttagggaagtcacatcccagtttttaagctgtaatcttcagacttaagattattattttttagttttaatgcctctgtaagtagacattctttatataaggcttctagaagtcagtttttctcatcagatataaagtcgagatggggcaatatttttagtgttattgatatttgatattgatattccccactgcaatatttgtttcattcttgttcactaaaaaagtgttgactttgtttataaaagttatgccttttctcaagtaacatctgtgaacagttattctaaaggctatacatcgtataaatgcatgtggttacgtattctctaatgaactagcgattgtttaactagctttactgaggaatgattaagaaaaaagaagatacaagttaatgtaaatatgaaatttatcttgaaaaagattacttttggcactaaccaggctgttaaggatttcttttgtagttggtagaaatcaggagattaattatatgttgatatgtcattactgagtttttgagattataggtatttctcattatatagaaagttacagccagctttaaatttgttagagattggtaaattaggagctagattggtctggatttatagaaagattcaaaattatggaaatcccaaggcaacaaacttatttttttaaaaaaataattttgtagttgcaggatgtcagtccctccccttttcactaatggttagagacttctctaaagagagagccgtttggaggttcttgtaggccaggcaaccaggagtcctgaactgagaaaacaccagcagtgcaaagaagcagtgggatgattagcttctagccccctgaactcctcaggattgcagaaaggcccagagaccatgccttgtaccatggtatgccaaacctatttttgattgagagtgttggagagaggggagggaagagacaatacatttatttttagagagtaatgtggaccaaatctttttaattaaaaattagggaccaacacaactcctaaaaataattaatagtggtctagaatggcctgcaagctgtagcagagaatcagagacatctgtcaacaaccttccattactggtacatgttggcatgatgtctgccagcatgccctggtgctcacctcttgtggtgtgtgttaaggggtggaggggtcctggtctcagcactccttattgctcaggtatcattaagcagcaggaatgttaaacgcatgatattggcccataagtcattatttctgtcaacagagatggatccctctttgtgatgaaaacataattatcataaaaaaagaaaataaatttgagataatcttgagactagaagtataccagaaaattccctgatctggcttttgggtgtaagtggttgcatatggcatttccccccacttttgtctgaagaatgagagattaagagcatggagccagactgcctgtgtaaatgtcctggctcagccacttccccactggaagactctggggctctctttgcctcagatctctcacctgtagaatggagacaataatagtttctacctcatagagtggttgtgaggattaaaggagtttgtacatataaagagcttagaacaatacttaggatggaatatgtgctgcacagatgttgctgctcttctttatttgagatttctgtttttttgtggggttttgtttgttttttgggacaaagtcttgctctgttgcccaggctgggtggtgcaatctcggatcactgcaacctctgcctcctgggttccagcgattcttgtgccacagcctcctgagtagctgggactacaggcatgtgccaccacgcctggccggattttgtatttttaatagcgctggggtttcaccatgttgggcaggctggtctcgaactcttggcctcaagcgatctgcccacgtcggcctcccagagtgctgggattacaggcctgagccaccatgcccagcctcatttttatttttattgtaatgatagctttatagttttattttctctctaacccactggtcataatttatatcaaattatggcatttatagaacttgaattcagtatgttaaaatgatgttttatatttttgcaatcaataaatgatcaaagttattcctttgttttacattattttgccctttagaagttttagttgaggttatggtgtggttagaaaaagatggatatttttttcaccattcattagaatcctaagaaccagaaaatatttgtatctacttgacaaccagagtattgagagttaaattgatgagttttactttatattgtttacatttaaatattaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctagtaagtacctaccttacagagtgtgaggatacatttaacagtatatgatgttcttgtcatgtgattggtctaacaagatgcctggtgatggttaaattcttaggctgtagtgtccaacagtttgggttcagacatcagctctgccactttctagcagtataaccagaggcaggttcaccagtctgtctcattgcccctaactgcactatgcaaatgaatatagaatctaccttacaggggtttatgaggattaaatataatgttaaaaaaaatgcttggtctaatgcctggcataacactaagctctcaaaggtagatgctattaataagcattgtgtgtgttcctatgaaaaaattgaattattctctgtatttaattgatttgtaattgtacctaatgattaatatatctgtttctctgataatccagtttcatttgtatgagcagctgtcataattaaaagccgataaaagtttaaacaagatgcttactatgtgccaagtaccttattagtcaagattttcagtttacagtcttaaggtttttgttccataattttctttatcagaactttccttttggggtggtagaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagtttgacgttgtctttattattttatgtcctaattgagggtgtggcagttgtatttagttaggtgaagaatttcctgtagaaactcagcctctgcatgtccatgcagactatttgcttggtgaggtttgtggagctctgtctccagcgatcccaaagtgtcattctctggaggagatgtgtttataaaggggaagaagggaaaatgtttaatttgggtaaaggggtagcggtttagaggggaagaccttgttataactaggaaacggtatttaattgtaaacagcaggattcttaagtttcagctaatattgaaaataaaaataaaagctttgttataaaattgtttttggttaatgtttgacacatctttctttcttagctttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggtcttggttttcattctataatatctcattaactgctctgtactgagtgggactgctatgacagaagaccacataagaggactgaagtgctagatcatggttttgagaacaagagaagttagaaatatttccaattggacactagattctacctacttatagataccccaaatgcagacatagtgacttaaaaggctggttgcccaacctgtttttgcaaagtagaatattatggttgccttgaatatgaacatggctatgaaattcttctggcctggtttgaacactctttccataataagaccatacctctgttaaaccatgtacacaagataacttaaaagctgctgggtttttttttttttaattactaatggatctgactttgtcttaagaatttttttccttttaaatagaccatttttagagcacttttatttagatgcacagcaaaattgagcagaaaatacagagctcccgtataccctctttgcccagcctccttcggtgtcaacaccccacaacagagtgggacatttgttacaatctgtggtcctgcgttgacacacacaccattatcatccacagtccatagttgacattagagttcactcttgtgcatttgtaggtttggacaaatacataattatatgtacataactgtaatatcatacaaatagttttactgtgccctatcttaatgtaatttaagcccagaaattaggaaattgttttaaaatttttttcatgttttaaaatgctaggaaataatagcaaacaatgagaaggtttggttgtaagtgcaccccagttactaagcaaaccaaaagtgctgagaagaagtaagcaagattccatagattataatgccaaaaaggaagtatggctcaaaaagaatgggaaatgtggcaaaggacatttgacagttttacacagagggatcatatgtgatttgtatcttagctaggacagagaggaaggtgagggacagggcttgaattacctcagattttttaaagtgtgagatggagaggtcatttatctaaggatgaatgtactgttgttcctataatacaaagagtaaaaatcagtgtttttgcgtcattgagtttacagcaagaacaataaagagtatattttgcacttttttctctatcctttgtaattttatagtcacctctcattttaacttttggtcaaggagggtaatactttagactggagagagtgaaaaacagtttcaagagggggttgaagccccaattttgagtttaactcatccctctgcacccctacccccttttaaacagacacctaaatgaatttgttaaagcacgggattaaaaccagacttctgtgtactgaattctgcccgtctgtatgttttggtctggtgtagaatcttttaaaaatagttaccaaacttaaaaataaagatttcacatttaaataagttttgtattttcatcttcttgaaacaattgaaagctctgaagcagtgactgggctcttatatggcaacaatttagcaggagctgaatagtgattgcccctttaatcccagagtaagttctctttttgcctctggcatgacttactccaattccctcatttctgttgcctgctggggccttgtagacagttgagatgcacccactgacttaaagcagataagataatgtgcttagaaaatctgaacaacattctagtgactctttcattctctagggttgctcaaagaggggaggaacattctagaaattataaaagctgagtttattgctcctgagtagaaaacaaatagtaattgttaaaagcatagttttatttttttttaagtatgtggagaagggagagccagcataggtttaccaagagcagagtctatcagatttacactttattttcagtagagttattttgacatattagaggatgagagatacagtatctagattttattgaggcatttttatatggagagaaggaatgaataactggcttcctaacgttttgagaaatgtgttcccaaaggcttgtggttaatagatcattgtctacctggaggtcagtgctatgtgtctatattagttcttgcattgctataaatacctgagactgagtataagaaaagaagtttaattggctcacagttctgcaggctctgcagaagcatggtagcatctgcttctggggaggtctcaggaagcttccagtcatggtagaaggcaaagggggagcaggcacatcacatggtgggagcaggagcaagagagaaggatgggggaggtgctacacacttttaaatgatcagatcttgtgagaactcactattgtgaggacaataccaagaggatgatactaaaccattcatgagaaactgtccctataatccaatcaactcctaccaggccctaccttcaacactgaggattacaattcagcatgagatctgggtgaggacacatcctgatcatatcagtgtcataggccatttcatgtatggcctttttatccagccgtggagtgaagattttgttggagtaagctcctcaaggatgtcaaaaagcattagagttattacatagtaactatactgagggataatattcaaacagttgaaatgaactgggagagcggataagagacttttgagtctatttcttccctttgtcctttgaccagccacagatttgacattctcctccaaaggtggggaggttctgtgtttacatactgccattttataactaggacttgaatattttccttcaaatactatatttttatggctttcttgatataaacttagttatttccctgttacttagtaaattatatgaaccgggacttctaaatatatgggaactgatgctaaggaatcctataagagcttaaatcctataagagcttaaaatgctgtggacttttgaggagtcacaaggctatcagaaaaaaaaaaggccaccagaaccactaataatctacaattaacctcttaacctcttttctgtttataacgggatgtgggtggctgtggcaggtgaatgtggattccaggagatcgtgatgttacaatagcgtttccaacctataaatcttctttgagtcaactttagatggcttgtgacaaacgctgggaggttaagctgcttaatctgaaacccagtggacttcactgtccttgaaccctgagaagccatggcttccagaaggagggggcccttggttgagtgacaaagtctgcagtgatacagagctggtgagacagtatgtgggaagacagatccaattaggccttcatagacccaaatggctaagtgctctaataaggtggggtaaatactaggtcttgcataagtacagagtggtaggagatgaaaatagtccgtgcctttatggagcttcttgtttagtgaagcagagagtcattaaatgagtgactgtatacagtgaagtcctcgcttacgtcattgagaggatcttagaaactgcaactttaagcaaaatgccatataatgaaatcattattttctcatcaaccttataatgaagtgaggtaaatatttaattactgttgttcaaaggtgtcggaagctaaagacgggaatctagtcaaagcttccctaaagccgttctgaggcttaagctaggtttgaactgagtaggaaccagacaaggggagttggagggtggaggtgagaagggcaggtggggagaagaggtttccactagagaaaaaccatgcacaaatgcccgggagtataggacttctttggaaaaccaaagaccagtttggctggagcatgaagagaagtgacacatcctgagaaacacacatctagctggctgtcagccaggtggtccaagaaagtgtttgtagtttgttacaccacaagtcaccggttttaagtccaaggcatggcggatgatcgtcttcacttgacactgtgctttccagaccatgcctagagtattgtgtttagttcccgataccattttacaaaggacagagatacatggaaccatccacatccatgactgtctaatgaggccaaggagctaaaaatgtattaaatgagttcagtgaaagacaaaaaggctgtttggcctaaagaaggagagatgtaggagtaacctcaaaactgcctttaaatatatgaagtgcttttagtggagacagattaaaacctgtgaccctagtggaggggatgaggtcccatgaggagaaattagcagtggatttcagcttgtgctctaaaaattggagctttgcaatatgggcgagacccccttaatgaaaaggagcatttctggcccttggagaggtttccacagtgctggctgatcactcctgcaagttttgataagaaatccaaacagcttataactttggattaggtgacctttgtgttccaacacgtcctttcccacacactacttaattttttccacagtcgtttagtgaagttgttaagaacctgggctctggggtcaaaagaacttgatttaaaatcccagagcaaaggcccaggatgatggtatcttgggggattttcattttcttctggcaggtgcctgggggcacagctagtcttggagcaccttgatttaaattcaagctttgagggttttggatccctctggtggcttgatgtgctgcatgtccaggtcagggcctgtgtctggaaggtgtagccctttggggttacaagtagagaggggatggtttatgagaatctctttgttggagggggtggggagaactgacttttgcctttctggccttgtgagtctgccaaaatactatcctgtatcacagtcttttttccttcaggtttgacaaatattcttaggatgaaagagtggctttgaatgctcagtggtttacttcttggggttctttgcttttgctagatatttgacccattgcatcctcaatatcttactagctgtttaaatgctttcaagaaggtgtttcttttttttctgagacggagtttcactcttgtcgcccaggctggagtgcagtggtgcgatctacattcactgcagcctctgcgtcccaggttcaagcaattctcctgcctcagcccctggagtagttgggattacaggtgcccgccaccacgcctggctaattttttgtatgtttagtagagacggggtttcaccatcttggccattctggtctcaaactcctgacctcaggtgatccacgcgccttggcctcccaaagtgctgggattacaggtgtgagccactgggcctccagatgtttcatattttatccaacttaattacttctaatattttaatttacatgaaggacttttattattattattttttttgcttagctccatgtgattaactgttaatatccttttaattttcttttacattttaatttatcttcttgaaagggttatatatgcatatggtattaaattccaaaaggtataagaatgtatagtgacaagtatccctctcaccactctctagccaccaagtacccccaccacccccagagataaccactgttaccagtttctgttccatcagcactgtgctatacaggacctttcaaaacttagattggcttttgtaacttgtagttggatacaaatctgaaagtttcaaaaaacaggaaatgaccaaatcatttagtaaggatagtggttacttctaggggagaaggaggtacaggagcctcccatggtgccaacaatattctgttttcttgactttggattgtggttaaactgcccagatagattctaagcaattctgtgtatatatttcacatcatgcatgtgtatgcacatgcacacacatctaaaaaaaatctgcaaaactgatcatcttgaagacaaccagagagaacaaatgggttacctgaaaaacaaaattgattcacagtagtgtgctcaaagatgatgatagaagccaaaaggaaataatgtcttcaaagtgctgattttaaaaaagtcagtctagaatttcatatccttcaaaactgtttttcaagagtgaatgtaaatttaaagtaatttctaatagattgaaagagtttacaatgaactgtgctgaaaaaaactactgaaggatatattacttttgtaagaaggaaattgagcttataaggaaatagcactgtttaaaataagaattaaaatagaaaatgaaagagaaagagtgagcacctaaaatgtaatgcaggttcatataataattcctgtttactctctatggcaagcatttcctatcattgaatccagtatcaaccctgtcattattatttctgtttttcatgtgagaagctgaggctcagaggggttaagtttcttacccaatgagcatagtggtaatgaatgcccaggtctggcaggctccaatgcccaagttctgtccattgcactacaatctatcaccaaatttagaaacagaaatataaaaagatgacaaaatcacttgtaataacacatagtgtattagtctgttctaacactgctaataaagacatacctgagactgggtaatttataaaggaaagaggtttaattgactcacagttcagcatggctggggaggcctcaggaaacttaaaatcttggtgggaggggaagcaaacatgtccttcttctcatggtggcatcaaggagaagtgcagagcgaagtggaggaaaagccccttacaaaaccatcagatctcgtgagaactcactatcacgagaacagcatgagggtaaccacccccatgattcaatgacctccccccaggtccctcccatgacacgtggggattatgggaactagaattcaagatgagatttaggtggggacacagccaaaccatatcacatagataacaattatttatatagtagtatatttctttcccgtttttactcccacatacatattttaaacaagtgaaatttcccttatttcataaatatttgtcaaaaacattttaaaacccccaaactgacctttggccttttcaagtttggcaatgatgaatctggccattgtcatggctggaaatatcttggttggggctctttgttctgactgttacatagtcggattctctttgtcttcttatgtggtattgctttgagcttcagactgatacagctgacaatctttacaaagtaaggattttaagtagataaattttgagaaggacaacatgtaaaaaggatctctgggtgccttccagaaaccaggcacaagtttttattatctcagcttaactatatggttttcttctttctttgccttcattcttttgctgcctgtcagagctgacagcaatagaggccatttcatgcatggtttccatgtctcacaaaacatggtctgaagaaaaaattaccgaaagaacaaatgcccttttcaagctcttggtcccttttttcagttattgggcggtcttttcccattgccctctgtctttagagtccagtatgtctaaaatcaagctcttcttgccccagcacctattccaggtatcctacctacattatgctggccattcaggtgtaacaccttccaatgatctctgagtattatctacctcttcctctccatctcgcctcctctctccaagagatgagagaaagcggggtgataacatgagaggaaggagagatggcaggtgtcggggagcaaacagtcctccatccaggggggaagggagagaaagtgaaatgttaaaagatgttcgtaatgtgatgcagtgtaaccccacactccatagccatcagagaactttagcaaggaaggatttaccttgcttcttggtgattttgaatcagatttatatagttataatcattactattattatttatttgatgcagtaagttgagtattgcaaaaagaagatgactcagcaatgcccagatgatagaggtcaccaagggatgagccacatttcatgatgaaatggtttgcaaggtaagttaaggaaaagcacaataaagcagctcatttactgacttcatctgtactcatatggcagaatgagccactctgaccaacccacccatgggaaacaattaaacattttggataaaatataaaaaatattcctaaaagcattgttgggctggcatgaaggcaggatttatgcaggccaaaaacccaatgaaggtagaaatgtgcaactgtaagcaggcagtaaaaccaactttggctttgaaggcatttgctgagcccagtgaacttgagcttcaggtttgattgactgatgcggcatgggagagagaagctgcatgtattagtcaggttctccagagaaacagagacaataggatatttgtgtgtgtgtgtgtgtgtgtgtgtgtgtgtgtgtgtgtgtatctttgtctatagacatatatatatagagagagagagagggagagattgacttatttaaggaattagctcatgcaattgcaaagactggcaagttcaaaattggcagggcaggcaggaaagttggagacccagagaagagctgatgttgcagcttgagtctgaagacagtctggaggcagaatttcatcttccttgcaggacctcagtctgttttccttaaagccttcaactgattgaatgaggcccactcacatcatggagggtcatctacttgctgaaagtatactgatttaaaaaataatcttttttttttttttttttttttgagatagagtttccctcttgtcgtccaggctggaatgcaatggcctaatcttgggtcactgcaacctccgcctcctgggttcaagtgattctcctgcctcagcgtcccgagtagctgggattacaggtgcccaccaccatgccttgctaatttttatatttttagtagacacggggtttcaccatgttggtcaggctggtctcgaactcctgacctcaagtgatctgcctgccttgacctcccaaagtgctgagattataggcgtgagccactgcacctggcccaaactttcaaaaatcaaaactaagataattgaaataaaacactcaacaattgagtttaccagcagattagacatagctgagagagaattagtgaattagaaaaccttatccagaatgcggcacagaaagacaaaaatgcgatatatggaaaaagtttaagtgaccttgagggaaaggagatttaactcatgcctaaaaagtatagaaggagaagaaggagggaatcggggcagaattaatatttgaaaagacgatggctggaaaatttctggaaatgaaagatgataatccacagattcaaaaaaacctaacaatttccaagcaaaaacagaatacatattaaatttcttagggagggctatacatgtatttgtctatttttctggactattcaaaaaacaagctaaaattctatggtaaaagggtagaaataaattgtatataaaattcaggatagtgatttcctgatagtgacagtgacctttaaaggtgggggaagagaggaggatgtgacacaggcttctaaggtactagtaatattctgtttatgaattctatgcccctggatttttaatttatgatctttcttcagattgcacacatcctctatatactattttaaatgtatattgtatttcatggtggaaaattaatttcaaatatattattcaacaagatttgatcaaagaggttgtgggtgtattaacaaggtggcttctggaatttttgcaaaaacaagagagaaaacttcgaagagaaataatgtttaggctaggtgtggtggttcacctataatcccagcactttgggaggccgaggtgggtggatcactttaggccaggagttcaagaccagcctggtcaacatggcaaaacctcgtctctactaaaaaaaaatacaaaaactatctgggcttggtggcgcatgcctgtagttccagctactcgggaggctgagaggcaagagaatcacttgaacctaggaggcagaggttgcagtgagccgagatcctgccactgcactccagcctgagcaacagagcaagactctgtttcaaaaaaaaaaaaaaaaaaaaagaaatagtatgcaggttaatatgtttaggcacaaatgaaagtagtttattaaaaagaaaaaaaaaaaaaaaaagccagaaaacttttctgtgtcccgaaatgcctcctgaaaagcacacattacttgggttttctttttcgcctcttaaaattggggtgggttagggtgaggggaagactgctctccaccgaggaaggcagagagaagctgctgcagttgcctgtcttatctctgcctcggtcttgcaccccactacaccagtccctattcccacgtctggacccccgccccgtctcctgacacagaggcttggctatccaaatcccaaccccgagtctgtaactaggaagtgcctgctgtcctgccaagggactggattggaggaggagagtgcaggggtgggatgagggaagagatggaggagggggctttaagccagagtttctagcaggagcaaataccggcacagggaaggacaccattggccagggtatgcagaggaaggcaaagctgctgaatggccactgtggtcctcagccatgagtagggacgtctgatggcctcagaagctgccttgtgattgagcgtgaagggacaggatctgaggtgctggagctcggggtaggctaagatggccatcttggcagtttgccctagacagtggtgcctatgcacctctcagccaggctgggctggtcttagcgtcacagggctgagtggcagccattgagttcgctactgtcccgaaaacagccctgcagtctctcccgtggggttcactacagggcggtgcttgccaccaatccaggggtacatagaattttatcacagtgagaaggaggctttgggcagagaccacagaagtccagcggcattgatgaccaactctgctttcttaaagctgcagtgttacttggagcctcaaggtggtacagcaacacagtctatggtttaaaaaagcctgaattacactttgtgaaaagcttccttgggcacaattagcttgacgatttgaactgtttctcagtcgcttcccttccttgtttcaaatagcctggcttctaatctggcctgacctttgaggtcctttcttgctggctcatccacctccatccccactcggaatcgggagggttttcttagttctttggttactgaaaaggaaatccttttctgcccaggttccctcctcagattcaggccagaactgctcccctgtggtcatggggcctgtcttcataggcgccacctggacctgtgccaggcagacagcagaggtgagttccagggggttcctctgaggtcacacctgcttaggtgcatggaggctcaggtgagcagactgcagactgccaccaccagcgtcccttctctgtttaagccacctgcttccttatttcactgattcccactggcctccccttcatatacatcctcactatcgtttttggaattttctattaacatttcatgatatccatgctgtttagaattcgcttctattctaaacatactctaaattttactccaaatttactctctactcaaatgtcaccttatccatatggtattccctgaccacctgtgaacagcagcaaccttccatcactagtgagccccttatgttgctttatgttccttcttagccctttcaccacctggcataagtatatatttgttatctcttcacccccaagggcagaaggcccccagttttgttctcttctgcatctccagccctggaacagcgtttgcatgtggtgggcactcagcaaatgctggttgaatggatggatggatggatgaatgaatgagtggctagggagaatttcaccccttcccaacaggtcaaaagcattgttctgacagtttgtagtctagggtctggctttggctgagccactagttacttgtaagactttgagcaagtcacttggcctccccaatggcctatttttgaatctgcacaatgagtggactggactgcattgtctgcggttccttcctgccccaacagtttttggttttatgattatcctccaaaaggggctaaagccataagccaggtgacagacaatatgcattattggcatgacacttgcaagtaataagctagcatcaaaagatgcattgatatatgtaaataaacatacttacttcacaatctttaagtctttaaaaattatgtccttaagaaagtctcaaatgtattggccttatgtttctattttgatctctggctccatgtgttaatgactctgatatttttctgacaaataaaaggttttaaaaattgctattgcttatttgggttcttcctaggttatttcttctcattagtaacatttctggggaaagatgtcatgctcttagtgtgcatccaacatgaaaaaatatttcaaaataaaacaatagtaattttttaaaaaccctcttacctttgaaaagaaccatcgccttatgccataatcttcctcttgctatttggctgtggttattttttaggattggtatatgtctggcatctagaagacattaaaatatttttaatgaagagtcagtgtcatgtgggaggaaaaaattcgtatcctgggatatgggtggaacttcatgaaagtgattgtgtctttcttatccaagggaagaagtttttgttctttctgaatgaacttgagggaaaaaggcaatcaatgtttttccagtgtaacctgatagattctccaagtcctcaagttcaaatatttattcttttgtctttgtaatgaaaacaaaaccaaacttgtagtaggcatactcatgatctcccaaatatgtccaggtccctatccctggaaactgcgaatgtgttactttacatggcaaaagggactttgctgatgggataaaaggagggatcttgagatggggagattatcatggattattcaggtggatccaatctaatctccttaaactgagaaacatttcccagctatggtcagaggacaacacgatcagagggagcgtctgagatgcatccttgccggctttgaagagggaggaagggggtcaagggccaatgagtacaggtagcttctagaagctggaaaaggcaggacatagattcttcctcagagcctccagaaggaaagataatcctgatgagacttttattttagcccagtgagacctatgtcagacggaactccagaactgtatgataataaaatgtgtatggtaaggcactaagtttgtggaatttgttacagcagcaatagcaatacattaccttcttatttgaacagaggctttcagctccgcagtgtaaaagaaaagaagccaggctagggtctagagttgtgcccttcagtttggtagctgctggtcacatgtggctactggagcccttgaaatgagtgctgagatgtgccgaagtgtagaatagatgtcgatttcacaaagattgagtgtgaaaaagaaaatatctcctaatttaataatttattcgtgtctattacatgttgaaatgccattactttggatatgctggtttaagtgaaatatactattaacatttatttcacatattttttgaacttttgtttttaatgtgactactagaaaatttaaatcatttgtggtccacgttatacttctattggacagggctgttctagagaatccctaaatataggaggtggtcatttcaacagtagacaggtctccaaccaagtggtgagtgatgaaaaagtccaggcacagaattccaggaggagaggtcaggctttcttacgtcttcctgtattggaccataagagaaggtgttgtatgggtctttatgtcctcagggcctggcacatactcagaaattgtttgcagagcatccatttgatgttgctgaccctagaaagttctttgacaaggcaccaaagggtggaaaattagtcttgaaacaattgccctgaaggaacttgaaactgtggtctaacagaaaacaggatgcaacaactgggtcttttcccgtttgaccagtatttgttgccccaccttacacctcatggacacgggcatttaccatttccaggaaagaaagatctcaaaaagaattacaaaccaaaaggcagccttgggtatcagagcccaaataccaagaagcattcatgtaatgatttcagtttggcctctttcttatctcggtgccaatttctcagcaatgcagagaaaaatgacttgagctcagaattaggagatgaactttccatttgaaatgtgcgttctcctctgacttgctccatgaacaagttagcttccctgcagtccccttcatcatgcctgctaagaggcaagtgtttacatttatcaggactgagcgctacgaggtgaggattaattagtgactctacttagaattatttttaaaatatcaagaataatttgcttccataacaaattatcctggcttgggattctgggacaggatttgggattctgatcagttgcttccctaacagcctgacactgacatttgcagaatctgttgtggtttaacaggtattataagttcaaatatcatatttcagagtgtctgctatggttacaggtaactaaaggttacagttttccccccatatgatgtcatttgcttaactcaaatgaactttgtgccattaaaaatggggaaacacaatttatttcaatgccatttgagtctgttttgaggtattgcggacggaaatatcctggttactgggtttggatgattcatgcagtagagcagtctgaggaataaactttatcttgtcctcatctttatttttgttttctatatggaaactaatcatttgaggttggcaacatggatttgggctaaatttcttcaatgaatttttttctacgtttccctacttcagaccaaaaatctccaaccctaggctgttttccaaaagcaaacctgctcatgagctctctgacagagtgctagcctgtcggaaattacagtaagtctccttctgaggttggttaggctgagaattcattgtattttggttaaaaacagagtgttacaatttgatcctgggagcaagaaagaattagtaatgaaaacattgttggtggagactgttgcctggtacacaggctgaactcatttgtctggcccccggtacgggtggcccatgtgaaaatacacacatacacacacacacacacacagacacacaccacccatctgttacgtttttcctgatgcttcaggaaagtctgcaaattaagacaaatgatattatctgggagtaactgatcatcttttcactatgaaaatgtcatattcataggaaatgaataacacacctgccaaaaatcaggtcgcctaaatgaagggatcaagggattgaatacccatggagaaaataagacagacacaatccaactgttctatactagttgacagcaacctattctaatgatatggttaagatttataatggccatataggtttaccttctccaaccaaactatttaaataattccacaagtctcctatttaatattgaagaccatctccttagctaaaattattatgctttaattgaccatatataaatatcggagggttttggagagtaccattagaccatgcacaaccaagcacagttggattgagccttgaagatgtgcatggttcctcccgcccgtgctcttcctggtgaatgagtagcttttttccctgcactaatctgttcagtttgagggctgctggaagcactaccttttattctcttttcattttctttacttcactagttcacagagctggaggccacaggactgtttgttacatcatcactgctttaaaagcttatttttgtgaatgcgattgtacttgggggttgtcaaaacctgtggaaatgtggcctttggtgaccggccatggcataatatgacaacatttctggagtagtccagcactgggaatggtacccttgggtcaggcaagtaggaggcagtcatttttgtctctggagctgctggcactcaagcgtagaggaggtagacatttcaatggccagttgcttttgtatttaaacaaatagatcctggattgtagatttttagaaaactgcagatgcaacctgcaacagaatcacctggttagcttactcccctaccagctgacgagtcttagatcagatatactgaagcacagcctctggggatggggcactcaggaatccaaatttctttaaataaactttaaattttagaatagtttcagatttgcaaaaaagttgtaaaaatagtacaaagagttcccatatacctcatacccagttttccttattaatatcttacattaggatacatataatatacatttgtacaaatgtgcaatgtaagtaatataaaatgtacatttgtacgatatacgttatctgtatcataatgtaatgtacaatgtaaatcctaatgaaggatacaggtaatgtactttgtgatgtacaaataacatcttacattagaatgcagataatgtacatctcccccactcgtttatttatttgatcatttttttatgtcagtatggactcatgaataccaagttatatttcagtaccacattataaatgtacattatctgtatcttaatgtaagatattaataaggaaagctaggtgtgaggtatatgggaatgctttgtactagttttaaaatttttttgcaaatctgaatgtatgaatgtacattaggtgcatttgtcacaatctcatgattaaccaaagtcaatactctatgacctgatgtcctttttctgtaagattccatccaggatgccacgttacatttaattgttacgtctccataggctcctcttggctgagacagtttctcagactctccttgttttcagtgacctttgatagttttgaagggtcctggagagtattttgtagaatgttccttagttgaattgtttgatgtttttctcatgttttaactgaggttatgggtttctggaagaaagatcacagaggcaaagtgcccttctcatcacgttgcatcagtggcaccctcaacgcaactcacagttgatgttcaccttgatgacctggctgaggtagtcttgacaggtttttctactgtaaagtgattcttttttccaccttttcatactttactctttggaggggagtcactgtggatagcccgcacttaaggagtgggagttgtactccacctccctgagggggagtagctacatacatgatggaattcttctgtctagagatttatctattctcccccacttgtttatttatatgttcatttatttatgtcagtatagactcatgaatatcaagttatactccagtgctactttgttaatcagattgttccagctttgtccattgggaactctttcagtgggatcccatgtctctttgatgtatcccctttcttgtgatgtttttgggagcccttccggcactttctgccactacaagatgctccaggaattaacatttttgaccagctctatcatactgaaaaaaaccaagatttatcattttcggccatcaagaccagaaattttaaatgtcccgcttattgttggatgtggaacaaagctgtcaaaagaaaaatcacactaaagaatgtgtatgtatcttcaaaatctctctgtttatttggtaacatctatagcccaggcacgtacagagaggcagttatttaaatccaatcaagagactaagaagttcaagagatctattgtataacatggtagctatagttaataacaatgtattgtacacttgaaaattgtcgaaagagcagattttaggtgttatcacaaaaatcataatgagaagtacatgaggtgatgcataagttaattagtttgatctagccatccacatgtatatacattttaaaacatcaggttgtacaccatagacacatatactttttgtcaatttaaaaaagtagtgatttttttttaaagagactaaaaattgaggagaatcatctatgaaacattttcctggaaaccacaaggcttttgggccacaggcacctcactgggtgtggataacaattgttgagttagcccagcccctatcaaagaggatcttaagccatatcaaccacttcttaggattttctggtgacttctgagagaggaagagtcagaaacacccatgggcagtaacacccagggctggctctggagtgggggtgaggtcattgaggggaaggccagggtttgggtgagcctgtgctgtagggatggaactctggttggcatagggtactgagcgtgtctctgtatgtgcatccatgcagacttgcacatgggtaaaaattcatttaacccaccttgataactaccatctaccttttgtaactggatttgatttagagtcagctgtagcagggtgtgtgtgctatgttgacacaacaaatcatggagatgcatttaggacccatttcagatccttgttgaatgctctacggtgatgatgacaatacagtcacgatacacaaaaccaggcccagcatgaaggcaactggcttttgcttttcttggcccttccttggcttctacatttgccttggcttctctgccatcgtggaacatcagttcacctttccagaatacatctggtggtgtttctattaagtaataccagcaaattacatataatccttggcattaggacatttaaaaactggtgaatgtggctgggtgtggtggctcatgcctataatcccagcactccggaaggccaaggcaggcagataacttgaggccaggagtttgagaccagcctggccaacatggtgaaaccctgtctctactaaaagtacaaaaagtagccgggcgtggtgatgggcacctgtaatctcagctactcgggaggccgaggcaggagaatcgcttgaacctgggagacggaggttgcagtgagccgagatcgtgccactgcactccagcctgggcgactgagcaagacactgtctcacaaaggaaacaaaacaaaataagacaaaaacagaaaacctcaaaaaaccctgctgagtttctggtctcatgcacgccaggaatcatttgtcagtgattatgatgtatactcccatgtgtccattttgactgtttttcctcctctctaccccaggccgtaccattcctcctgccgtcctcacatattctcccacggttctgcagatgaaatgtaagaacttcctccaggtaatcttccactggcaggctgcattgtcaacagcagctgtcctccaggtaggattcttggcataccctgaagcattctggaagcacttgtgttttttagcactttagccagtattgattatttttattggggattgagtgtgttgtgttttgtctcacaggactttttcacatctgttgctgtgcttaagtttatggcagagattcatttgaaatgggatttttttgtcttttttttccatttgaggcaagagtgcagatgggcttttaattttcttgctgccacctgggaagaatttgtcatttcattcctaaagacaaaaagaaacacatctgatataatctaacacaagtctatgctaaacaactccaacaactcgggtagagtaattccagcaatttgtgttgattatctatgtttgttaaggatatctcagtgggaagacttccaagtaacccttttgagtttccactcaaggcattttttttcttcttcatattcataaagctcctaaaggtatagattgataatttgacgggaaaagctaggtaaatagaaccaagcaactgacttacaagagagctagcgtaaaatggatggagacacaaggaagaaaaagctttgtgtatcttcgcagatatgaacaaagcactaggcggagctggtggccttgtaggatggtgacccagggtttctgcacagggtctgcctccctgcttgtcacccctgggtcctctctctggctacactgctgtgttttccctggccacttcctctccagggctgcctcacactgaggggtactttcctctgccttccccaaggatgcttctctgggcttcaagccacccagctttgaccttgcagtcacctccttcattttcttcctttggaaggtctcagtgagattccaccctaacgcctcacccatttcttctttccaaactgtcagagagcatctagagtgctacccaatgatgaaagcatatcccagttttgggggaagcctggcttctttgagcattcaaatgctgcaaactggctcttgggtcctaccctgtaatcgctgcaaaggcccatgggctggcttggtccatcagcaaaaggtcccttcttccttatgccagttggaacacacccagaggccagactgtggtgcaggcattttctctgggagaggggaatcctctagtgtttcctctggacaggacacctacctggcacaggtgcccagactccccttttggtctttctcctgctttccttttctctctccttcaggggtgccatttaattcagcaaggacagtttctcttgctgttgacgtgtggatcaactctgttaaccctggatccttaatgttcttcagagccacagcccacaagatcaaaccctctccaacaaaataaaatgaaacaaaacaaagaaaccctcttgctaatataaaacttcgatgtataatgtgccaaaccttcccaccctaaacacacacacaacacagaccaggggtgagggttgggaggataaggtgaatacaagctcatcttttgccattagcaattctctagtagccctgggagctcccaggtccattgagttttggaggttggtggcatcacgcaggtcccactatggaaggaaatatgttacccaacagtttttgtttctttcaaaacacctacttcctttggcagcaaactcctgcttcttgtgtgagaggcatcttcatctcacaccttggagcgagcaaagatgcctcatgtcccagagcagagcagtggctgcttgcacttcctgctcttccatctgccccaggtttcttaagaactcacaccattccctgtattccatttcttgtaatcttttttgaacagttattcaaatattgtgccagacagtgtgagggtggtggggcaaataatggaaagtgttcttgttcccctgggacctacatttcgagggagaggtagataggcattttcataatcttcattttctttgcattctttatttgtgtttacctttctattgagtggactgttaaggaagcaccagaggagggagagaagagctttgacgtagatgaccaggagagtgttcttgtggaaggaggaatttggtcatgacctcgaaggacatctaggactgtgattggcaggaatgcatggtggaaagaacagttctagcacaacagagcacaggagtgggacatgtcagggccggacctcagggtcccctgagtagttccatgggagagctgtggcacccgtggcgaggtgtggaaatagaaatgggaagggaccttggggtgatgctgttggaggcttctgcagtagaggagtgtttttccagttattacagtgttaactatataaaaactactttgtctatatacatcaaaaatacccagcataattatttttccagtatagctgtcactcaccactatactgttgctttcaattttaagctttaaagatgatgtgagagaaaaatagtatcctagtacctgtgtggatttttttcccttcctaaaatcaataattctttcatttttaaagtcaattttgcctttgtaaatgacttcatgccttttgtttttgttttgtgcttgtagcttgtacgttttggagctttaaaaacaaactctggggccaatccacctaggtttaaatctcagctctgttgcttcacagaagtgcaatttgggcaagttacttaactcgcctgttttttagtttctttatccatagaatggagataatatttctatgtatccttcacagaaaataatctgtgaggatgaagtggaatacatgttacaagctctcactgcctcgcatggagtaaacaataagggtttactattgttattattcttttaaaaattaaatgaattcatgttggtgttgaaagagggtgatacgtgcacatggggatgtgacaatcacagttacagccctctattaatagccaagggtgaatcataaatgaaactcccacccaaagcctcccaaggcctccccaggctgaggcagtcactgttcggtttctggtgtatccttccagaatcactttgagtttctagggtgtatgtgtatgccttcctgtctctgaatctgaaatgtgtgtgtgtcaatctgtgtgtgtgtatatatatatctgcacacatatacatgtgtacatgtatatgtatagtttcacaccttgtattttcctatcttaacgtatcatactgattatttcatatctgcaatatagatctatataattcttttaaatggcaatgtagtatctcatttcatagatatataaaaccagtcccttaaaaatgggctattaagatgcttctagcctttgtcttacaatgttgcaatgatccttttagtacatttttatttcgatggatattattcaattgtaaattatgaagtaaattcttccctgtctttccataaaatcaatgcagtctacattttttccctcatgctttatgaaatggatttactttgagatgtgcatgctgcttcaaggtggtatcgaaaaatcagtttacttacatgcgagttatagggagaactatttaagtgaagaaaattcctctgtaggaatactacattgccctttagatgtttcttttgaagaaaaaaatgtttaccaccttaagcacaaaaagcagaatacacatcactatttatgactgcagatattgctttctcagtatattttaaaacaaattcatgagttaaaaaagacaaaggtggaatatctgtgtatgagtaggtgaatattcttaaattttccgtatttttccagtcttagggaatgggcatgtgttgttttcataattgaacataaaaaggaagaagacacttttaagagtatcaaattaaaagagagaaatgactgctggaggaagacctgtggacaattttaagaaaaagggacaaaaggggaaagggacatataagaatcaagaaacccgatagtggggtctacagctaaaatcctagggactccaggcaactcttggataatactacagctaacacgatagatattaatatttggggatcttgagtcattgcaagaaaggcttagcaaaaacatattggttcaagtaagctagcaaggacgcatgtagtacatcttaatctccatcaagataattttgaagtgttgtcgtttaaagggtaaatcagctgctatctggacaatgcacttatatggacaacctcattgcttaacaatgctggataaatgaggcctttaccgcatttctttttcttaaaagtatagttacttttaaaaatgctatcttcagacaaatctgtttgctgattatttggttagctatctttgattatactagtccctccttgttcaagttgtttaagaaagtgtcactataaaatattgaaagtggccgtggcatgacttggaaaaatgacccacagttctaattccattccaaagaattcaagggactttccagataaattcatttggagtctacatggaatttgcagttaggaaaggagctgatagaagcttatactttaaccatctataaagacagggtttacaaagcagataacatgtttaactttcaggaaacaaactccttaagtatcatcaggttttgttgcagatgtctgttcacaaacaaatggtgtgtggtatatgacattcctgatcaacctcattttaaaatttaacttccaagagatttactcgacagcaatctattaatctacttgtaacaatgatacatttcattttggtttttttgagtcagatttccctccctagccctctgtcattccttaaatggctttgaattacgaggttaatgtctcattttactaacctattttgtaaatttattgtattgaatattcttgaaattatgggccttgaatttccatttttttcaacttttattttagaattagggggaacatgtacaggtttgttgcattgacatattgcatcatgctgagatttgaagaacaaatgaatccattacccagctagtgagcatataccccaaaggtagcttttcagcccttgcccttctccctctcccctcatctaatagtctccagtatctactgttcccatcgttatgtccatgagtacctaatatttagctcacacttataagggagaacatgcggtattttgttttgtttctgtgttagtttgcttaggataatggcctccagctgcagccatgttgctgcaaaggacaagatttcattcttttttatggctgcttagtattctatggtatacaggtactacattttctttatccattctgcagttgatgggcaccttgattgattccatgtcgttgctattgtgactagcactatgatgaagatatgggtacatgtatcttttggcagaacaatttattttcattcgggtacatacccagtaatgagattgctgggtcaaatggtagctcaactcctggttctttgagaagtctcccaactgctctccacagtggctggactttttttttttaatgtggagattttgtcacaatgatttctgctttgatctataaggagaatgtcatccttttctccttattgccaatttgtttttatccccagtcttaatgaagattctgttagccttcccctaccctaccatttgtccccatattcctaaaaccagatacataagctactgaaggaaagaaaaccatagaaatacagtttatctctcacagaaatacatttcttacaatctgccagtgaatgccaaacaacttctcgaggctgtgattcttgtgatccaagtgatccctcccaggtgttgatgcctttgacatcagggcaggtgattcttgcctgagttgatgggccagcccagctgagcagtcagttgagccctctgtgctggatgactatggtcctcactgagacacagctgagcttaatgagccatagactggaggctgggactcctggattttttgccaactcttgaccttaggaaatacctcacctctctggtcttcaattccaccatctttgatataggagtgtgaaaattttagaaagtcgtttctggatctgaagttcttgattctaatggaaggaaaagaaaagcaatcacacgttcctagctatagcttaaatcaggaggtattgttctcacttaccaagactttctctcttttccctcccccatgctctggggttcatcattccttccactgggttcccactgtggtttgcccttgaagactccacccgagagtttatgacttgatattataattatctgtttatattttccgttcctttatgggaccaagacctgctagaaggcaggaactgtatctcactcctcttcccatctccagtcccacacccaggatctctcacatcacaggtatccaagaatgactgttgaacaatagaattagaacagtagaggtaaaaagcaacaactctgagatcccgagagagattttttccttatcagagcactggactggcagtcaagagacactggtttggcacctgatggcccttggacagctcatttaacctgcagtttgccaaaatcaccttgaagaatagagtcactaattgtcacaatttcttgaacccatactaaacctattattaccatccccattttgctgatgaggaaatcaagtcccagagagtattagatgacttgttcaaggcatgccagttaacaagcggatgggctggcattcaaagcttatgcttttctgactacaccgcactgcctcctattatgcagtgtatattgctagattgatatgtcagcacttcatgaattcataatatgtacagggtgcagtgtatgtgcttggtggtagtgaggaagttgtaaaaaacattacttagatgctacatttgtacccaatgtgtagtttttagcccttatgcgatttaatctgttcccactgtttgatcctattggccacttcctccttgaaacacatttttctcttggcttttgtgtcacatccttctgtttgtggctactctttttcagtctcttttgaagattcttctttcaaagccattaagaattgatgtttcttaaagctcggccctagactccctgctctgttcattccttctccctcccaagcatcaacatctgaggcaagggctttggtgactacctctgtactgatgattcctaagttgtatccctgagctccagactagtatgcctgctagacatctccacttgaatgtctctagggcactgaaagttgaggtccaactaaattcatgctgtccatcctctttccaatgcccccttctggttttcttccagtttttctgaatgccccatcatgtatgtaagccagaacccaggagctatcctttggactgctttctccttcacttttctccagaagcaaattcattaccaacccctatcagtgctaccaataatgagttcttatatctgcctccttctatttccactgccaccgttgtagttcaagccaccacaacctctcactgagatgcctgcattagcagcctaatctggtcttcctctatcctcaatgactctcctccttctgtttctttttcactctgcagagtgaccttttaaaaatgcaaatgcatcccttttccccttcccaacagatttgcatttctcttcaggaaacgacccaaatctctcacatggcattggctgagtgctcgggttctcactcagtcctctggccccatctcatccacccctctgagctctctatgcttcagtctcagtagccttgcagctctagggggtgccttctccaaccggcagttgagccataacaggctgttccctctgtttggaatgctcattccaccccaacgcctctgtggtaggctgaattatggtccccaaagatatccaggtcctaatctctgagacctttgaatgttaccttaaatgatatcagggattttgcagataaggataaagggactctcctgaaatggggagactgtgctggattatctgggtaggccccgagtgtaatcacaagcatccttataagagggaagcagagggacgtctgactcagaaggcagaaggcaatgtgacaatggaaacagagagatttgagaatgccatgacattggctttgaagatagaggaaggggccatgggcaagcaatgttctctagaagctggaaaaggtaaagaaacagattttcctcaggagctgctgagtggatgtggccctgcctatatcttggtttctgcccagtgaaacccattttggacttctggcctccagtaagagagcaggtttctgttgttttaacccacaaagtttgtggtaatttgttatagcccccagaggaaactaatacaatgacttcatgtttgagcaaatgctttgcactccccagagtaaaagaggagagccctgaccaagggtctagaacaataccacccaataaggtagccattggccacaggggactgctgagcactcgaaagctgcactttaactagggcaactggggtgaagctgtaagaaatttgggtgatttaaaaaagagtcatgtaaatccgttgggtctaggggagagcaatgcatttgcatttggtgggccctcccttgccgcagcttcagtaatggatgcatgatccaggtccggccaataatgatatcctatccttagggccacagtaattggcctgatggtctagtcctgagccggaccaatcagggtcctctccagagatttgatatgaccgctgggatggcgggctaccactctctccccaagacttgctgagctggggattagaaagactggaaccctctgtgacctggtgctcccttctccctctgcatagggggtgtgcgccacagcagagacagtaaggctgacacgcagagagaagaccgggactggcaggcatgggtatagagagagacactgccctgattacattttgggagttgctggtgtccctaaggccagatttacccaagatcacaagggtaaaggatcgcaagacccggagttgtaggagcccctttagccactacatggagtgagcttgccaggaatggagcacgcagagtaaggtgagtctggaagaccgggagaaagagctgacatcccgaagacggcttttgaaattccaggatccagtgtgcctgaggctagcctgacctctttgctgtcccaatcatgggaacaaataagatcccccttttttcttacatattttgagtttggctttttcactggaccagttgaattttattcatacaactagcaaagctactgtgcattatttgaaataagatttttaaaaatttacatttgcactaggaagagaaaaagaaattatttagagattcttgattaggcagtaggataaataacctattttacagcagccctgttaattactgcaataaatccaggccccagaaaatcaattgcctcctgttaagttccatttcatccatcctccccaccctcccattcctagggttcagttgtggtgacaaagaaggcacagggtctgtgatctcagtgacattttctccattattatttatttttaattgacaaataaaaattgtatatatttattgtgaacacagattttttttttttttgacggagtcttgctcttattgcccaggctggggagcagtggtgcaatctcagctcactgcaacctctgccttccagcttcaagctattctcctgcctcaccctcccaagtagctgttattattataggcacctgccaccacgtctggctaatttttttgtatttttagtaaagatgggttttcaccatgttggccaggctggtcttgaactcctgacctcaggtgatccgcccaccttgccctcccaaagtgttgagattacaggtgtgagccactgcgcccggccacaacatgatgttttgaaatatgtatacattgtggaatggctcaaaccaggtaattaatataatcattatctcacatacttaattttgtgatgagaatacttaaaatctactcttagcaattttcaaaaatgcagtacattgttgttaactatagtatccatgttgtacaacagactgttgaacttatccctcctgtctgcttatatgttgtatcctttgaccaccatctacccctagccccaacctctccagtctctggtaactagcattctactctctacttctatgagttcaacctttttagatttcacatgtaagtgcactcacatagtatttgtcttcctgtaccaggcttatttcacttaacataatgtcctctaggttcagccatattattgtgaatgacaggatttccttctttcttaaaactgaatagtattctgttgtgtatatatagtacatttccttttttttgaggtatatacatttaaaatatattttttattacgatagtaaaatatgctcattgaaaaaaaatacccaaacaacataggaggaaataaagtgaaaagtaaaaatatcccccttccccaaggcttctaagcttctttcagaactcaaggtctacgcttttagacttttgtatatagcatgttttctttatctatttattcattgatgaaggttgattccatgtcttggctattgtgaataatgctgcagtgaacgtgggagtatagataactctttgacatgatgattttatttcctttggaaatatacccagaaaggggattgctggataatatggtagttctattttcagtttcttaaggaatctccacattgtttttcatagtggctgtcctcatttacactcccaccaacaatgtttaaggattctcttttctccacattctcaccagcatctgttatcttttgtcttttgaatactagccattccaacagatgcaaggtgatagctcattgtggttttgatttgcatttgccttatgattagtaatatttagcattttttcatatacctattggccatttgtatgtctttatgtcttcttttgagaaaagtctattcaggaatctcagtgactttattgctttttatctttgtcctgctgatgatgacttggaaagttttaaaatataaaacctacaaggtggggattttttttgtctgttttgctccctgttatatatctagtgcctaaaagtgcctggcttataataagcactcaaaaaatatttttgaatgaatgaattaatgcatagcagcaacatttactttgcacctgttgtgttaagtatgttaagagatgcaagggaattgaagaagctaggaatggttcctgggccctcacagaaattacggattagttttcattcaaatcctttatttttaaatttattaaagactgatagcctgaacatcattgaatttgttcttttatatttggaaaatatgcttccaagagcatcggtgttcgtagagattctcacattatctggttcagggatttccttggatactgcgaatttgtaaggattaaatgctttaaaattatagactccttggaaagccccaagctgatcttataaagtacaaccacctttttgtttttaagcataggaagtagatgactgagagaataggatgatttaattacacatctggggtgaaaacatggcagtgtattctgtgttactcatggagcaaatataattcattcaagcaagccacggaaattgtgaatacaactaccataatgacttggtgatgatggctttctgaatgccaccagtcagtccaccttgggagactgatttgccagaggcctctcctttctatctgtgcttctgaactgggcttgaatcaaagccaacctactgccactgctctaacttgactgcattgtttatggtaatccacgtggaccctgaaacctggtcgtctgatgcactacatgcatgcacagactgagggcagccttctcagcatcagcacaacctctgcagtgagtactgctcataagatcagtgcagggagcagcagatgtttgctccaaccttctgcagtacatgtagtagcaatcgcagggctgaggctctgtgggcagagcccacgtgggcagtctcccaatttcctcctagggagaaatgcatacagaggcttagcaccacagttgggtgctgttcacttctgtctagttaaggagtcattattagccagaaaggaactatgatgtcagtttggtctttgtggatttcctgactcagtgtttatgaaggagacacattagtaatggtctaagatatctggtccaatttgtatcaaacaatagtcgtttctcattttccattgctgtggtaattttaatgcattctcctctgtgaggcagtggaaataaataccatggaggaagattcaaggagatggtgcttttttagtcttttttcccttctagcaacaggatgagggtgtaaaaaaggtcatggaccaaggcaatttggagaatcattattttcagagtctgtcctgtaatgacagagctgtggctttgtgtgctctatcttccccaaggatccagtgtccagagtcaggggtgtttctgagcctgagcactctgcagctctccgagagacctgcacaggagtgctgagatcctgctggcttccctttcttatctgtgaagtgaagatctgagagctgagccctgcctacgttcaaggggtgggagagtatctgtgaggcttttaggcctttgaaggcaggtgctgtaagagtgtgagataaaagtttccggagatgaaacagtgatcaggaggcctctggagggctgccatcactgcagctgattttcccctctctctcaccaagcccttgtcattcagtttgtggccaggtaaagacttaagttgaggcggggaacatggtactgtaatggcctgtgaggtctccttcctcatccctccactggggaaatgggaaagaagaaaggagagaaagaaggaaggtttgagggggagggaaggggaggtctttgatggcatctgttcctaagagctcaggaggagagaggcattaaagctgccaagtgccggctgcttccaggatgtctcatgctccttcaagcccttctgcagttgtggtcctctgagctagggctgcccttgtctccgtcctcacctggggactggtgaagctctcactggtattggcctggtggggggtcaggtgtcttggtcttggtgagtaccccgctgtagcacatggtgtcatcctgcaccattcattgtgtgtctgactctcccactaggctgaactctctaaggataggctgggatttatccatctttacaccacctcccccagttctgagtcccaagtgcctagcacagaacctgcctaagaagggagactgatggttcaagaggaacacccccatatcaagcccaagagagcgcctatgctccagcaatggaaggtcctctcggcacagccatgctgcagggtagagttggaacatgacaactgtgaatctggttaattttatatccaccccacatcctcttcatctccatgtctgtcgtttgtacagcttctgtactatacatctctttataggtgaagctacagtctcatttatattcacaggctgcgtttgtacttcctaacatccactcctctcccgcagcccaatactctgcacatagtaggtgcatctgacatgtctgtatactcgaagtttcctcagcctacatgagcctgggtggctgtgataggctgaataatggctcccagatatgttcacttcctgaaaacgtcatctttctaaggatcttgagatggggagattatcttggatgatctgagtgggcctgaggtaatcatagcagttcttataagaagagtgagtcagaggagaaggtgatgtggccacagctgcctaggtgggagtgatgaatatggaggaagaggccacaagccaaagaatatatgtggccactagtagccgaaaaaggcaagcaaatggattctcctctggagcctccagaaggaactggccctgccaacaccttggcttgagcccagtgagactgattttggatttctgacctccagacccgtaagagaataaatgttttaagccacaaagtttgtggttaatttgttacagcagcaataggatgctgtacagtggcacacctggtaccagtgctctggggcaacttcagaatggtacaaaagtcatgctgaactgaggaatggaggaaacaggtacagatggatctgctgacttgcagccttcttctggctcttaggacgaggggtactgtggccttccagctttgtgcctctctaggacttaaatgaaccactctggctggagtagttccttggtgaggatgcagctgctgggagtagccaacaatgcttcatggtgcctggggctccccaccttggggctcatccccctcttccttaaaatcacctgcagtgacacagaccagggtctagcttttggttcttccccaaaacacatttccagaaaacaggaactaatactcctagggaaaatgagcttccagataataactaccttaaaaacaataaattggacagctttagcattcaaaacagtcactgaacattagagcatgattaatatacccagagggataagggacaatattagtgatatgaaacaagttgagaagcaaaaaggaacaaaatggaaatatgtatgagaaatttagaaataaatagtgtggtgaagtgattaatactcagaagaatacagctgaaagtaagcttgtgagttagaatatcagattgaggccaggcatggtggcttatgcctgtaatcctaacattttgggaggccaaggtggcaggatcgcttgagctcaggagttagagaccatcctgggcaacatagtgagaacttgtctctacaaaaatgttaaaaaattaggtgtgcgggtgtgagcttgtggtctcagcaactggagaggctgagttgggaggatcgcttgagcccaggagggtgagcctgcagtgagtcatgttcatactagtgctctccaacctaagtgaccgagtaaaactctgtctcaaaaaaaaaaaaaaaaaaaaaaaaaaagaagaaaaacaaagaaagaaaaggaaagaatatcagattgagggactctcctagaagtttgcaggaaagggtcaagagataggaaattgagaagaaaagccaaagctaaggacacagatagaattagtggaaatatctattattcatctaataggagtcccagaaagaaaaatacaaaaaaaagaaaagaagaaatatttggagaaataatggagattaaataatggagattaacagatgcaattacagatgcaaaaacatattaaaagacccctagcaagataatgagaaccccacacctagatagattacagtgaaatatgggaacatcaaagacaatgaaaatagactatttattaagccataaaggaagtcaccataaagaccaaaggatgagtatgtagaacatagtatagactatgttttacaactataaaataatataggcctatttcactgttggatgtagatgcataatccttaaataaaacattagctaactaaatccaacaatgtttttataaacccatcatgatctcataggagtatgttgataaatgcaagaataacattaaatggatcatagcattaagaagagattttaaaggtataaacctggataaagtaagaaataggtgagatattcacaaaatacattttacataagtcaaaagcacatgcacacaaaacaccaatataccttttgcaggaacttatacaaacaaaaagaggcatgatgaacaagtcagagtggttgcctaggcatagggtgatagaaatagaagtggggactggggataaaaggatatagaaaagattgaaaggacaatctgagtgtagcatggaatactgaaactcagttattcctcctatcctctcccaagatagatctcctacatggccacggcactttgcaattcgtcttatgaagaggtggggtctactttccaattttttatatttcaccttgtgactgtctttgatcaggtttctttgtggaagttctgatactaagtctcaagatgccacatggcttctgctagtactgctgggaactctgaagccatcagatgatcatgcttgagcagcctttggatgttgaataactatgcggataatcgtacataaaacaattctcagcaaatgcaatagaactgaaattataccaaacacactctgagaccacagcacaataaaaataggagtcaagaataagaaaatcactcaaaaccatgcaattacatgggaattaaacaacatgcttctgaatgacttatgggtaaataatgaaattatttttctaaaaatacaaatcagatcctaactggttcttgcttaaaatcctctttgctaataggataaagtcaactcttttaccagggctctccaagcctcctgtgatctggatcctatcacctttctgccctcactcagctcccgtgaaatcttttaacatcgtatgcctccgtccctttatacacctgcctcactttgtgtttcttcttctggttctcccagcagattcctattcactcaccagcagtcagcttatgttcattcctctggcaagcctttcccacctctccttactgaaccattctgggtgccgcctcgaatctcacatctgttgtagtctctgtatgatggtgcttttcaactagacctaagcatcaacatcgtctgtgtgcagcttttaacatttaatgatccccggaccttattgctagggattaagttcaggagtttgtggagtagaaagtcctctgacatggaattgcttttctatgtgttggtttctttcaacagtggtgaagagcaaggattctggagcaagactgcttgaatttgaattctggctctgctacctggctgctgagtcatctctagtttttttcacattatctataaaacgagaataataacactaatgtcttaaatgtggtgaggattaagttagtaatacatgtaaatcccttagaacaatgcctggtaactattcaatacatatgaactattatttgctgttaccaaaagtgttcagagcagaaactgggttgtcaattctttgaattctaaggcctagcaccttgcctggctcatgggctggcatttagtaaaaggttgaggagctgaattaaaaattataattaatgtgggaagaaaattggaagataagatgggggtaacttcctgctttatcagaagttcttagcgcaataaaagtcagtagcccatctgatttttgtccaaagatgagcaccagcagactgatacggagtgaaaatagctccagctagataagatgcagaaatatggagaagaagctgggcagcctctggaagatttgttggaaaagcttttgtatttttccaaatatattgcttggtaaatgaaacactgaataaatataatatatattcatgttaagtagtggttttaaaaaattacatgattttatcagctttcatgttagtgctgaatgcagtcttagacatcttgactcttcagatctctgtttttccttatttataaatgaaggaaaattgcagtggtttctctaaagtcacgtgaccacttgtgccaaaatcaggacccgtgtcggtgctgggcccactacagcctgctgccgccgttgtaatgagctgtgattattatacaatccaatacattcccttctgtcaggcctgctcctcctctggttatgatcaatgacatcgctcctgtcctagctgccttgggttggttagtgttgaccagagcgcaaatctatcaagtgagaagagggaaacagagccgtttagtagaatgtgtaagtcagtgaagcaggaaaacatacatagattagcacatgagtgtgggaatgcaagcacaaaaccatggaaggctggtactctcttcagagtgagataagccaagaggacttttttttttttctctagcctgataagtaggcttaaattcttcacaaacagtagacttcagaaatagtatttccaggtgccctcagttgtggtaatttagttcatcataatatgttgatgtatattttaatgaactgtgttcagttttattctttccaagattataaagcacattgcctcatacatagaagcaggcaataagtgatatgttgaattgaattcaactgcactgcagagctgtggtccagcgccatcaaaaatcaaagaactagatagtttctctcaatggccctttcactcaaatttatctgtacaagtcagttgatttcattagtattaaatttcatgaaatgactggggataggtgtgcattttgattttctccagtttttgggaaacttctaggccatccctagctgcgtgaccttagcctgtgtttttttgtttgtttaactctggaagcctcatatttctcctctttgaaacaagggtaacaaaattggtagcacaagagggttgtatatgtattttttttctttttttttttttttttgagatggagtcttgctctgtcacccagggtggagtgcagtggcatgatctcagctcactgcaacctctgcttcccgggttcaagcgattctcctacctcagcctcctgagtagctgagactacagatgcaagccaccatgccagctaatttttgtatttttagtagggacagggtttcaccatgttggccaggctggtctcgaactcctaaccttaagtgatccgtccatctcagcctcccaaatgtatatgtatttctgagtggctgaatgcaccagtaaaacatctagcacacagcaaacactccaaatattttgctccctactgctatttcaccttttcccttacctttctttcttcctttcaaggatagcaaattatccttgcctcggacatttagattatctaaggaattattatttaatttctggggaagtagctaatcctgattaatacttctccctcagttccatctcatccttcttaatgcaagtggttacaggaatggaaagaaacctataagtggtcggttgttgcagcctccaaatagaagatggctattgtacgagtagaacgagtgtgcccttaattaagcactttgactgtaggcatcacctcctacataaaagatgagatctagacccgagatagagcgctgaaaaaggaagttagagtatgtaacaactaatttatttctgtagattttccatccactggcctgacaaggcagctgttcagaggctcctgctgcataaacaaaagccagagctttccagaaaggggctgctgaactgcacgccatgacttcctggatatattcctcaaattacataatattaaaaaaaaacatggcaagaaatgatgcggaatgggaagtggaaacatggcaataaggagttaagccactgaattcaggcaattcttattagtatttctggtgattttctgtacttaaattttgtctccaattaacatatgttaggagtagaatcctttttttttttttttttttttttttgagacagagtcttactctgtcacccaggctggagtccaaattgtgtggtttcggctcaatgcaacctctacctcccgggttcaagcaattctcctgcttcagcctcctgagtagctaggactacaggcacatgccaccacacccagctaatttttgtatttttagtagagacggggtttcactatgttggctaggctggtctcgaacttctgacctcatgatctgtccgcctcggcctcccaaagtgctgggattacagacgtgagtcactgcgcccggccagaatcacactttcataagtgatcctaacaaaggcctcatccaagaaggagttgaagggagaagtatcctgtgcctctagagggaaacaagtttgagtgtgttggcaagaggggtctccaagagactgaggaggcagtcctggagatggacgattgtggaggttaaagaaatgccttttttaaaaaaaagttccaagcttaaatatttttacgttatacatgcttaaggtaaaaatttaattcaggatagaggggaacttgatatccaaacctttaggagtaatgactcttaacaaattgataaacgtccttccagacatctttctgtgcatttatttatttaaaatatgtgcatataattttacataaatggtattatgcaacttgcatttttctcaaccatatatcttaacagatttctatggtcaaatgataaaggttttcgtcattatcgttaatggccccgttattatttaaagagtctcctttgattggctatgggaagcaatgctgtaatgaatatccttgggcatattcttttccatttgggtgataatcactttaggtaagtttctaaaaagttagtttattgggtcatttaacattttgatacatattatataaatttatgctttgatacatattatataaattatacttccacaagtgataacatgaatgcctgtgcctcacaccctaataggggttataaattccttgtcttttgtatatactgcaaatattttcctctaggttaattttttttcaattctttctaatgatgtggtgatgatttaaacttaaatttttcagtcttaatttctggtttggtggtggtggtggtgtgtgtgtgtgtgtgtgagagagagagagagagagagggagggagagaaagagagagagagatagagaaagagatgcttacttttattccctcagctatggaaatattctaccatatcattttatggtacttacttaattttatttttcaagtcttcaaatctttgagatatctggaatttattttaatacagagaaaggggtatggatctttttgtatttctcgcccccctccaaatatctacctaattttccaacaacatctttcattaaatgtatcatattttccccattgatattaaaattgatctttattttctacatgtttgaacctattatgagattgtttattgtttctattcagtttatcatttgacctattcctgcactagtgactcatttataaaattattattgttatgtattttaaatatatgacgggcaagttccctattgctgaccccacctccaatttttcttgtttctaagatggatattttttcatgtttttctgccagcaatctttcagaagcatttctgattgacttttggatcataccaaatttacagattaattaggagagcggagatctccataatattaatttttttatcgatcaatacctttcttgtttattcatattgtttttatgtctatcagtactgttttatgttttatatgttttttccatagagtcccatgcattgctcatgaagtttatttttagttattcagcaaagtgtaatgttttgtaccatgtcatgacagctactcaggaaccactttttccagagttttttcccctgttgacccaggttagggttggctacaagagaaacttgcatggactttggagtcagaaatgaatcaatagttgtcagtcagaggtggtgaaggacagatgcagaggtcctgatgggtttcagtttgtccttgtttctcccaatgccatatcttccttctctgtcctctgctgaccccactgacaagcagtgactccaggtgcctccagttcaccccattggcagtgactccaggtgcacccacagatatttccctgaagctcacacagtgacaaccatgaggaggcaccagccttccatggacttccgcaccagtccccctttgggttcctctgcagcagctgcgtgtgcctcacatcctgcaagctctgactcatgtacccacctcagggatagggagtgacttttctctgatccctttcagagctccactttcctagtttctctcacaattttctaaggcgcaattcagataataaatgtcttattccttaatatttgcagtagttctgcttccctgatcaaattctaactggttcacaaagggtggagaaaatgacacacaggacaggctgatgcagatctgtgaggaaggcttcagactcagggccagcgggaggcatggcatcattcactcaagaacaggatgcactggggttttaactccaggagaggaaccctggtatttctactgccttctgtgcttgtagaggagttggaaggggcagagtcgaaatcaagttagcaggacctaggttttgcaagtgaaatcacagctttgctagtgtgagaagtgattggtgcccacccactaattacttgggaagttgcctgtaggggcttagagctttctgctgagccagagttgctgactccctgagggagggcagctgaaggcatctaggagctaactggctcttcccaaatagctatttcatgattttgttgctattggacacaggcatgtgcagcttgtactaaaatttttaactgttatttgtctataggaaagcaattgattttccacatatcggtttagtaagcttccactttactaagctctgattatttcagctgtaaatataattctcctgctttctttccaatatagactcattgtggctttctgtgcaattgcattgattagattgttcaatgttaaatgtaaatggtgattgaggaaaactttctggttcttgattaatttgaagcatgtttgactcttgattacaggcacatagatgcacacacagacacacacacacacacacacacacacacacacagagagagagagagagagagagagagaaataagtatcatgataaggaggtatccatccattcctattttactgaatattttgatcagtaggaatatttatcaaaagcatttttggaatttacagagatgctaatttttttttctcttgaccaatttacatggtaacttttataaatgattttctcagtttgaacaatcttggcattcttaaaataaaactcttaattatatgcattatctctttattgtatgaataatacatgaatatttgcttttttatttttggctactaaaatatttgccaatattaaatttttctcttggataaatattcaggaacaaaactataaggcagttatttctgtttgttgtcatgatcgagttttgggatcagagctatgtaagtcttaaaaaaatgggaaagtttcagattttttctttgtctaaaacccataaatatcacagagattatctatgtcttgaatgtttgttgtaacttttctataaaattaatcaggccttatccactttcagggtgtaaatctttacctgtgttttcaattaaaaaaatagtttttctatctcttcttgagcaaattctgttaattttaatttcctacaattattatagtcataagttttttacacagtattcctttatgaaaaaatctgatctctatgtagggttataaactctctaaaaaattcccaatattatgcagttgtgctttctattctcacaggttagtttattttaacatctattcaatggtacatcttattcattctgatgcttttatttttttctaaataatttatttctgattattatttactcctttttaattttgtttttttagcttcttaagttgaatgcttttttgatttaattgaaatttttcttatgtgataacaatgttaaaagtaatggattttctattgaaagtgacattggctatattttttgagttttctatggagtattcctactgccattaattcttaaagaatgtataattcaagttttactttccttttgatgaaagaattatttatagatcaaatttttatttccaggaagatactttttaaattttattttgttgtcagtttctagttttattgtattgtggtcagaaaattaataagtatctcactggactgtgaaaataaggtatattatttggtttgatgtatgtggtatcaatatcttgtttatgctactgatatttgtatttctacccatgccttttcctgaagtataagtatacctcaatttcaaactttcttgtcaatgtcgatatgttttacatgtgtcttatgaactgtgtacatcaaatatatgaattttgcttgtatctatttttatttatttaaacaatccttttacttcagaatagttttagatttacagaaaacttgttagtacagagtttcccatatatccttacctagtttgcactatgatcaacatcttttattggtttggtacatttgtcacagggaaattgtgcggtttcttgaaaaagtcaataaagttgatcaaattgctagccagacaaatgaagaaaaagagaggagatacaaattccttatatcaaaaatgaaaaaagtgtcattactacttatcccatggacattcaaatggtgacaaaggaatattatagataattctatgccccacccccccaaatttgacacttaaatataatggaccaatttcttgaaagacacacagtacaaggggaaatatatggaatatatgggaaactcacacaaagggaaatagatattgtgaataggcatatatctattacagaaattaagtcaataactaataaccttccgaaaaaaaaaaaaaaaaaaaacaccagccctggatggttttcctggtacatctaccaaacatttaccaaagaaataatagcaattttctataatctcttgtagataatagaagcaaatggagcactttctggcttattcttgagtgcagaatcaccctaataccaaaaccagataaagacacaatgagaaaggaaactatagatcaatatctctcatgaaaatagataatagataaaaaaaatcctcaaaagatattagcaaattgaatccaacaatatataaaaattagaatatgccacaaccaagtggaatttattccaggcatgtgaggttggtttaacatttgaaatatagttaatgtaatccatcacatcaagacactaaagagacagtaaaaaggttagtgtttgccaggggttgggagggtggggagaagaaggatgaatacaggtgaaacacaggggatttgagagtggtgaaactgttttatacaatattataggagtagatacatgacattctgcatttatcaaaacccatggaactgtatgacataaggagtaaatcttaatgtaaaccgtgaactttagttaatataatacatcaatattgaatcattgattgtaacaactgtaccgcattagtgcaagatgtaataataggaggagaaactgcatgggtgtggggggggggtatgtggaaactctctaagctatctgcttaaatcataaactgttttaaaaaaggaagtgcattttttttaaaggagctcactcttttatgatgcaatgttgcttttctatagatttaacaaggtgcaggaagatgcagactgggatgaataagcaccaagctgaatgaactcctttaccctgaagagatcttggcccctttcacaacctaccgtatcaacctcttagcctatatatatatttttttgtcagatgtttgtttttataatgaaaatactcaagctcttttgttcctatgcaataaaacatttagcagtagaatgcactttttttcgccatacactatgcctaagagcccttattgtactgggtatatttgcaatataaggaaaaaggctatagggctaaaaaccaagttagaatcgctttctggcatttttttctgtaaattgctgattcactttctgacactcttgcttttaaattagtctaaggcaagcacagaagcatacttgataaaaggctttaaaagaatcctgattgctggggctccggtctttctgaccttattaagtggggttggggacatttaagcctcttctctttttttgatcaccactgcagagcttgctgaaatctgaaaagctaacttgtcctgctagccatccatcaggggtaatttagaagaagaaggccagaaaatgctttgcctttaagaataaaagagaattggtaatggggtttttattttattctggtacctaacaatatctgcagtggccaattgcaaactactgtgattttaatggtacagaagcattaatctataatcagatgatgttaaatacattattctatacttgagttaatagtcactggtgctgctaatgaagtcaagggacactaagaaccctaaatccttaaatatgattaaattaaatccttaaattagcatggtaggttcttctgcctcggcagttttcaaagtgaggtcctgaaaccttttcagttatacctgaaaagagtttttgctgttttcataataattcaaagacacaatttgcccatttcacgaggttgactttgcactgatattggacaatttttctttttttggccttggatctgctttgttgacctcagagcacactttgaatgccattaaaaagcaaaccacatacacaacaggaactagaactggatctgaagtcttctgaggcacatgacctcagaagaattcttcaacaaggtggatttatacaaaatgcaggggaaataaatgaggcaatgtggtgctgagtcaaagggtaacagaggaacagtcagtgacagcgcaggcagacgatacctctttctcataagtgcgagtgtaaaccgcagtgccctgggtgagtgtcaggatgagtttcccatcacttagctctggcacaagtgtcctctcttgcccgttacacttctgcaggtgaaaaagtttgcttccatccagtgtcacaatggacttgacctttttgtcatctgctgttgtctcatcgaaccccatccccagcttaaagctgatctctgtgttcttgaacatgctctgtgtttttaaggtgataatgtccccattctttttgatgattgtggtaggctttgtcatgctagccacctgcctgatagcaaaacttgcaccgattaacttcatgtagtcatcaaaattcttgctgtctgagagcttccaggtgcacaggaaggcatctaccatggtgatgctggcctagactgagaaagaagctgtgagagagcaggtgtgcaaggagttggactgccgatattggatgcaatttttggtgccttaggaccagttgaggcagtggcactaaactgtgctaatgctcattgtatttttccccaccagacagtggcaatataatttgtgagtatcgtcttgcttcaactcatccgtcatgactttctcacagctattaaaacatgttttacaagcagaaacttacattttagatgaataaatgcaggctcctgaggaaaggcactttcatgattgtttgagctgtgagctcaactatctgcttttccatggaacaccatatttgtttgaaaggccaactgatagacaggctgtggctattcagacttgtatatttggcaggcattttgtaaaaaataagaaatctgagtctgacatcacaaggaaaacaaatgacagtatttatagccaacgataaaatttgagctcttaagtgaaaattagaattttgggatacttgcatatgccaccatgagcttggcagctttgcaatacttaaaggcttttctaatgagaacagcggtcatatgaatggatgtaatgttttgatatttatactagaagtgtcactgtttcaaagatctgctgatattttcccaaagaccaatgcatgatgttgcaaagtgacatggtttggctgtgacctcacccaaatctcatcttgaattgtaactcccacaattctcatgtgtcgtgggaggaacccagtgggaggtgatggaattatgtgtgggggcgggtctttaatgcactgttcttgtgatagtaaatgagtctcatgaggtctgatggctttaaaaatgggagtttcgctgcataagctttcttctcttgtctgccaccatgtgaaacacgcctttcaccttccaccatgattgtgaggcctcctcagccacgtggaactgtaagttcaataaacctctttcttttgtaaattgcccagtctcgggtctgtctttatcagcagcatgaaaatgggctaatacacaaacaaaattcaaaatgtaaggaagactaatggattttaatgtaatggttttagattccacgttgcagcccatctttaagaaactaccacttgttcaggtttggtgcactatcagagaagaatatcccgatgatctgaaatggctattatactgcttaccctcctttcaattgcatatctgtgtgaggctgaattttcttcatatacttcaaccaaaagcataccttgtaacagattgaatgcacaagtggatttgagagtccagctgtcctctagtaagccagatattaaggaaatttgcaaaaatataaaacaatgccagttttctcactgattttttaaattaaaattttaaatttgtgatacatgtagatttgcagaaaattgtagaaaataatacagtgtgttgagcactgtggctcatgcctgtaattccagctattcaggaagctgtggcaggaagatcagttgagcccaggagttcgaggctgtagtgagctatgattgcaccactgcattctagcctggggagagagtgactctatctttttgtatgcatgtgtatatttagttctgtgcaattttaatgcatgtgtggtttcatgtttcttctgccacagtaaagatattgagaagttccttctctacaaaggtccctcctgttgtcctttcatgaccatatgcacctccctcctcccaatccttctccctatgatatgttgttttttctgtttatgattgttccattttattattagttgatgttaatctctttttaatttttaattgacatgtactaattgtacatctctgtggggtacagtgtgatatttcaatacctttatgccatgtgtaatgatcaaatcaaagtaattagcatatccatcacctcaaacattgatcatttctttgtgctgaaacattctagctatttgaacacatagaacaaattattgttaactagtcaccttacagcgctaaagaacactagagctcatttctcctatccagccatgatcctgtatccactaaccaatctgtcatctcctctccctccttcctccccagcctctcgatccccctgttctatcctctacttctatgagagtaatttattgagcttccacatcagtctcactgtttttttttgttttaaaagatatagttcttttttttataagaatatgttatttatgttaacaggcaatgggtttattctttttttttttttttttttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaatgggtttattcttattttgttttatttttttgagatgtaatcttgctctgttgcccaggttggagtgcagtggtgccatcttggctcactgcaacctccacctcctgggttcaagtgatcctcctgcctcagcctcctgagtagctgagatcatacccggctaattttttgtgtgtttttagtacacatggcgtttcaccatgttgaccatgctggtctcgaactcctgacctcaagtgatccacttgcctcggcttcccaaagtgctgggattgcaggtgtgagccaccacccctggcttattcttattttaaaataagttactacatattaaagaatcttttagttttaatttctaaccgctaaatattgatagatgtaaccacataaatagagatctttggagttctcagtagcttttaagagtttaaaagggtcctaagactagaaagttggaaaaccacaagaaacaagtcaacagacaccattatcttttgggttaactctcttgaattgttagtaatgtcttctttatagagtctcattgaattttttttttttttgaggtgaagtctcactctgtcactcaggctggagtgcagtggtgggatcttggctcactgcaacctccaactcctgggttcaagcgattcttctgcctcagcctcctgagtagctgggactacaggcacacaccaccacaacagctaatcttttgtatttttagtagacatagggtttcaccatgttggccagggtggtcttgaactcctgacctcagtgatccgccagccttggcctcccaaagtgctgggattacaggcatgagtcactgcgactggctgagtttttaatatttctcacagtgcccatgatagtgctgggcctagtattcactcaataaatataaacagaattgatgtgaatatcttcatcaagtttataagcttcatcactgtggttgtggcttttttggcaacaatggaccctgcgtatataggcgttgctcgccaattctagatgtgacttggaaactgtgtgacttaaaatgtgaagcagctacctatttacctcaggatttatcactttaaatcatcttcagtttgcatatcaactgatgtgatgactgacaggttcactttggtccctgtttcttttcatcaaagttaatgatcactcatcaaacctagagaagaaacttcatagtcactaaggaaaaaaggatacaaaatccttccccttaaggaatttacaaattaaggtgattattctttttagaaaaacttgtgggaatttacaggggctgtggtaaagtgggttaaatacaacgaatcctaagacagacagaacctaccccgtgtcccctcgagtgggtggccaggcaagtatgatgacagacacatgctgagacatacaggtttagagttagaaactgtcagaatctctattatttggttgagcttgtcattgtgagcttctgtggaaaggagacaaaattctaatagccattgcaacactaaaaacttctctgggtttaaaatttttttaattaaagacataagactcaagtaaatattaatacaactgctaataatgacagtaataaaactcaggaaatttattttaaactcacttatatccaaagtagttaataacaatttttgactttcattatgccttcctccagccatttgtcatgactttctaaaagctattaaaacatgttttacaaatggaagtttacattttagatgagtggatgcaggtgcttgcaaaaaaaaaaaaaaaccactttgtcaacaagagggtccttatttctatctatttaatggaagaaaatcaaaacgtagaaatctgccatttaatcatgcaaggtagcatcacctcaatgtaatcagctaaccaaaatctccttgttcaatttactagtcataaacccaattatttaaaattcaggaaacagataaagtgacctgcatagttaattcagtttttcccccttaaaatacaatcacaattatttattgagcactgacaattggaaaggcactgggctaggtactggaaagaattataaaatgacatggaatctcttcccgtggcacttggttcatgcttcctttaatttttttcccccacttcaaagtacttgaggtgtcctagtccattttgtgctgctataagaaaataactgagactgggtaatttatatagaatagaagtttacttctcacagttctggaggttagagtttcaagatcaagttgactgcaggttcgggcatctgatgagggctgctgtctgcttccaagatagctccttgaaaactgcatccttcagagggaggagcactgtgtcctcacatggaggaaggcggaaggcaaagaggaacaaactccctttgtcaagttgttttgtaagggtgcctgatcccattcttgagagaggtgctctcatggcctaatcacttcttaaaggccccaccttctaatactattttaaattttggaggggacatgttcaaactatagcagtcgagtatggtattctgatcaccattgtatttatctgcttcagacaaatttggagaatttgacttaaagcacagctgttgatagccccaaattccattccagcacttctttgctatatagtctggccatcatccatcccccttagaccagatgtaatacattgtaggatgaagtaggtgtttcatgtgatggaatgggtattaaccatcccatagattggattaattttagaatgtcacatcacttcaagtcttgttggcatgctcagaacttatgctttctgaggcaacttgagtggctgcctacagcaggatgaatcctgtggcttgtgacaaacctggcttctgcctgtgtctatgaggcaccacggcaaagatgccatggctctgaatcccagcttcactgtgcttagtacatggtctggaacagagaatgcacttcatgtatcttcattatcaccactgccacaactaccagatgagcttagtcaacctgttcactgaggcttcctgagagtgatgcctattttatttaccttgcaatattattgtgaaaattataagaaagtttgcataaaaagtaatttgcatagtgtccaataaagagtagaattaaggaaaatgtaactactactattattgatgttgttgttactattattatcactactgaggctggaagaatatctacttctgctgtgccatcagtacaatacatcatgacaatggattatagcaattattgctctaaggcactgacattttctaaacagataaaacattgtatcaactgctgtttttataatttggaactgacatcatcatatatttgtaggcacaccataaaaatctcttcattaacacactgatagcatcttttattttccttcactcagagtttttttttctgccaacaattagtcttgatttcatcaaaagcaatgattacctaaaggaatattgacattctacagaactatgtccttcttgcatttttgtagttgtcatgggaaattaagatcagatcagagtcatagcttatagtataggaaatatatggttcaaaaacagcacaaggtatttgatgtggtcaccagataaccttgaattgtagacccttgccaaacactgcagaaatgctttgggctggagtgttcttgcttcacagacttcttcattttatgattgccagagtcattgaaaataaattttggattgtgctaaagggaaataacaaagatactatctgggatcagtctctcagatttgacagacaatttcatgcttttaattgattccaatctttgcaaaaaagtggaacgaagtaatagacaaaaattaacaacaaagatgccagaagtgactatcattgcatgaaacttttgctgtgttgtttgcaaattgcgttccagtactatattctcatttgttgaaagatattagaaaagaatccaatccccaagctttgtaaagattttgatgttgtggcatatagtaatcgtattcatttccccctttatcctttttgtattataatcttccaagttctaattgggcacacaaactccttttcctggggtaacttaagctagatatgtgattaaattctggccaatgggatgtgagttgcaacttcttgctaataccctttaaaaagaaactgattgctctgtactctcttttacccttcctttggggcagaataaagaggaggtgctgcagataagagcaacattctagggaatgttgctagggcaacaagtggaaacacttggaaaagtgtatttggctctatagaaattagatttaattttttttaaaaacagaagatgatcctgggtccctggaggacctcatggagcagagtcagcttcttggccttgccttacccacaacctatgtgctcctctgttaaaaggaaatatttttccattctgcttgaggcactgtgttttgtgtaactttgctacagcaacttgggctatgccctaatactagatgtgttctaaattttccacacttgctgttttcccattggatgaagggcttgtgagacacagcatatgttaaaaaaaaaaaaaagacttctctattactctttttcaaggtggcagacaaagttcaaattcacattataggctcttttagtatattacatgtcctcagcactggtacttggttccctccctccctcccttccttccctccttccttttttccttccttcccctccttccttcctccccccaccccctttgtctttctttcttgagacagggtctagctctgttgcccaggctggaatacagtacgtcccatccttgctcactgcagcctcgaacatctgtgctcaatgaatcctcctgccttagtctcctgagtagctaggactgtaggagcatgccaccatgccaagctaattttctatttttgtagaaattgggtcttactatgttgcccaagccggttttgaactccctgctcttgacctcccaaagagttgggattacacacgtgagtcactgtgcctagccagtactcaatttcattttgaaagttgtatttctgttttatttttgttaaatggaattaaaatgtctgtgcagtgtctatcataacctagtacaaaagcaataaaactattgtaagcactaagcaatgtggtcattattgacttctttttctagcaaaggaaagagataggaaaatggcttttgcatggggaatttaatgtgtcacagaaaatgatatagaagataatgtaaattgtgatgatgtgaacgcggagtagtttgtgtcgagcatgatggccaatggcagctaactatgcccttctggaaacagatgcacccctttgcgtatatcaaatctccaagctgcactgcaccaaaagaaccctgggcaccatgttacttagctggaaggaaatggggaagctgtgggaacccctataaaactccctctgacatatttagcctgtggcttgtgggtattcactcaaactccaggagtgtgggttacctttagtcaaatctgaaggagttttgcatctgtcacccaatgcagagctgaaggagagggagcaggtgtgaaatacaacccagacttcctttttagtcccagtgggggtacatttttgtctcactgttacccttggtaactctgggatggtaaatagtgagatgagtaattcagaaagtggaaacggaaagtgttactatatctgctacgaagctttgcatcagaaaagtacttcctttgcttctaaagagacttgaagagttttgggcttcttcttcttctctctaggtagctttttattatctcatgttatagttacttacataaacgtattgctgggaattctagtagcacagggattataggagtttcctgtgatttaactaaatcactggtgtcttcaataccatgtccatgcttcccccacaaacatcagagaaaatgacttcttggcatgggaagtttatgagtccagaaataatctatatttagtatttttggcatggagccctccataatctggctccaggctgccttattcctaggctctgcctcttccctccgtgtgatatcatatcagatggcagaggcaatggaaccatcagactagattgtggttttgggccacaaagcatgacccatcagtctttcagattcttagtagatgggatgaccccatgagctttaccaccataattttatttttacacccatgaaagtcatgggcactagttggtgagatccagaggccaatcctgaggtcctgagatggttctccaggagggaggtgcgtaggaagtgagaggtcacactgtcttctcacactaacctcagcctcagggtgtgaggccagcttcagaggggagaccacagttctggggcccagccgtttcagccactgccttcttgccttctttactaaggtcgttaacaagcatactcattagtggcaatttccctggtggtttttgtgatgtgggatttgtttgctatgaaatggctgaatccgcaaatcatttaaaatagtcaatcctactggagatagaaataactccttgcctgtgttgatcctagctagtgaccagtgtccaggaggtgaaatcttgggaagagaggcctgggcttctgactcagcagaaaccaccgtcttgacatttttagtcttttctttggtcttgtcctactatagagacttctttctacaggccagatttgacaaaatagccctaccaaatcataatcagaggtgcaccagccaccctcccccaataaatttggccttatttcttgttaccctgatgatgctcaggattcataatacatatctctaaggaatctccagatttgtataatacttgaaacagaatatccaagaagaggagaaaaagaaatggctacaatagatcagtcctccaccaggagtggcttgaatctcaggggaggtttgacaatgtctggagacatttttggttttcacaacaatgggaagggggtttgtaccactggtgtctagtgggaggtcccaggaagctgctaaatgtcttacaacatgcaggacagtcctctacaacaaagaactattcagtccaaaatgtcaataaggctgaaaccctgaaatagaggaagacaaagaggtcttcatatatcctgcagtttaagaaatgggttttaaatatttactgagcatctattatgtatataaatggtgctttttttatgagatggtccaaggaataaaagtcacattcacgaacatcaaaaagtttccagtttacttggagatggtacatacacaatgaaattgtgtgttatttattacagcaatacttcacttgcaatggagattgatacttatattggtttgctagggctgccataataaagttggcttaaataacagaaatttattttctttcaattctggaggctgtacgtccaagatcaaggtgtcagctgagttgttttttgctgaggcctccctccttagcttgtaggtggctgtcttctctctgtgatttcacatggtcttccttctgtctttgtctgtgtccttatctcttcttcttataaggagaccagttattttggattagggcccactctatgtgccctcgttttaatgcaatgacctttttaaataccctatctccaaatgcaatcacattctgaggtactggctggttaggacttcaacatataaatttggggaagatgcaatgtagctcagaacagtactctcgggttataacttggtagccaacggtagaaagttaaaaagcagcacagaaattcattttagagtattatgtaagagctgtcacactaagaaaaatatttaaatttttctaaaactaaaagaaggaatatgcttaagagatctgttgtacaacatggtaactgcaaaagtcacagcaagttagtaatggagctactttataatttactttcatcctaccctcaattaatttactggaattcaactactgggtaaaagaaaacaaacagagagggcttagggcagatatcatgggtcctggaccattaagcctcaaacagtccagccttgctagaaagtttaggggaagaattatgtgtttaaaataaaccttaaaaaattgaagtattatgatcatacagaaaagcgcacagtcaccagtgttcagcttgatgaattatgacacagtgagcacacctgtattaaccacagccaaggtcaagaaacagaacttcatcataaccccagaggttcccttgtcccactcactgccagccctggtttctcttcctccctcttgtaaacgattttaatgattttccagcctccctcagagaagagaagcactttgttcaggaggcctggccgaggctggtggaagagtggaggaatcaactgaagaattaattgaaagtcatagagaaacaatgaccaacaaagaattgggagaacagacacagaattgtatacgtatagccttttattccaggcagtattctaggaacagtttaagacatttttaagggcattttccactctttacgattttcacttgagtactgtttaggttttaaccaaacttcgtgtcatcttaaatcgccctgagaaccggcgggggttctctgctcagcggaggctgaggctctcagctggctcacagctttagggaagctgctacttcctcctactcacctgcccttgagcgcagggtgcacagaggggagggggcagagagcaagacgactgggccagctcagagccagacagtcctacctcagtttactcattctgtctcagggatgagagatgaacaaggtccctagaaagagagtgagttgattcagctgccctagggaaacagctccattctgcttatggcctcagccaactgaggtccacagtgccagataacctcaccccagcgtggggctgcggcccacgccccctcgtgagaggtgaagccagcaggacttcctgggtccagtggaacttggagaacttttctgtcttacaagaggattgtaaaatgcaccactcagcactctgtagctaggattgtaaaatgcaccaatcagcactctgtagcttcctagaggtttgtaaaatgctccaatcagtgctctgtaaaaatgcaccaatggatggtctgtagctagctagaagtttgtaaaatgcaccaatcagtgctctgtaaaaacgcaccactcagcactctatagctagctagaggtttgtaaaatggaccaatcagcaccctgtaaaatggaccaatcagcacactgtaaaatggaccaatcagcaggacatgggcgggaacaaataagagaataaaagctggccacctcagtcagcagcagaaatttgcttgggtccgtttccacgctttgttcttttgctcttcacaataaatcttgctgctgctcactctttgggtccctgccacttttaagagctgtaacactcactgcaaaggtccgcggcttcattgttgaagtcagtgagaccgcgaacccactggaaggaacaaactcctggacacactcgctggtgcattggtgatgcagcccaatcagattagcaacccctcctcttggggcagagctaagaggggtgtgtccctgttatagacaagattaggagcaatcaagggagaaccactgcacgtgctaaggagggtgtaattgggttggctggctgtggctgagctggggaacaggagtgtggggtgctgggagttgggtagggtgatgagttcatgttgagaagtggcgaaagtaggaaaggagtgacaggccagacgttgaaggtcttgaatattgggaaacagattttaactgtgttgtatcttgtaggttactgggaaacggttgttggatcttgagcagaacagtgacaaggttgtatttcacgaaaattgtaaatcagtggggggtgggggccagggagtattgcggggagagaacggagctaagagaggaagggagaccgttgaaggacaggtgatgcacatctagattagcatgtggcctccaggaaatggatgaagtttagagaagtactcagtcctagcatcaggcttcagacaaggggcaggctggggagcttctaacaaagccccgagaaatttttttcttttggacctgagtgagtagcgggttgagttaatcatactcttctgtgtataatcaccgtcatcattagttcactggcgccctcacttagtttgtgtattcatttgcttagtcattcatttttttaatccccattctgcactgttgttattctccccccttatatgcagcttgtctaatgtttgtgcttttttgtttctgagtgttctttcaaagtgtttgttgttttcttgtttgtatgttattttaaaaactttttattgtggaggggaattttgaacatatccaaaaagacatagaagaatataataaatcccgtgtgcccatcattcatccttaactaccatcaggccatggccagtcctacttcatctacatcccatccactgcctgccttccacacatcagatcatttctcccataagtatttgagtgtgtttttctgcaagataacacaaccacaaaatcctcatcaatagctttaaaagaacaatgttttcttaatatcaaaaagctaatcctcaaatttccaatcttctaatgactgttattttttccacagtttgtttatatgagtccagatttaaataaggcccaaacatagtgattaaacatagtgattggtttatatttctataagtctcttttaattagcaggtttcttaccgaatctgtttcttttttcccctacagtttgtttgttgagaaactcaggtcttttgtcccgtagaatttaacaaagtgtagattttgctgattgcgtccctgtggtgtagtttaacgagttcctccgttcttttgtagtttctttgagttggtagctgaatctagggatctcatcacatctgtatttaatttttttaacaagactgtttcatggtttgtcttgtgttctttcgtcaggatgtgcataacgtggttgtctcttttttatgtgacattagcagccactgatgatcaaagcctaggactatttatttttgtattacttatctattgctgtgtaacactattgatgcaaacttagtggtttatagcaaaacatattaattatctcagtgtttatggatcaaaatccaggcatgaatcagctgattcctctgcttccagatgtctcagaagtctgcaaacaaggtgttgaccagggctggggtgtcacctgaggcttgactaatataggatcccctttcaagtttatgtggctgttggcaggatttcattctttgggggttgtctaactaagggcctcatttccttgctggctgttggtcagaggccaccgttagttgcttgccctgtgagcctccccatatagcagcttagttcatcaacttcagcagtacagagacccatagagaaagcctgctagcaagagagaggctacaattgtatgtaacataatcatggaagtgacacccatagcttttacatattgtgttggttggaagtaaatcacaggtcccatccacactcaaggggaggggattgcacaatggtgtaagtatcagggataattgcaggctgtcttagagtctatttgccacagttgagtttgcaaactgatgatattgtaattctgggatttcttctttgtttactagctggaatatttctataagaaaaaacttctccttgtattgtttgactatccatggtatattttagaaagggatcagaataaatgcttgattcttcccttttacttaccagttttaaaaactaataagttgattcccttgcattctccaatggtggtcaattacatgggcaggtattgttaattatgtaaatattgtgctaaatattgtattctgtttatttccttttcagaaactcagtactgtgttttaaagatctattcataatgatgtgcgtacatctggttcttagcttctacttgttgaagagtcttcatggtgcgtgtaacccctttcacctatctactcagccaatggacaccaagactgcctccaagtctctgccacgatgaccattctcatacagcttccctcatggactcacacacctgcagtggaattggtgagtcatacagtgtaactaagtagtcagtttgcttaagtagtgccagattgctttccagaatggctgcacaaagctgttctctcatgaaaatgatttattaccatatgtagcttagcttaaggtgggaggaaacaccttagtatcttcatgaattttatgcccttcactaagctgaactaaatttcttaagaaggtttcctatcagaagcatccaagttactccatatctccaaagccacagccgtgctgggtgatgagagctaggagacagaatcttatactattatatcccaacctcgactattgcaacctggtaaactatgcaaattctatcccaggcctcagagatgagggagaggaagatgggaagaagaaggtatgatgtattaggccgtttttgcattacttgtaaagaaataactgaggctgggtaattttattttattttattttatttatttatttattttatttatttttttattatacttttaagttttagggtacatgtgcacattgtgcaggttagttacatacgtatacatgtgccatgctggtgtgctgcacccactaactcgtcctctagcattaggtatatctcccaatgctatccctcccccctcccccctacaacagtccccagagtgtgatgttccccttcctgtgtccatgtgatctcattgttcagttcccaactatgagtgagaatatgcggtgtttggttttttgttcttgcggtagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgcctcaataaacatacgtgtgcatgtgtctttatagcagcatgatttatagtcatttgggtatatacccagtaatgggatggctgggtcaaatggtatttctagttctagatccctgaggaattgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccgctttttgatggggttgtttgtttttttcttgtaaatttgtttgggttcattgtagattctggatattagccctttgtcagatgaataggttgtgaaaattttcccccattttgtaggttgcctgttcactctgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtctaacgtttaagtctttaatccatcttgaattgatttttgtacaaggtgtaaggaagagatccagtttcagctttctacatatggctagccagttttcccagcaccatttattaaatagggaatcctttccccatttcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaaggcattggtagtttgatggagatggcattgaatctgtaaattacct

SEQ ID NO: 226 - DNA, 388716 bp, Homo sapiens
ttaggcactcagttctagtgtcctcagtaatgtaggtctgtttacatacaagaagttcaaggctttgagtggggagttaggtttagatagagaagaagtttaatgtagtttttatgtgagttgacactggaagtcaattacttttgaattctctgctaaagtgtttagcattattctgtaagcaaaagggagccatttaagtcttttgagcaggaaagtgaaaagtcagggctgtacttttaggaaaatcattctgttacagagaggaccatggactagttgggagttattagacgcaggaaaaccagttagaagaatattgcaatcctagggacaaaagctggtgaatgagcccaagagaagtaggaatgggaaactttaccttaatttgtaaaagagattgcggcagaatgaaaaggcggcatgctggaaatgactggatgggattgagggagaaggaaagcggaaaatagagcagatgagggagagaaggatttctcacttttggagccaagtttgtggtccagcaggcaattcaggtgaagaggtgcttgtagtgagagggaatagagtgtgagacctagtaggagtgatctgatcaagctgcggatgagatttaggaagcatctattttctttcgtttttctttttcttttttcttttttttttttttttttttgagacggagtttcgctcttgttgcctacgctggagtgcaatgggcgcgatctcagctaactgcaacctcctcctcccaggtacaagcgattctcctgtctcagcctccgaagtagctcagattacaggcatgcgccaccacactccgctaatatttttgtatttagtagagacggagtttcagcatgttaggctggtcgtgaactgctgacctcaggtatccacccccatcagtctcccaaagtgctgggattacaggcgtgcatcaacgtgctcggctctctccttccttccttccttccttccttccttccttccttccttccttccttccttccttctttctttctttctttctttctttctttctttctgtctttctttctttctttctctctttctctctttctctctttctttcttttttgagacggagccttgctctgtcgcccaggctggagtgcagtggcgcgatctcggctcaccgcaaactccgcctaccaggttcacgccattctcctgcctcagcctcccgagtagctgggactacaggcacacaccaccatgcccggctaatttttttgtgtttttagtagagacggggtttcaccgtgttcgccaggatggtctcgatctcctgacctcgtgatccgcccgcctcggcttcccagagtcctgggattacaggcgtgagccactgcgcccggcctattttcctttctgaactaagagatcacctcttggtttggactaggtgtcccttttgaaacaaatgatagtgtgggtgtcttagctcaagctgctagtacaaaataccatagaccgggtgggttaaacaacagacatttatttcccattctggaggctgaaaagtctaagatcaagatgctggcagattcactccttggtgagggcctgcttccttacttgcggatggccaccctttctttgttttcttacctagcagagagaggagcctctggtgtttccttttttgttttttgagacagagtcttgctctgttgcccaggctggagtgcagtggtgcaatcttggctcattgcaacctccacctcccgggttcaagagattctcctgcctcagcctccccagtagctgggattacaggtgtgcaccaccacacccagctaatttttgtatttttagtagagacagggtttcaccatgttggtcaggctggtctcgaactcctgagcttaagtgatccgcttgcctcggcctcccaaattgctgggattataggcgtgaaccaccatgcccagcctggtgtttcttcctcttcctatgagggcaccaatcccatcatgggagctccaccttgatgacttcatctaaacttaattatttcccaaagttcctacctcctcatatcaccacattggggattagggcttcaacatatgagttttggagaggatatacacatttattccattaacagtgggtaaatggtaaacggtgcttcagagtcagtaatacctaccctgttctttctggaagataggttgaatgggttcaggcagtgtttctcaaaaatgtgcccttaatgggatatgatatattaatgtgttttccaagggcagtttgtgtcatggtcaaataagtttgagtaatataggattaagcaaagccaaacagttggggtttttcaaatgcaggacttctcaaggccttaatatgtaatgctactatgcacagttaatcttcatgaggagagaaatataaaataaagcatttcttatattcatttaaacagacaatggtttttctaaggaattaatgctccaagagaagcactttaagaaaaactgatttcagctgtgccaagacggccgttatttgtaatagttgtacacaaataaggacttctttcctttaatatagaaaatgcaatatagttttggaaaaaaattctattagtagtgaagaaaattttttaacaagttcttcccaagaaagcctgagcttaggcctcacatgagttgttggagtccatttccattaaatagcgtttggggctcaacaacatagtgtttctctaactccagcttcagaaacctaccattataaataattggggataattatgagagcagctgaataaactggaaaaggttgggcataaagagaaaagcaataggaggaaatgtgcagtacttgagctcgcccataaatctttctggaggcagaaaaacagcccccatcttctccaaactggaatgcgcatataaagtcaataccaaatgaaacctaaccaaatcaaaataacggtaccctgaaaagtgactctagttttattttgcagttattgagagagaatctctggaccctttcgtgcagttattgagagagaatctctggaccctttcgtgcccctaaaattaaatcccctgactccaggctaaaaaatatggcaataactttgtttggggccagggtggtcccttaatcctgaggcatttgtgattccttcccccctatcaacccagcatccctcacccttctaccactggaaacataatgacttaagaagctcaatttggtctcatgagcagccttcaagcaaaccttttgctgggaaggtcgttatggagaaaagcaagggtttcagaaatgaaataaattgttctatcaataagcagtacatctggcatttattaattaaaggctggggagcctctgggggcaggagactgggtggctgctgcaagtattgaggaagtcagtacatgataatatgcactttttgttgaaaattctctatgacaattttggcaaggtgcatgtttccctgcatttgtcaattatcaatttttctgcataatcagatctactcctagacttcattttatcttattgtctctcaagggggaagtggaggagggatgtaaagtggacagagcaacttgcattgtgccagacaatgtgctcagggttatatttgttataatgtggctattgggtgggagtgatccctttacagacaaagaatttgagcatccatgatccaaacttagctctgaactcttcttttttcttttttccttttgagacagagtctcactctgtagcccaggctggagtggtgtgatctcagctcattgcaacctccgcctcctgggttcaagcaattctcctgcctcagcctcccgagtagctgcgactataggcgtgtgccaccacgcccagctaattgtttgtatttttagtagagatggggtttcaccatgttagccaggacggtcttgatctcttgaccttgtgatctgctcgcttgggcctcccaaagtgctgggattacaggcgtgagccactgcgcccggccagttctgaccacttctaaactccttctgtttcatgcaagaagaacttaaattagagaggttaggcactctgatgccctgacgacagggatgtaaattataaatcagcacaactgttttggaagactgcttgcaatgaatatgcagcaaggtccctaaaatgttaatagtatctgacctggtaataatcgtaatgataaatgccatttactgtgcatttacccacaatccagcatataaccttaagccatatctctgcttagtttgcgcctgtagaattcctgagatgtattctcaacaaggaactggttgcttaatcagctctctactgagcacctactctgtagctaggctgactagataggttcatagttccaagtacagaggggaggaggaagaggaggtgagagagccctaatgagggaaattgtattcaagtactattctaacttggatttggcaactttcccttagttttcatctcttgaacgataagcggtgccaatcagtagctatgtgacttggagcaaattacttaatctctgtaaaagagattacttgttacttgtaaaaggaggataatagtgccagcctagggttgttgtgatgaataaatgagataatgcaagtgaagaggtatggtgcaggaattttggctttaggaacatattgaggtttggaaggaattcctagatagaggctctgtatcagaagcaatcaacctcacctttgctgtccagtacactagccatcagccacacatggcttttgagcacttgaaatgtgactagactgaattgaaatgtgctgtaagtgtaaatacacactggattattttgaagacttagcacaatagatagaatgtaaaaataccccattaacaaatttcacctgcttcttttttactttttaaatgtgactactggaaaattctaaagcatacatatggctcatatatattggataacattgggcttgacatcagggaggcaagattccctctgcccccaagaaataaaaattcagctctagactgcaaaaccttctgcctggaggaagatttctcttaaagattcccttgttctcttccatcctcatccccaacttaaatccagcctcgacatatggtggtaaggtgatctttctattacaagatgaaaatctgctctcactgttgttctatttcttcacacattttgaggtttcctctttgcctttcagaataagggacacactccttaccagggctgcgtaccaggccattcgtgacctggctgccactccctgccctcagcttcatctcccacccagtttcttatgtgtgttgtatttctgataccgccgtgtctttgaatttgctcttcccttttctagaaaggtcattctattatctgtgcacacacaccctagtctcctgcactaccccactgttctttatctgcctgattgtcttccaagacccagcttatctgtctcatcctcttggatgtctttcctaaactttcatcctttaactaggagaaatactcctctctgttccccataacaccctccattggcctctttaaaggcacctacacatttgatttcttcctggtttgcctgccttcaattgactgtgagtttcttaaagacagtaacctcttcttcacctataaccccaggaccatgactaatgcctggaacacagtaaactctcaatagacatttgtcagggaattggccagggatcatcagctcatgggtggtgtggcaattagaactcttctggatgcaagtgacagaaacctccactgtgccaggctttattggcctacaggattgaaaagtctacattgccggattcagcagttcaactagtgtcactaagacactgtttttcttcatctctgtttacttcccgttgttccagttccattctaaaggttctttctttgtggtgacaagatggctgacaggtatatccttccagattccatttaagggagacaaatattccagtcaaacaagaccctagttccagcagagtagtctggaagtagtcaccgttgcccgtggataggatacatcaggagagtcaggtctggattccacgctgaggccatggaattggggctgtggtagagctggcttcacaccaagcaaggagctgagagtggaagctctcaaagcatgatcaggacactatttctatcacaaatgcaatacaatgtccactgctgtgaaggaacactgggatatacttgttccagtgcttctattatcaaagtggacaggttagacagtgtgagcttcaagagaaatttatgctcttttaactgtgttaattttgttttttctttgctttggcattgccaggaactctctgtaaaatgggatttattcttgttatatttttaggtattatatagaacctgtgtaaatcagttgggaagatatataagtcaatggagagatagttcagagatacaaaaccccaccactgtttagtaaggcatctttcctggcttgcgaacttactgagagtacatgaggaaatgattaaacctgcaacctctttctgtgaaatatggcatactatgtagaaatatttggtacaccttggaagaacaagtctttagtatcagggacactcagtttgaaggctccttgtaatagcttcttctgtacaagttcactaatgtgaaattcattgagtccatactgtgaaccagacactattagaggggcaggagagagggggtaaacacagcatacttcaaggagcttacattatagtgggaggagccaataaacacacaagataaataaggtactttcagattgagataaatgctatggaaaaaactgagtaatacgcaagagagggactagattagagtgggtcaatttagggagggtggccaaggaaggtttctctgaggaggatcatttgagctgaggcctgaatgatgagacgacatcagccatgcagataacaatttaggaattcccaaggaggacagagggctcaaccgtttggggaatttagggtagactcctgccttcaaagttgggtttcaggctgggcatggtggttcatgcctgtaatcccagcactttgggaggccgaggcgggcagatcgcctaaggtcaggagttcaaggccagcctggccaatatggtgacactctgtctctaccaaaaatacaaaaactagctgggtgtggtggtgtgaacctgtaatcctagctacttggggggctgaggcaggataatcgcttgaaccggggaggcggaggtttcagtgagccgagatcatgacactgcattccagcctggacaatagagtgagactctgtcttaaaaaaaaaaaaaaaaaaaaaagtcgggtttcaaaatagctacgtcagtagcacctgggagctttttagaaatgcggaatcccagatgccaccccagacttactgaatcagaatccacatttaacaaacactcccaggtgatttgtaagcacagtaaattcaagaagtgctagactcttaacttttcctgcagcccactggaaaggtgtaaatcctgctgaggcggggagcagggaacggtgttgtcagtgtccgtagaaagatgacatggtaacatttactgctgcctctgaaacaaacaagctaggttctaagggggaagttcactgggttatcaaatgttagggtccaagtgattttcttggttagcactcttgcttcacagaagactcaggttctttgagaagtgaccggctcatgataggctgcttctctctctgtgccagcctttttttttttttttttgagatagggtctggctctgtcacccaggctggggtacagtggcatgatttggctcactgcaacctctgcctcctgggctcaagcaatccttccacctgagcctcccaagtagctaagatttgggctaccatgcttggctaatttttgtatttgttagtacagatggcgtttcaattgatgcccaggctggtctcgaactcctgggctcgagcaatctgccctcctcagcctcccaaagtgctgggattacaggtgtgagccaccgcgccaggccttgtgccagtttttaaaaatcaacaaggacagattagagaacagtggaagagggtgagcagcatgatgaagtgatacagaaataatttcacatgaagaactgggcatgtttggcctttcttttcttttctttttttttttttaaagccattcggtgagggttacttaagaaaatagggccgggtgcggtggctcatgcctgtaatcccggcaatttgggaggccgaggtgggtggagcacctgaggtcaggagtttgagaccagcctggccaacatggtgaaacactgtctctactaaaaataaaaaaattagccgggtgtggtggtgggtacctgtaatcccagctacttgggaggctgaggcaggagaatcgcttgaaccctggaggtggaggttacagtgagctgagattgcaccattgcactccagcctgggcaacaagagtgaaactctgcctcaaaaaaaaaaaaaaaaaaaaaaagaaaaaagaaaaaaagagaaaatatatgtgagcaccagagctcaacattaggagcatttctgagatttggagctattcaacaatggaagttcctggcacacacatcaggtattcacaataccctttctcaggtgtttggtcactgctagtgagccgcctggatcagtgtttcccaaatggcagtcatttgcatctttgcttttcttttgggggcgggggggtaatatcctgtaccagatttttgaaaactgacattaaaaatacatgtttaaaatgtgcaaagtgcactaaagtgcactggatgtattttttattcatgtatatacttttgttatctatcacccaggtcaaaatacagaaccagcaccccagagggttccctcctcctccttcccagccaataatcttctcctcctacctaaccgctgttcttacttcaatcactatcaactagttttacacgttcttcaactgcatataaattgtctcagttttttacttaacacttttcttgaagtgctttcgttttttgccactttttatttgacctaagaaataacattaatgaaacagtggtttgacgtgataggcatttccctcctaatgcgcactaaaaacacttaactatttgaaaaaagaagtttcttcgtgtaccaactaatatattctccgccctgtctccagaaaccgcccttcctctgtgggccggtggttaccggcaccattggtacacggaccacattttgtttcccaaagcaaccagatgatttttgaggtcctttgcagctcgaacacggaatgactttgtggtgatcgagtagccagaagttcacggaatgcactgtcacaattgtgattccgccatagcgccgtgcatccatccaacacttgtttaatacctatatttaatacctaataccttagacggtcctaggctgtggacacagaagactaaaccccacttcctgagttgaagtgggggaaatagaggagtaaatcatttcacgatgtgtggttaagtgctgcagctcaggtaaccaccagtacacagaggaagggcggtttctggagacagggcggagaggagaccgtgggtgggcatttcccagagcagcctctgccagccaccctactttgatcactttgccgccgagcagcagcggcggtcaacctcagcctcccttagcaacctgagtgccccgtccaggagccttactattggtctcatgcagcgagatgggcagttctgccgtgcaatcccagctcgcagttcttgctccgcgtgtactcacgggaggactcgcaggcgttaccgccttcccgcgtgccccgcccaccctcccgagcgtctttcggcgcatgcgcggactggagctgtgtgcagggccagcgcggagcccgagcagccgcggtgaagcgcctgtgctctgccgagactgccgtgcccattgctcgcctcggtcgccgccgctttagccgcctccgggggagcggccgcctattgtctttctccgcggcgaaggtgaagagttgtcccagctcggcccgcgggggagccccgggagccgcacggtgagagcgcaacttagttggcggagttgggggaagttttgtgatttgtgggtcggggcgcggagcgcggccagtcccctgcggttgctcggtggggcgggccccggaggaggggcgggggctgcgggggtttcgggggcgggctggacagacgggtcgccgggcggcgccgggacctcaggtctgcggacccctcctccctgcgcatcgcccttctcccgcattgtctgcttggggctcggcgcgcctcccactccgcagcccaacttagaggccgtcgccgctttccgggtggggggcgcgcccggccgccgatgctacctcaggcgctccgcccccagcgaggccccgaatccttgccccgggtccccgggtcggcgccgccggggcgggctcactcctcccctggggcgggcggccgcggtgtggagtccccgccgtggagtccgcgccgtgaacaagtgctgcgggcgcgagggagcggctccccggggtcgacgcggacggtaaacacgtcgggccgcgcctgcctgtcggtgcctctccgcggcttctcgggggtgcggcccagctgacccgcgcgggtcgcaggcgagcggcccaggagacccgtgcggtccccacgcgctctgggacccgtgcagccagccggctcagcttgcagctatactttgataccaaacaaaacttttttttttttttttggtaaatacggtttactgctttttttttttttttttttttgcaaagccacgaagtatgtgaagttgaaaaaaggaaaaaccctaaaactttttaaaaaaaaatcaagaaagggggtagataggtttgttttgttttggaaatagttcttatagcagagtgataccgtcccatttaattttctagatcccggaattcacaatgaaaattggattgagcggtattttggtgttcattctttgctaatgacactccttaatgaagttatttggagagtttattgcttcagtacagtaaaaaccagtgtgcctttttttttgttagtagtcccccccacaacaagtgttttatttttagaagaagcattttcttcagtttttctgaactgttggattgcgcagatgaggacaaacggtgcagttcttgaaaggtcattattggcaagtttgtgaagaagctaagatcagttgagataaatcattgttactattcttgtattctgtcgtggactcttggggatttgcaggctgcattaagtacaagttttgtcaagtttgggtgcacatattacacttaatttggtttgtgtggcttattatatgaacatgattctgtttcagttccccagatggaactagcttaaatgtctgtcattcatagtggagcaaaatggccagagtgtcatttattgttaacttcagttgtattcctttaccatctgctaaatgaaaaagaaaaatttgagaaatactgtgtgtgtcagtttgctcagagtgatttctcgtgctaagtgagtcctgtggagaagcgttcctgggcttttctggtttggtgggccttgtgttataaaaccaattttcttcacctgatgaagctaaagacaaattttcttcaggtacagccattgcacttttaaattacagagccgcttttaggattcacagtactcgctccatggcttcccttcctggttgtgtggttttgtgtgtgtgattgtggggaaggaggttgacagaggttggaagggattgtcagggagggacataatgtaagcaagtactacttacaacatgacgtgacgagtgcactagttgctttccttctctgggcggtgatggcatgttatactgtaggtactattgttttaggatttctcacacttcttttgccttgactaaatggtaactgcacacatactatactataaatggactcctcctctagtcctttaactccttgagggctgtgatagaccttatttagctttttaccctctttgccggtagtcttaacatagtgcaggcacggtacgtgtttgaattgggtaaattatttttactgcctagtggtagctagcgtacacaggagagagccactaactggggacctgtccagaatgacagttcacttgcagatctgtgatgacatttactttaaaaggatttctaacctttttttaatctgtcaattattttttgaaaagaagtgggtttaactagcgctctaaggatttcaacaagaggttccaatttagaaatcagcccccccctttttgtgaaattattattgtttttttttagagtcggaatcttcactgttgcccagttgtctctaactcctggacccaagccatcctcccacctcagcctcccacagtgttggaattacagacgtgagccactccacccagccagtgaaattattaaaattgttggacaaatctagtcacaactctccctccattgtgaaattggaaaaaaattagaaattttagaaaaaagtacaccctttggaactaggtagcgttcagatctccacacttccattgactagttgcatagcctctcagagcttcagtttcctactccataagcgttagtaacagtgttcttaggaatcagtgaaactatgtgaggtacttaactacagtatctaacatggagtaggcagctattacctagtagctgtaatgataataattttggtacatttttacatgacttaagcattcttaaaagtctgatgcttctgagtgtagaggtttagctatttctttcataaagaaggggccttgagacttgtgagtcttatcgaagtctatttcttcaaaggtgccagatgaactgaaggataatggaaacaatagcgagtttatcttctcagtcacctgtgagtcttcctttgagagtgggacttgcagagtggcttggtagggtagagctctttgtgactatgctatttgggcaacagtgagagatggattgttttcagtacatcagtcataagaggatatgagttccaactttattttaccttagtcttggcaaataagtgtggattgtgtctgtatttctcaaacttgtttaaggtagagctggactgggtgttaacagtgttagttcagtacagagacatgagcaaatcactcacttcctcttcaagataacactttaaaggtgacaccatttacagaagaaggcagtgatttaaatcagttatactagcatagtttagaatacttacactacctagatggagtagatacattctagaaatatttacctgttaaggacatttctttagattttattccatctttccattagttttctgatgaagagattatagtaaacctttaaaaattatatttgatcaaacttacagattgaggataaacctttaaaaattacagttggtcacacttacagattgagggtaaaaacattcctgacaaagctaggcgaagaaagttggacttttgatgttcccttcttttaaagttaacatctggcacttgaatagacttggttattactgatggggacaggcatccatttggaagtagcttccctctctctttcccaggttaggctgtcttactgctgtaaatggggagagacgagaaagctgtgggtggaagaaagtttgtttcatagcctggcgcagtggctcacgcctgtaatcccagcactttgggaggctgaggcgggcggatcacttgaggtcaggagttcaagaccagcctggccaacatggtgaaaccacatctctactaaaaatacaaaaactagcccggcagggtggcaggtgcctgtaatcccagctacttgggaggctgaggcaggagaatcgcttgaacccgggaggtggaggttgcaatgagccgagatcatgccactgtgctccagtctgggcgacagagcgagactccgtctgaaaaaaaaaaaaaaaaaggtttgtttcatgcatctgtcctcactggtcagtggaagaaagtttgtttcctgcgtttgtcctcatatttatagttttctcgtccacctacaagttgattgtgacgttatgaatagaagatgaatggataatgtgtttttgtcagaccttgctgtaaggatggacctggtactgaaataccgtgattgtatgaacatttgtgtggggcaatgctgtgttcagtgcctggggaatgtggatatcagtgtgtttgtatgatatgggtgctagtatgggagagaaggaaaacgtgtgaggtttttgaccatttatgtcactctgtaagctcttctctggctactttggtgctatagtagcagagttgagtagttacaacagagaccatgtgatctgcaaagcagaaaatatttactatctgggcttttacagaagtttgctgaccctttttctacataaccaactgcagttattcacaacaagaaagattaacgttaattctataatattattcaatacctattcaactttctctatttgtctcccaaatatcttttatagttgattaagaaaaattttggacagagtaaaattaaagttcactcagcacatcattatgtctctttagtctctattttttcattctttaattattcatatgtatagtttacattcactaaaattccgccattttagtgtaacattctctgagttttgacaggtgtatacattcatatatccactgctgcaaacaggacagtcccttcatcctccagaattcttctgagcccttttgtactcaaccggttctctacccccagactctggaaattgctgatctgttttctgtctccatggttttttgccttttcaagaatgttgtaaaaatggaatcacacggaatgtagcctttttattcatttgcccaatgactaatgatattaagtatcttttcatctgattatttgtcattctttgatgtcaattcaaaatcttttgcttaaaaaatgagtttttgtatatactttggaatcaaatacatgatttgcagatattttctcctagtctgtttttacttgtcttaataatgtctttttttgtttgtttgtttcgagatggagtttggctctgtcacctaggctggagtacagtggtgagatcttggctcactgcaacgtctgcctcctgggttcaagtgattctcctgccttaacctcccgagtagctgggattacaggcacacaccaccacacccagctaatttttgtattttagtagagatggggcttttccatgttggccaggctgatcttgaactcctaacctcaagtgatctgcctgcctcggcctcccaaagtgctgggattacaggcgcgagccactgtgtctggccttcttgtcttaataatgtcttttgaagagcagaagttcttaatttttatgatatccagtgtttttttgtttttttgttttttccctgagtggatcatgcttttggtataatagtttagaaatctttgcctaacttaagagctcaaagactttcccctatatttcctcctacaagttattatttttttttttagagatggagtctcactctgtcatccaggctggcgtgagtgagatcttgttcactggaatctccgcctcccgggttcaagtgattctcctgcctcagcctcctgagtagctgggattacaggcacccaccaccatgcctaatttttgtatttttactagtgatggggtttcaccatgttgaccagggtggtctgaactcctgacctcaagtgagccacccaccgcagcctcccaaagtgctgggattacaggcgtgagctattgtgcccggctcgcctagaagttttatcatttaaaattttatatttacatttattatctgctttgatttaattttcctaaatggtgcaaggtatgcattgagtttatttttttgtggatggatttacaatttttccagcaacagtttttgaaaagactgtcctttctctgttgattacctttgtgcctttttttttttgcaagttgatcataaatgtgtggttttgtttctggattctctctcctattccattgatctgtgtctttcatttctctatcacctcactgttgattactgtcaccttagagtaagttttaaaatcaggtagtgtgagttatcttattatttttcagaattgttttttgggtattttagttgcattgccttttgtgcatattttagattcatcttgctgttatccacaagtcctgctgggtttttctttttcttttttttcttttttaagatgaggtctcagccgggtgtggtggctcacgcctgtaatcctagcactttggaggctgaggcgggtggatcacctgagatcaggagttcgagaccagcctggctgacatggcaaaaccccgtctctactaaaaaatacaaaaaatagctgggcgtggtggtgggcgcctgtaatcccagctacttgggaggctgagacaggagaattgctttagcccgggagatggaggttacagtgagccgacattgcgccactttactccagcctgggtgatagaacgagagtccgtcttaaaaaaacaaaaaaagatagggtctcactcagttgtccagtgtggaatgcagtggtaggataaccactcactgcagccttgatctcctgggcccaagcgattctcccacgtcagcctcccaagtagttgggatcacagtcatgcactacctggctaatttttttatttttgtagagacagagtctctctatgttgcccaggctggcctcaaactcccgggatgaagtgatcctcccactgtggcctcccaaagtgtagggattacaggcatgacccaccatgcccagcctgctgtggtttttgattggcattgtgttgaagctggaaatcagttagggggcaattgacattttaataatgagccatgaacatggtatatctatttagaccttagatttttgattagtgttttgtagtttttagcaattggatcttgcatgtgttttgtaatcttatacatgtatttcatgtattctggtgttgttgtgaatgatacttctcaatttccagttgctcattgctggtatatagaaagatcattttatattatttgctgaccttggatcctacacccttgctaaactcatttttagtaatagaagctttttttgtagatttttggaattttctgcatagacattattgtcattggcaaataagggcagtttgatttcttcgttttcactttgtatactttcatttcctttttttttttttgagatagagactcgctctgtcacccaggctggagtgcagtggtgcgatctcagctcactgcaacctgtggccccccaggttcaagtgattctcgtgcctcagcctcctaagtagctgggattacaggtgcatgttgtcatgcccggctaatttttgtatttttttttttttaagtggagactgggtttcaccatgttggccaggctggtctcaaactcctgaccacaagtgatccgccagcctcagcctcccaaagtgctaggattacaggcgtgagctacagcgctgggcgtgatttctttttgttactttgctgaactatctaggaccctcagtgtaatgtgtaataggagttttacaagtggacatcctttcctttttcctgatgttagaggggaaaacactgagtgtttgaccattaatatgatggtagccataggtgtttgtttttgtagatgtcttttatcaagttgaggaaattgtcttctatgtttagtttgctgagagtttttatcatgaatagatattgaatgttgtcaaaggtttttctgtatttattgacataatcatatgttttttcttctttagtctggtgtaatacgttgaaatagctttgcattcttgtgataatactcatttagtcgtgatgtattattttttacatgtctttgggttccatttgctactgaatctttttttatttcttccatttgtttcccgttatgttcattttaaaaataggttcttgatcatatgtataatattcatgatagttgttgagtccttatctgttaaatgtcagatgtctccttgggggtaaagttatttcaaacacaagaaccattgctttaaagagtatcatactttgttttggcaagttaagttgccaaacttatgtgtgtaagttgcttgttacaccccattactaaggcatgaagctcctgtagttttcattgaagaattgggctctccttgaggactctattctggcagttgagaacacaaatgtctcccagccctgtgtgaactttggagatcatttagcttacagttcctgggtgattctttgcatgccctcatgtatttttacaatatgcatgcttggcttactactgggtgtgagactcatggggcctctatgctgatttctggagctcctttttcatacagctccctcctcttctctcgtactctgcaattttcaaactccttagccttcccaagctatgtttgttttctaaacttgacaaggctgtcatgttgtgcttgatcctcctcattgcaccatggtctagaaggtacctccagccagaaagctggggcgattttagggcttatctcatttgttcccttctctttgggactgcagttctgtgctacctgttgttcaggctctaaaggatgctgcctcatgcattttgtccacttttctagtagttagggaggatgccaggataaatctggatccagttactccgtcatggttagcagctgaagtcctttgggtgagtatgctttgttggtggttcttaaaatttcattacaggattctcaaaatctttgggggtataaataacaaagaagtatttgttgactatcttctgacagtagctcagccattgctttgtgggaaatacaaaacaatgtaggtatcttttagttgaagaggcacatggtacatacctaagattaatcaaagaaatgaattgctatggtgatgaacagaaagagaaggatcactataatctattattttctgtccccccgtgggggagtcttccagtgaaaagcagaaaacctgctagacagattctaaaagatctgtaacacttgtgatctggtgttttcatgtagaaatgcttgcttttgcgtttttgtttcttagcatatatgctttatgtcgcaagttgtagtgagtcagtgggtagagtgctggctctttcaggtgcatttgctatttatttactatgcagctttaggtaagttatttgtctctgaaatctaatcttctcttttctcttggcaaatggttatatgacataccttgtagggttgtttgttaattttttcaagtatcttttgtttgtcaggcacggttctaggtaatgggaattcagtgacatctgtagttgctgccgttaatctatatcctattgagggaagtagaaaataaacgagtgaacaaacaattgcagtcatgtctggtggtgatgattctaggaaggatatgaagagtattagcagagattggggaggtcagacaaggccttactgaggaggtgagatttgaacagacctgaagaaagtcaagggagcaagtcacatgaagattcagaggaagtatggaaggaacatcaagtgcaaaggacctgagatgggagaatgaacagggagcctggtgtggctggaatgggtgagaaagagcgtgaggagataaggtttgtatgtgtagccagagaccagatcaaataggctcttaggtatggtgggaaacagctgaaggatttgagcaaggcatgacaaggttgatttaggctttaaaaactttactcttggcatagggagcagtagtggaaacggagagactagttaagagatttgcagtcgttcaggctagagaagatggtggcttggattagggtggtagcagcgaaagtggtgagaagcggtttgaatccatatacgctgaaaatagaactataggattacttacagattggaaaaaggttctaaaggaaagaaagaaattaaggaggattcctaggtgttttacctgaacaactgggtaaatggggaagatgtggaatcagtttgctgagaggttgaaattgtgatttccctgttgacatgctaagtttgagatctgtgaaatttttaagtgaaggtatcagtaagcatttggatatacagttctggagttcagtgatggtctggactgggtgtatgaattagagaattgtagatagagaagggagagtgggaggttttagtgggaattagggatatataaagctccataataggggctcatggcatagtagttaataatcatgacagtcataaaacaaccaccactatgtatagtaactaaaggaaggctagatatgaatgaaggaagatggtagtgacctaaaacaattatcttgcatattatatcagaattagttaggattctaaacatgctgaaaacttttcttctctaagcatgataaaaatattagtgaactctattttccatttgtagtctgtaaggatattggtgatagtggaaagataatgacgtttttatgtgatgctagtgtattatttgaatgtacttcacatacacatatacgaagatagtctggaaggaggctactgcaaagtagatgagggtaacttttgatcttttgattttctgcagagtgtatatttgtctttattcttttcttttcttttttttttttttttaagacagggtctcactcctttgaccaggctggagtgcagtggcgcgatctcggctcactgcaacctctcccttctgggctcaagtgagtctcccaccttagcctccccagcagctgggaccaccggtgtgcaccaccacgtccagctaatttttgtactttttgtagaggtggtgttttgccaggttgtccaggctgttcctgaactcttagactcaagcgatccacccaccttggcctcccaaagtgctgggatcataggtgtgagctattgcacctggcctccttattctttttttttgagacagagtcttgctttgtcacccaggctggagtgcagcggtgcgatctcggctcactgcaacctccgtctcccaggttcaagcaattctcctgcctcagcctcccgagtagctgggactgtaggcatgtgccaccatacctggctaatttttgtatttttagtagagatgaggtttcaccatgttggccaggctgttcttgaactcctgacctcgtgatccacccacctccgcttcccaaagtgctgggattacaggcgtgagtcaccatgcccggctctattcttattcttaataaaaggagttaataatattttttgaggttgggctcagttggtgagtttctagggtagtgggtttcatttgtttgtggttgctgatattacttattccatttttttttttactatgtatagtctattgtcttaaaaatgtgagcccttaataatttttttttttttttttttttgagatggagtctcgctctgtcgccaaggctggagtgcagtggcgctatctcggctcactgcaacctctgcctcccaggttcaagtgattctcctgcctcagcctcctgagtagctgggactacaggcgtgcaccaccacgcccggctaatttttgtatttttagtagagacagggtttcaccatgttggccagtatggtcttgatctcctgaccttgcgatccacccgccttggcctcccaaagtgctgggattacagaataatcttaatcgtaaatgggaatcagttaagagtattttctttcttttttttgttaagaaatgaggttttgccgtgttgcctaggctggacttgaactcttgggtttaagtggtcctcccactccagccttcctagttgctgtgactataggcacacgccactgcacctggctctgggtggttttgaaatgagtccataacagttcctggaaaaattgttagcacatactcttcccaccaggctaatcgtggcaccattttgttgaaagggtactttatgttgcactgtggtgggcagatctcttcagaataattgaactgagcatgaagttgttttgttttaaaatctgaattacaccatcagcattaacttagatttttagaagtatcctttttcccaggtgatagctgtcctaaaggtggtggatatgacaggggcttttgacaaatttggcattttcagtaattcatgaatcacttctaaaaacatactcagtgatttgggtggtatctgtaaattaatctatcatccttgtcttggcatttgagttctgccttgtctaagtgggtgtgtttctggagtgggagaagggaggtccgttgtgacattgcatggaaataatttcttttacctttaacaagctggaagaaaatggtttttggatgctttgtacacagagtgtacatcctcttggatgctttgtacacagagcggctgggctcagaatagaaaggaactatagatgagactttgcagtttgggagttatttggggaaaaaatacggtaacaagagttgggaagtagagttctaagtgttcatttgatcacatgaagccttgggggctggctgaggtgcttcctctcttcagggattaaaggcatgcatgggtcagtgggcagtaatagccaaagcttttgcttgggcattcctgccaaaatagtgctgtgtgtatgtttagagcatagaatagtgtgtatgtccagtctagagaggttttttgaggtcattttctataaggtgtttttgaaaaagtaaagttactataaagggaagaagaaacttttgtgtgtttacctacgtgttatgttatctacattctcttaattccttacagtaatcctataagacagatattattctttctcccttttttgatgaaaaaactagggtttagagatttaagtttgcttctctcaagtcaatgaactacaattttgatctgggacattgtgactacaaacataactctagttttattatatatgccataagtcacatttttttcactttgatgtaattatatccaaagtagctagtttaaaattccatcttgttcttggtgtaaatagaaaatcattgattgtggtctgctcttaaagttttcctagaattcttaaaaacatgctaggcttccatgtttgtgccttgaaagtagcagaaacttgccaatagaattgtggaactgtattttccttcacatacagaagctttgtggatggacattaataattaacatttacacatttgttcacatcttcaaagtgttttacaaacatttaattagttcatgtgtaaactatataggaagttgaaaaaccagttttttaggttcattttagtagtactgaagtgttagggggagaaggagtaagcaagccctcagtaagaaaaatacaggtatgcaccatgaagttctaaacatcttttcttacctgcctagctttcagcccagtttggctcatatcaaacatgttttttgggtgtatatcttctctgtaatacaggggagtggattatgtggacccaacagaagacagggtggaatggttggggaaagacctgggtcatgtaatgcaactttctcttccgtagtcccttaaatgtgaattgtccttgattcatccctttgagcattttgaaggccaggatgttgttggagcagagactctggcaaatgaatggagcatgcatgttaatttctagggaaaaaatcttttatttttcactcttgatttaggaaataatagctctataactagatactttgctagtttcctcacaactgcttgtcacctgattccatctcctctcctcccaccccctggtaaaatggctttaacttggcaaggtttgtagttggaaggagacagtagtcccaatttagctgggttctgtcacataattgactgtgtgaccttgagcaggtaggttactgctcttttgcctttgagttcttttgttctgtgaaatggtatttgctgactcacctttcactgagtcctagaaggatggccagagaaagatataaaacttagactcttggacatgaaatgggacagaggttattttcacattagtgaggattcttcagagttgcaacgactcctttctactttgcttggagtaactaattttcttactattcttgtcaacctcattactataaacactttttctaatacagtacagtaaatagaattatttgataaatagtgtgtctgggtaatttcctaagacaggacatgcaagttccttttaatcagtgcttatagcccattgttcagaggaaccgttcattgttcagaagaatctttgtgtagataaccttgccagagaaaccttacttagtatgtgatctcagaaaggagaagaattctgatagcttggcatgtatatttaattaaatttttataatgaatgagaatctgttcttttaatggggctgtataagaatggccctgaacttttgcctctatccaatagtgttgtttttcaagtctttctttttttctccatccctttccttctcttcttgaaatctgaaaatttaaaggtgggatgagttggctgtggctgttgaacctctttgtaacatgaaatacacccaggtttaaacttatctttctgttctgccaagatttatggtaacttggaaggaatattttacagccggacattgagtaatactatatatgaattatgaataattgagattggcttagttaagcggttaaagttactcttttatttgaaaggatatctgaaggcagtgtttatttatctttttgaaaagggagacttttcgataggacagattgtatgtataagacaagatagaagttttcttttggaaacctagctggtttccaaacaatccaataaatgattgtttttcctatttagattagggatttgagttgtactgtttttggttacctctttgatttttccgtattgtctttgcccagtgttcatttcctttccccggttaatctagtaggatgtactgtcagattgcccactgaatagatggggtaatgtaatatcacatgtctatctttcctcccagattataaacttcttgagggcaaattttatctgctttgtttattgctgtatccccagcaacaatggcacataatagttgcttctcaagaaatatatgggttgatggaaggatgaatgaatttttgactatacatacatacacacacacacacacacacacatacatatgcacacataacatacatgtatatattaaacttaataaaatctatcctgttgcgaataaatgaacagatgtttattttttcttttctagcatcagttttagtttgattttggtcagtttaaagcattccttttggggaaagagaagacatcatgttaaatggaagtttggtattgaccaagtttggtggtaaaatctatacagctcttgcctgatggttgtgcttggtccacgtagggctctgtcactttccgttttaacctcttcagcaacttcatcattggcatatggatggttgacctaagaatgtggtgcgtgatggctggcttaattaaaaaacaaaattatgattgtaaaacatgttcacagtagaacggtagaattgactcatatactcattacccagattctagcaagattttgctattctctacatgcattattttaaaaaaagctttgttttgatataattcatataccataaaattcacccatgctttactataatatgtttgtcctagttgtcctgaaagtcactacgaactattctttttagtgatttttaaatggtatttttactccaatgtataatactgtaaaccatgaaatgcctctgtaaaacaaggcacgataggtttccaggatatgaaacagacaactttaactcaaagcaaatgagtgctgagtagcctgttttcctttcagcagagtaattgcagaaataggactgcaaaccttttattaagcacttttatatgaaatttgaggtttctgtcaaattagacatggaaaattaaagctgcacaaattactgatctgtgcagtttttttgagtcctctcgtatgttagactttttttttttttttttttttaagataactgtttctcttaagtaccagcacaggaatgctatgatttatacataattatttttgttttcacgtcagtagtcttttgttccccccattgaatttggtgattcccccccgccccccgaggattattttttaaataatgcattcccaagtattttgacttttgtgaaagaaaatactttttaaggtaattgaatacctccataaatcttgtatttccttaataatttatttggcaatgtatttaaaaacagtgttgatatcttaaaagctttcatttgaaggcccaaaaacaactgatacattgtttttcatagcactttttgtaaatattatgtcctaagtgcatagattctttgaaatactcctctttcaccccctctgtggtaaagaattattttggctgctttgccaaaagtgcttgtggcagtctaaagatgatcactttattagttagctcactgggatatgtgcccataaatggagagttttctttcccgagctcaaataaaggtaatggttcatctgtgagatacctcgggactcaaatactaattcagaagaaaaattatatttattctctcccctcagccttgatgcatgttgaaatctgcggggacaagttcactaatataatagctgtcacttattgggaaccattattgatctattggtagctattcatctaagtgtcttatataggtcaggtcttatctctgcaaggaaggtatttttatgattttaccagaaaaggaaattgaagctcagagaaattaatagctaattttatatatacttcattcagcattttatttaaggcctgttgtatgtcaggcacactactgggcaccagggattgaggaataaacaaaataagatgtagtcactgcccttaaagcactcatgattttgtttcttgattgataggcagtaacaataatagtgataattgccatcatttattattactttccatttgccaagtgtagtagtaagtactctacaaacccttgtctcattttaatcctcataattctaatcctcacaaaatgtggaagtatccatattttatggatgaggagacagaggcccagagaggctggacttgctcagggtcacacagttagtatgtggctgagttcatacttgaacatggatcttactctagaacttatactctgctcagcattcctcattctggcgagagttgaaacgagtaatgatgtgaaagggacatcattgtgagctattattttggcagaactttatgtaactttgactttgccagtagatttatttttatggttaatctcttattctaggagtcatcagatcgttttcatgatttatgaaagacatttttaataagtcttatttttattacaacagtaatgtacagttcctctagaaatttaggaactatagtcccccaaaagtacacataaatgacactacctagagaaaattgttgggtataatttttctttccaaacttgaaaacttgtagagagagagtgtgtgtatgtacatatatacagcccatatgtggactagccatatgtggcgtattttatgtactcttgagcataaacaggttataaaacatttcatcaatgtacctttatatgatttcttttttgttgttgttgagacagagtctcactctgtcgcccaggccagagtgcagtggcgcaatctctactcagtgcaacctctgcctcccaggttcaagcaactctcctgcctcagcctcccgagtagctgggattacaggcacatgccaccacgcccggctaatttttggatttttagtagagatggggtttcaccatgttggccaggctggtcttgaactcctgacctcaagtgatccacgtgtttccgccagccacctttatatgatttcaagtaactgacatagttattttaatggctatatagtatttccttgtatgaacttaagtttatcttcagttcatttcctattatttgaataggttgtgtatcttttttccccatcacccttcctcctgcctctttcctctatgctattataaacattgctttgaaggacagccttatacatacatctgtgtgtccttgtttactttgttagagaaatggaattgttagggcaaatggtgtacatttcagcagctgttcatagatattgtcaagttgtctacagaaagcttttgtcatttatacttctactggcagaatatgacagttcctatttactatttccccataacttttagaaaacacgtttttaaagttttagatgcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaataaaaaaataaaaaaataaataaataaataaataaagttttagatgccataagataattactcatagaattactggattactggcaaccaaagaaaaaatgaaagaactctgtatttctaaaaggatatgaagaaactcacgaagcatcgttactgtcctcttaggtgctaaacgttaatctgagttctcaatattaaaagacagatggaggaaactttcaaataaagtcactgatatcatgttcctttggcttgttcttagttgtcggttcagattaactccagcaataaaacagggaagtatttgagataagatttagagatgctgaggagtaaggtcctcttctacacaaagagccctgtgaaagatgatctgtggccattctgttgcttatctaaatgcatgttagaattaatataacttatttatttatttatttcattattattttttctagagatggtgtctcgctgtgttgaccaggctggtctcctcaaactcttggcctcaagtgatcctcccacctgggcttcccaaagtgctgggattacaggcatgagccactgcgcctgactgttaaagcttttagttctgggccaggctcagtggctcacacttataatctcagcattttgagaggttgaggtgggaggatagcttgaagtcaggaggccaggagttcaggaccagcctgggcaacatagtgagagcctgtctctacaaaataaaaattaaaaaattagctgggtggtgatgcatgcctatagttgtagctacctgagaggctgaggcggaaggatcacttgagtccatgagttagaggttacagtgagctatgatcacactgcctttactccagcctgggtgacaaagcaagatcctgtctctaaaaaaaaaattaaaaaacaaaatttagttctgaaagtacaaatacgtataatccacatatgttcctcaaatcacagttacatattgacatcatggtttagataatcaagaaaacaagcaaattaaacattgaaactgtgttcttgactttaatgtaggcaaacctttttctctgagccaaagattagtcaactggtctcagctataataatgattttcaatcataatatttgtgaaggttttctgtattataagtaggaagaactagttgtataggaagttgtaagtcaggtagctgtgtaaggtgatctcttggcactgttgatacaccagcttgtctctgttttgttgaccattcttaggagtatcttgttgatattcagcctatttctggttacagagaaatagctgattaatcataatttagtagccatatatatatatatgtatatatatatatatattttttttttttaaacagagtatgttgctcaggctggggtgcagtggcacaatcttggcttactgcaacctccgcctcccggattcaagcgattctcctgcctcaacctcccaagtagctgggatcacatgtgtgtgtcaccatgcctggcttattttcatatttttattggagattgggttttaccatgttcgtcaagctgatctcaaactcctgacctcaggtgatccacctgccttggcctctcaaagtgctgggattatagacacgagccactgtgcccggcatattatatcactagatgtagaaatttaatttatgatggttctataataaagtcttggaacatgtagatagttaattcagatgtgggagggcttctgtggtcttgaaaccacccagttttttatgtagtatacctgattattgaactgttagtttcgttatgaagtctagatgttacttggttttggtaaggaaccctatgtagaattttgaggacgtctcctctgccaacctgaattgatcagaatttttatagacctcccaaaggacctctgttttggaaatcttttggggcaaggccagctttgatttgttttctctgttacaacagcattatttgggcttaaatctcagaagtgtgccattctgcttttttactgtttcctccccctggtaacttgagctattataaactgtttaccaaagaagctagtcatttttgtctcagtattctcttaaactgtccctttgaggttgtaaaaaagagagtaataacaattagcaggtcaaccaacaaataggaccttggtatctcacatttcagaggattcttccttaggtctccctactttctttcctgtcttagggatctgggataaacaattagcttggtaaatcagtggtaggaattaaatgtttctgtgcagtttttctgggacataggacaataataatggggaacaaaataataagagaatgagtaacaagacagtagtaataagaatgccagattaaaaataggaagatggaaactcactgactggtagaaatgtaaaggataaattctgatgtaaaacattctgtagctgagaaaaacttgttagtgaacagacactggattaggattcaataaatttggtttagtttgctgccaacaaccttgggcaagttgcttagcccactccacctcaattctcccatcaaaaatgaaacggttaaactgtatcaggtttttgtttggttctttgttgtgttttccccaaaaagtatcctcaagtcctggagatccttggaattacatcaagggcccaagtgagattggggagggcatgaaaaagagagcaagtggtgctacacagagtagttccactttcctctagtttatttttgtgtttcctgtaatgtttccttcgaagacacttccatggccaaaaaatcagtttggaaacatctggactgaaatatgttgaaagtgccttctggtgcctaggatttggtgtttatgaatctccatctgttggctggatgtctttgttcttggtataagtctttcatggttagggaaattttactggctgaatcatgaaggaactgtataatacaatgggggatcgtggtatctgactgctaggctgtgctctgatgttaactgcccatgagatagttctcaactaagcaattagaaattaaaatactttttagctctccgggagcttgggaaatcctgataaaaagatgcaaagaatcatactccttgcttatcaaaacctatttatgctagctgccattttttttttcgagcacttactttgtagcattttatctgtatgtctcacttaaccctggggtggtcttgtgaagtagctggagttagctctgccgtaaatggtagttgaggcttactaagattgtgtagcttggctaaactcccacagccagaagtgcaagagctggggattgaaactaggattgtgtttctaaaatgtgtgcattctttattatgttcacctgcctttcttaaagttacaggagttttgtagctgtgagacgtttttaatagcaccgctgttactcatgtttttcattaatgaaatctggtaataaaagtgattagcaacgttcattgttcttaactgcttgttatgccaaggactcttaatagtagggcagaaatgatttgattatattgtatataccattccttatctgttaggtcctcataaataaggaaaaaatgagaaatttgtaagattagagcagaatgaaataagctatgttttctttaatggttggaaattattcctaaaagaataatagatatgaaaaaaatctaaaataggtgatgctaaattctttagagtcagtgaacatacagagattagattgttttatgatcagtgtggtgctaactttgatgccctaagaatggatttaccatggtggtacctaatgcaaggaaattgggcatttttttcttcacaacataatttattgctggacactgtaaaaatatcaaaacgtggtgggcattagtgccactcactacaatttctagttctcctttttgcatgtggaatatcacatttcccagcctatttcaagatggcatggtcttgtgacttgctgtgtcccatggaaatgtgtcgcttttggctagaagcatttaaaagctgatgtgaggtcgggcgcagtggctcatgcctgtaatcccagccctttgggaagctgaggtgggtggatcacctgaggtcaggagttcgagatcagcctgatcaacatagtgaaaccttgtctttactaaaaatacaaaaattagccgggcgtggtggcgcatgtctgtaatcccagctacttggaaggctgaggcaggagaatcgcttgaacccgggaggtggttcaagcgattctcagtgagcctagaccacaccatcgcatgccatcctgggcaacaagagcaaaactcctctcaaaaaaaaaaaaaaaaaatctgacgtgaaatgctctctctctttccttgcttttgggacctggaagcacaagtagctatgacagtaccacatgatgaaatcaggttggaatactgccctgaggcttgaaggattgctgccccagagagttgcctggagccatagtgatctttgagtgagtgaggagtaaacttcattgtgttaacttctgataccttctggttgttgttaccatagtataatctagcttatcctgactttactacacacatcatcagaaatcattagtgtaaaagatttttaaggagagggactgaccaagattgaagcataattacctcagatgcagataaggtcaatagcatagttaagggcaggttttctcttttagctgtcacctgttttatgttttgtcagtttattcttcttttagctcagttttggtcgtatcactgccccatttaaaaatagtagttcctcattgcccaccgaataaaatctgagtaaggcctgccacagtttggttctgcaacaacacgctttaaaaactgttctctcactgtggtgaagtatttatttatcatcatgtgcctttgcccattcatgcatttgagaaacatatattgattactttgtgtgccaatgtggaggctagaccctagggacacacaaaatgttccttcccatctgttcatgtccaattctgccttagcttttcaagctaagtcttgaaggatgtttcctacataaaccctgcttcattctcacagttggttataagctgtctttctgacctctcaagcatttctggcacactgtttcctatcctggttgtaaagttgtacttgtatatctcattccctttactgggctagtgtcacacctttgtatctttagtacctagctcccagcttatggtaggggctcagtaatctttactgaatgaatggctgttagattgtggctgtgttgaaaagccaatgattaatttgcctttgtttgacaaattgttactatctttaaagttattttgccttcgttgcttgcacttacctccttctagctattatcattgtgtgtgttcattcttagtactcagtagggccttatgtagcagtggttgtgtttttttctttttttataagctatctggaatgctgtatcctagcacattctggtgagctttccttaccattgtttaaagtctgttttgtgttttaaagatccattgtgaagtttcttaatgtgacttctaagtctagagcttatgaatagatgagtcatgtgttttaatcgattcagacttagttttgtcttggtgtcttgttgtttctactgatgttttcctgaaagatttgtgcctttgaatctgtgttctgaacttatactctggtttctcttcgtatggtgttagtctttccccttttactaaagagctttgaactgggtagtttaaaagacccagattctagtttagtttggcttctagctcactttgttaactttggttgtgaagtttgtatccacgaaacaaatgagtttgacaaaaatccatgattcacatactgattttactatggaccgggtaagttatttgaattctaatcttgtgtggatacaaaaattggagacaaaattctggtagggttggcaaaggttgaaggaaactttatttatttattgagtgcttactatgtgctagatgctgtttatttgccttattcactaacctgtgaagattttatctctgtgttttagttacagaaatatgagatacaaagaagctaggatacttattgagctagtaagggcaggatccagaacttcggccaaagtcaatttcattccaaagccagtgttctttttgttgcagtttgcaagccgttccagacttctctaacggagtagcctttaggacaaatgataggtgttgtatgtgtctcttgaagaaagtactctctgttgcatgtcatactactggtagaatacctgccctcaccccccaccctcttttttttgagacagagtcttgccccatcgccaaggctgttagagtacactggtgatcacagctcaccacaaccttgaactcctgggctcaagcagacctgctgcttcagcttcttgagtagctgcatctacaggcatgtgccaccatgcccaactaactttgtaatttttattttgtagagacagggtctcactatgttgcccaggctggtttcaaactcctggcctcaagcgatcctcctgccttggcgtcccaaagtgctgggattataggtgtaagccactgagccagaccaaaatgctcttaagatacaaaaactagagtggataaataaactatttctctggatctttgattaagactgcacaccccacggtagtgcagttatttccattgtgcctgtaagtgtgctttaccatcctgagtgaagagtgaagggaccatgattaaaattcccatgacattgtatggttttatgattgtggtttcaagtcttgctctctctcaactaatttttgtgaccttagactagaaaatagtttttttttttgttttttttttggagctgcagttccactgtgtgtaagatgggaaaaacagtacctattttatataccatattgctcgttgctggacacatatgtgtccagcaagcatttattttttgtctgtggttgtacctataattggggagaattttttttctttaagtgtagatcaattatggtataggacattggaaggtagaagaagaggtactatatacagcagttactgacctttccagtctgaattcctatttagaaataaactacttatgttatttgtgttactgttttaggagacatgaattggctaataagttgtttgcagtgttgtttctttgctaatttttgtaaatgtaattagatttcataacattttgtgttaggagaacatagacactttgagagaaaaatgcataataaaagctaatttgatggtttctaggggtagttctattttgaaattcctttcagcagacaatatgagacagcatattatgggctaggccctgaaagaaccaagggagagtaaagcacagtcctaggccacaaagagtatgtctctggaggataagatctctggattttttgtcctacttacaaaacagaaataatatattttatgctagttacaagtagtataagctcattgaagaaatatttaagcagaaggaatgtgcaccagccactaggaatgcaaagataattggggtatagtgagagatatggaaatttgttgtgtaacaatgttagagtaccaactttgtggtatacaggcttctaaggaacacagatgagggatgagggatgggacgggtgtgctgggtctttttttttttttttgggacggagtcttgctctgtcacccaggctggaatgcagtggtgcgatctgggctcactgcaacctccgcctcctgggttcaagagattctcctgtttcagcttcccgagtggctgagactacaggcatgcgctgccatgcctggctaatttttttaaaattttttttatttttagtagagacagggtttcaccatgttggccaggctgttcttcaactcctgacctcaggtgatctgtctgccttggcctcccaaagtgctgggattataggcatgagccatcgtgcccggcctgtgctgggtcttaaagcatgagtaggaatttgccaggcctgggttgaggagagaaagaatggaatgatggttctgctgtgatacactgtgtgcaaagaaacagacgtcaaagagcttggtgtgtttgaactcagtgagcagtgaggtgtagaattatttcgtgtggatagggtgtggtcaccgaattaggttagaaagtcaaaatggggtgggtggaagcgtcttttagtttgtcctcttgaagcaaaagggaggatagtctggttttgttttggatacctcattctgtgagcagtagaggatagtggcttggcagagggagaagggagcattgcctctcagacaagttagaggaggccattaccatagttttggacagattgtgagggcttgaatgcagtgaggttggaagggagccagcagatctaatggacattttgaaagttgaatggatgaaacttgttgagtagatggtgggaattaggaggtggtagttgtccagaataactgggaatttctagcacaggctgctgggtgaatgagagtgcactgaggggcatgattcattctggcatgggagaggagttggcttcctggaagtggtaatgtttacatttggcttagattacctcattcaaagtggttcttgattttgcccacaatctattttagagtccatttattcatctagaaagtaccaactgcttactgcatgccagtaattgatattttaagaatattaaaaaatgttaattgtggtaaacacacataccataaaatttaccatcttaaccatttaccgtcttaatcatttttaagtgcagaggcagtggcatttagctctttcacattgtcgtgcagtcatcaccactgtccatttccatgactcttttcatgttgcggaacggaaattttgtacccatgaaacaataactttctatttctctctcctccgtgtccctggcaaatacttttctacttcctgtttctatggatttgactattctgggtactatatgtaaatgataccacacagtctgcgttcttgtgactggcttacttcacttagcacaatgtcattagaattcatccatgtggtagcatgtgtcagaatgtatttcctttttaaggcagaataatattccattgtatgtatataccacattttgtttatccattcatccaccaatggacactagagttgtttccacatatgggttattgtgaataatgttgctttgaccatgggtgtacagacatctttcgaagtccctgctttcagttctttggcgtatgtacccagaggtggacttgctggatcatatggtaattctatttttaattttttgaggagctgccatactgttttccatagtggctgtaccattttacatttctaacagcagtgcacaagtgttccagtttctctgtaccctcaccaacacttgttattttctgtttttgtgacagtagtcatcttatagtgtgtgaagtgatatctcattgtggttttgatttgcatttttctagtagttagtgatgtgagcatctttttatgtggttattggctatttgtatatcttttttggagaaatatttgttcaaatcctttgcctgtttttcatttttattttattttaatttaattatttttttgagatggagtttcactcgtcgcctagcctggagtgcataggcacgatctctgctcactggaacctctgcctcccaggttcaagcgattctcctgcctcagcctcctgagtagctgggatgaaagagtgcaccaccacacccagctaattttttgtatttttagtggagacagggtttcatcatgttgtctaggctggtctcgaactcttgacctcaggtgatctgcctgcctcggcctcccaaagtgctgggattacaggtatgagccaccctatcaggtccattaccctttttttaaattggttgtaggaattatttatgtattctaaatattaatctcttattaaataagagttgctagaattttctcccattctgtgggttgccttttcactctgttgattatattctttgatgcagctagtagtagttttttttttttttttttgagacagagtctcgctttgtctgtcgcccaggctggagtgcagcggtgcgatctcggctcactgcaagctccgcctcctgggtacacgccattctcctgcgtcagcctcccgagtagctgggactgcaggcgcccaccaccacaccctgctaattttcttgtatttttagtagagacggggtttcaccgtgttagccaggatggtctctatatcctgacctcatgatccgtccgcctcggcctcccaaagtgctgggattacaggcgtgagacaccgcgcctggcctgatgcagctagtagttttttaatgaaccttaaattataagggaggttgttgcttttatagtaactttactgagctcaaatgaagaaattagtttcctccattttcctttagaggagtatgatataattttataatttgaaaaagggttggtattcactttttctggaattttcctttctaggtatgatttatgacctagtatcttttgagtaatgtctccttcctttctttttcatggccctcaggtgtggttattagaataagcatcatgaccatgacttccccgggctggtcgctcatcaccagctgtccagttagaagcaagtctggtcatacctgcttttgtgtaccatgtcttacagtagtagttgtcttggggctgtctccctactcatgcccttcttgtcgactttcacctgggtcatgagaatggcttcaaaataggtcttctgcttcagatttctcttaattttcctgtacactgtttggactggcctttccaaaacacctttcaggggctttgtgatgctttcaggatcaagttcagacactaagcttggcagtccaactccttctaccttgaccttaacccccctttgcagttattttcttccctggtcattagtatattggcagtgtcagtcaaggcattttatcttccttggactggggtaagatgcttgataggtgggccatttctcttctgcgactctcagatttaccatctgtcacctggacgtgcttgtgctgtgctctctgcttggaatgctgtcacctcttcaccttgcctggtttttcagggcctaactcaaatccctttcctccttgaatccttctctagctggtccagcccatagagatcattttccgttctcagaatgattatggcatttattttctgtgctgtttcattgggcaattgattgtaaatggctctgtattgtgttagctttttgtgtgtttttaagaaaatgttctgtcccctttagttccttgtagtagtaatcatgacttgtactctatacaggttctacacacgtaggtaattgatggatcttcattgatcctataacattggttctccaagtgtagtcagtagaccattgaacattcctgagactctttcagtgagtctgtgaggtcaacacatgaaaacattatttacctttttatagtgtgcagacatttgacctgatagtgcatagtgcaaaagcaacaatgggtgaagctgccgatgccttagaatcaatcacgacagtgaactaaactgagctccagtagtcacggtattcattacagtcatgtactgtgagtgagaaataatgccagttccacttaatgtctgtgatgaagtagtgaacattattacttttattaaatctcaacctttgagcacacatttaaaaatgtgggaagaaaagggaaatatgcgcaaaggagttctgcacgtggaagtattgtggttatcttgaggtaaagctctcgtgtgatggacattaaggtgaactaactgcttttttttttgagatggagtcttgctccgtcccccaggctggagtgtagtggcacgatctcggctcactgcaagctccgcttcccgggttcacgccattctcctgcctcagcctcctgagtagctgggactacaggcgcccaccaccacgcccggctaattttttgtatctttcgtagagacagggtttcaccgtgttacccagggtggtctcgatctcttgacctcgtgatccgcctgcctcggcctcctgaagtgctgggattacaggcgtgagccaccgcgcccggccaactaactgcttttttaaatgaaactccatttttatttgaagggaggactttgataagctgtggttatccagaaattggttatttggcagataccttcttgaaaataaagcaagcctttacttcaaggaagtagtggagtctttgttgccagtgataaaatttgagtttgcaagtgaaaatcagaagtttggaaaatatgtattcgccaccatgagcttgacagcttttcagtatttaaaagctttatgagtaaagtaatgatattaacaaatgtgatttttgatattgtataatgaaatgtatctacatttggaagatctgcataactcaaggaaccagtattttcacaaatgatcaatgtatgatgttacagcaaaaatcatgcttgggtaaacgattcattcaaagtgaaagaccagtcacttttaatgtaacagagtacaaaacggtcattgatacagtttcagatttcacattgtgactaactctttaagaagctaccacttgtcaagttttggtgtaacatggaaaaagaatattaacaactatcccaaaagactattaaaatactactcctttttcaaattgggtatctatttgaggcaaaattttaaaaatgtacttccccaaacagtgtaaccgtttgaatgcagaagcagataggagaatccagctgtcttctattaagccagacattaaagagatttgccaaaatgtaaaacagtgccacgttcttatttttgttttgttttggaaaacatagttatttttcataaaagtatgtttatttgtaatgagttcatggaattttaaaatgaagtaatattttataaatttttcagttttaatttctaatacaataaagtaccaataaatataacccacataacaaaagctctttgggattctcagtttttaagagtaaaaaggagggagctcaggcaaccaagaactttcaaaccactgattatagcttacaatggattgaaataagctgatcctcatgaaatactttagtttcttatttgaaaatctttatagaaacaacacagaggaaaataattagtatctgctttcataatgctgagttatatttattgggcacttaatatgtgcctgacactgcactgaacaccgtacctatattatctcctctaacctttatcttatcctgcaacgtatatattaccttagttttacaaatcagggggctaaggcactggcgggtcaagtaattggcccaagcttatttaagaggtaagtagtagagctaagttttagacttagtttaagttgaaattgaaagcctgcgcttttcatcaggatgttctgctgcctcacagaaaagtttgtaagtcggcactgtgtccgcactgctaattgatccttagggaaaagtgcagaatgctgttgtctgaagattgttgatgcaaggttgagcagtggctgaagatcctgcgcatgttttctttttatcccaggtcacgtagtcttgtactgttttgtggagctggatctttagaaggtggttctttcagaacttcagaacagaccgtaactggaagactgtgggcttagtttcttatggttactagtagttagtatgtgaatctagctcaaggttggagagatttttcaggatggctgtagttcagttgtcgttgcttatgctagttctttcatttcattcaggggtatagaaactttagattgtctgaaaatgttattttcaggagttttcccattgggagacaaggaagtggggatggagttgaagtcaggtgaaggtgaagagaatagcaccattgccctgacccctggcttttgggttattgtgctgcaagcatcaggtgactgaaaaagcaaacatgaaagtagagattcagagaggggaagtgactcaacccaggcaccctgcacaggaacatgtgtcatcacggtttcagctccggacggtgagatcgcagtgtgttctcaggcccttgttaggattcttagcacaatagttgtttctgcttggtgggtttgttgattgagagcgcctcagaagcatttatattcacagtatcccacgtgccctactaactcaactttatattacatagacagctactttaaaattgtcttggtacatgtattttgaaatttatatgaacagctttatttacattatccattatactcctctattaaagaatatatgtatattttaattatacttttttatactcattcaactttcattgttttctccaaccttttttaccacctcagtggaaatggaaatgagagtacctgttatagcctgaaaagcagaggaaaaaaggtgtaactctttttaaggtttttcgtcatgtttaacttatgtgttattcccagatttttctccgatgttcatactgtctcttgaaaccagtcttcctttttttcagcactattgtggcctgtgtataattggtacttgtctttcagatttgtattctgtaaacaggctttgacggggcaaatttaaactgttgtaaagattgcctattcatttctaatacatgttttgtggtagaattgaattgctgattgtgtgaagggtttttgaaaatgagggacaaacaaaatgagaacttatgaatagtagcacagtaaaaaaaaatccaagaggaataagaccaccgtgctttcttttttcacttctgaactagtcaatagctttgtattctggtgataattaacaaggtttctatacatacacaaaaatgaggggtagtgagatttagatgatgatatagagaatgaagatgggaaaaaatcctcttggtattaatacatatggtataggtacagagtgttcctttatgtgtataatttgaaaagggtgagggagctccaaaataagataaggaagttggtagactacatgttttgttaattcttatgttagagtgccttctcctggtgtggatgcatttctaagatgaatagttaatttgttcttgtttctttttcaaagtctctttgagcaaatgacaaattgagatgtcctagctttaaggagagaccattgacatttgcctaatgccttctcttgtcttaggctttgccttgtattaaagaagtatatgactggatgtgactaaaatggtctgggaggagggttagtattctgttttctaaaatggattctgggattgttatatgcaattggtgctttaggatgggagaaaatcacctaagtgtaacttcagaatgtgagaaagtgtgacctgtcaactgttttggttgggttttctatgttggagtggtttgtttcttaaattttgctctcaggtttggggtggtagtgaagttactctgaaaattcataatttttctataattagtaacagcatcccaggagtttcagagggaaatacctttaaaaaaaaatgagatgtgacagcacgctgccacgccgacgcagaccccgctctgcacgccagctcgcccgcacccctcatggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaagtttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaatgagatgtgtatattgatgattatcttttaaaaaataatgggaggtttatgagagagctggtgcacttaaagcctggtggttcagtacgcataacccctagagctcagttttcatggatcaaggcagatttgtaaatagaagaataatgagtcagtatggtaaatgtcaatgggaagattcgaatgaagtgagatgggagcacagaaggatggagcaactatatttgctttgaggagtcaaggagggaaggacattctaaaattttgagagcattaaagaataggttactcttttataattgtagagtttattgtactatgtatttgcataaatggacacataatatttagttaaatacctctattcattgtgcagtttatgtttagcactgtgccaggttcttggggaaggagttaaaaaataaaagatgtcctgtttcagtactttcttgggagtggggctactatgtgaacagcttgagtaacattttgttcaagactcagttgtgggtagccaggtactgtggtggactggtgcttttgttaagtctggtttttttcctccctgctggtaagccactttagaaatgatcagtttcattaatgtaaagtcatattttatacctctacgcactaattcccgtggacatgactggtagctacgataatttttgggactccagtggtcaatgagtatgtctcaggtacttaatttcttccatggctaactagtttttagtgggcaaaaggaaatttgagagaagctgcataatttgctttaacttgcagggtgtgttaagtattgaatcacatctattatgattatggaattttggtgtgtgtttgaatgtcagagatagtgttaaggtcagaattctgctgaaaactgacccatctgaaaaccagtatgttcactccattccactcttcagcaaggccatagtttccctatcatggttcatttctccttttccctgcccattaaaggtagcaaattttggaggttcttacacatttggggttcttaaaattgttctgtaatgtgtaagctcggctgtccacaaatgattataggattgacatttgttatttggtggagtttgatatattagagtaatataaatgtgttatgcttcaaaatgaaatacgggatttttattcactagtttgtctttgtttcattcctttccaaaagaaaattaatgcttaacttgaacagctgattttttgcattgtttcccttaaaagcttgctagcataggaacaaaaggtaacttttttctttgccttttattgttttctgattgtttgatattaagttttggattgatattagaaatattaatagtttatcctaggcaggagccagctttctttaatatgtgccagatgagcttccagtagtttttagactttgagattttagaaacctcattttcagggatgggtgacttcactgctttttctttgtcttaatttaaaattggtatgtatgaccaaaggaatctttctgatactcactggtcctttttggtggaatcgaaatagcgtatgagcaatgggcgtttaagttagaaaatattcgtttatgtaaaaattaaccagaaattactggaatgtagtattggtcaaggttgtagagtcaagttaatcagtatgattaatgggtattaggaatggaaatgttgcaatgtaatgacaagtcatgaattgttaaaagaacaatctgttgttagcccattgataaactttgtgagatacttatttgagagcaaagtttgaaatctttcttttgccgattaaacatgactgtcattttgccattttctgctgtattccaaccattacgttctaagtgctcatttatcctcaccaggagccagtgaagaaggcgacattattctagttttacagatggagaaatgcagcttatgtattaagcagctgatcaggcagcacaaaaccaaggaagttattagtactggtaattgaacctagatttgtctggctccagtccagtactgtccagtagaagtataatatcagccactaggtaatttaaaatttcctagttgctacattaaaggagaagtttattttaatattttaattcaatatataaaagttcattttgacgtaattataaaattgagatattttacatttttacattctttttgtaccatcttcattatttattattattattattatcattattattattattattattattctgagatagggtctgtccctgttgcccaggctggagtgcagtggcaggatcataggtcactgcagtctcaatctcctgggctcaagggaccctcctgcctcagcctcccgagtagctgggactacaggcgtgcgccaccatgcctgtctaattattttatattttgttttgtatagacagggtctcactttgttgcccaggcaggtctctaactcctgggcttcagacgatcttcccatcttggcctcccaaagtgctgggattacaggggtgagccaccatgcctggccttttgtaccatcttcaaagtcagtgtgtgtattttagatgtatagcacatctcagttcaggctggccacatttcttcaagttgaaatgtggctaacccaaattgagatgtggctggtggctctataatgggattgtgtagccctgatacctgtgcagtggccagtactataagcggtaaagaaaccaagacttcggttttgcatgttgttgaattatttaagcttgtagcatataattatagccactagtttaataaaatcagtcatgacaaaaagtgataaagtagccttgtcataatgcaaatatttggttgtctttcccatatttacaatttttacttctctgaacaggagatgatgtaggttaaaataaaatatttaagtagcatttaaaaggcaaataattgcatttagtctagagataaggaatcaatcgcatagttatcattaataataaagaccacaagtggctaagaccactttaaccacaaaaaggagacagttgaaatattgtacatgggtttaagtatagataattaaattcagcagtctgcttatagtacctgctgtgtgctgggcattgtttagatgttcagatgttaaaataagaaatggattctgtgctcaaggatgccacccttaagggtttaattagagccattatttccagaaccattaattagaaccattatttccagaaaaatttggtggtgatgggaagagtctttgtatatttttgaacattccacagtggacactgtttgctttaagtataatctttgtatcatatcatcataggatttgtaaaattttcaaacttctttgcaagtactttgcaaacttctttgtatgcattaaaagaatgcgtggttctgagagatttaattatggcagcctcagggccactttataaaatgctctccttttgatactctgtgagttgccattatgttgccccatttctattcctggtaaagactcaccgatcatactgatgaacttgatctgcattttggactgagcttagtcatacaagtaacgtggccgctgatacattgtgtatcattctggaaaacaattgtatgtcactgttgacccggatatttttatgtataggattgcttagttgcaagatagatgaaaatatagttgcctaatcatttaagagtgaaagattcttggtattctagtttttgggttgaggagggagaataaaaaattttccaagtttagtgagtttttttgttgggggatggagagggaatgtagagagatggttaaccagtatttatgtctcatttcaaaataatgacagctttttttaaaaagcttgaaagatagtatatgccttttgtcagtaatcaacatatgtatgtaatctattctgttgataaatgtcaatatctaaggataagtagggcacagagaagggaaattgtgtacctcattttctctgtaaggctgtaaagagtgaagagggtgagagaaagaaggcacacctttcatattcatctgtcatttctagaaggcttaagtgtctgaatctgactcttgttttttttttttttttttttttttgagacggagtctcgctctgttgcccaggctggagtgcagtggcgggatctcagctcactgcaagctccgcctcccgggttcacaccattctcctgcctcagcctcccaagtagctgggactacaggcgcccgccactacgcccggctaattttttgtatttttagtagagacggggtttcaccgctttagccgggatggtctcgatctcctgacctcgtgatccgcccgcctcggcctcccaaagtgctgggattacaggcgtgagccaccgcgcccggcctttttttttttaatctgactcttttaacagtattctgatagagcagcgatggcttcaagacgtagactgttgtcacttcttttgtctgctgagctgcaaaacagcttcttgggatatctggcccatgactttggataggattgatggcttccctagcccagtctgttcattcatctttggagttgatttcttatctttcctgcttgaaaagaatggatgcagggtatggtatgattctgattatgtttttattcaatatgaagcaattagttgaccataccatgagacagaaaagacaaatactcattgaaagttgatacttaaaactcttaccctaattgggattaggaggaagagtactttatttcaccagagaataatgccagaaaattttgctaagggtaaaagtgtggggaccattttcgaaggaggtcaagagctagctattttatgtaagggaaattatctgaatgggatggaattataaggaaaggaagctgaaatattgaaagagaatttcccccaatattttcttaaatgtgggctattactttttcattggaaaaaatttaaaaggactacattaaaaatgagaatacttaacaggctgaagtaggaggattgcttaagtccaggagtttgaggccagactgggcaacatggcaagaccgtgtctctctaaaaaaaaaatcggaattctgcattttaaggagtgtggttcattcctagttatagattaggacagttgaattatgtgaaggtctgagaactatttccaatatatagacttttattaaacaaaggtatagatggatgatgacttagaaatgcaggcggtgattttgtttcatgcctagtttctcaagttttagaaaatggtgacagtctcagagaaaacaagcaactattttgtgaaatctccaggtgtcaaaacagtccaaggcacatataattagaataaattaagggagaatgttgctttagagttcttgtggtgcactagtcattcttaaagggtgagcaaggcaaaaactaaaaatagatggaagcttatctgcacatttgaacttgtggaacagctggagtgggtctcttactcccttactcttcctaactgaataattctccctctctggttatttgctgtattgagaaagtcttcactggctctcctggcgtttttgagaaggatattaaaggggcttgaattagagcacaggaagtggaataaatggcaggaaacatttgatcatttctgtcactgtcagaatgaaagcccaatatttgatttgagaggttgcaggacagtagcaaatgttttgatgggtttgtgtgtgcgcgtgtgcgcgcgcgcctgtgcacactctcaactttgtatctttttttttctttgcccttctctctaatattcactcttgtccagattttcataatataattggaagaagcaaaggcccttcctcctctgttaatgagttacaatctttcacaggtccaagaaaggcgacagaagggactttctactttgtagacttattattgtttttcattttctactaaaagtttattttcccatgtgctgtttttcggtgtgtatgcattgttaactgcatttccaccatgttgcataaggaacatttgcaatttggtttataatgtcaccattcgtgctccataagggaggtctatactctatctctcatatatccagtacctaaaactcactgcctggcacttaagtaggtgcttcagtatatgtcagcattccaaaggtctttgttactgtaaatagagcattgatgtgaatagtacagatgatggtgggctctatcatgatctctcttggcagggatttatccagagtcatttgaataattaccatgtaccaactagtatgtctggtcctgggtatgtacgtatttaggacctttagagagcttatatgttggtaggagaggacatactaggaaaccaacaattacagtatgggggtgctgttacgagatttgaggtgtgcattagagagcagagaggaaggctacctgacccagtttagagtgagttgagagaattaggggattgtttcatgaaggagatgatggttacatgatcatgttctgtaagatgaggaagagttagcagggaaaaggggaggaaaggcttggagccctgagaaaactttgtccttatgttggggaagtactctgttcagttttcaagttatgcaccattttgactaatctttaaggaagtaatgtaattggttagtttggacttttctcataatttgaacagaggttttttgttttgttttaataatggagcagtttaagaaagaacttaccttgtttaccctaccctaaccaaaccaaaccaaatgaggtgttgcatccttctctgtgcatacctgcatatgattttaaattaggaaagaaaaaccaatccaactctcttgtgaataggagttgctgttagtgtacagtttcttattttggcagcaaacccatctcagcaatgcagatgttctgcagtaaaataggtgacttattaatatgatattttctggttgtgaaaaacagttgcatggccagtatagaagtgacctatttgaatatagtacaatattaatctgcaggcatgcttcagagatattgtgggtttggtttcagactactggaataaagtgaacattgcgataaagcaagtcacacatgttttttgtttcccggtgcatatgttttgtttatactatgctgtagtctagtaagtgtgtgatagcattgcatctaaaactgtacatcccttaattgaaaaatattgctaaaaaatgctaacaatcatgtgaaccttcaacaagtcgtgatctttttgctggatggtcttgccttgatgtggatggctgctaactgatcaggtggtggttgctgaggattggagcagcttaggcaatttcttaaaataagacaacagtgaagtttgctgcattgattgactctccttgacaaaagatttctttgtaacatgtgatgctgttggatagcattttgcccacagtagaaactcatttcaaaattggagtcactcctctccaaccctgctgctagttgatcaactaactttatgtaatactgtaaatcctttgttgtcatttcaacaatgcacagcatctgcaccaagagtagattccatgtctagaagccactttctttgctcattccttaagaagcaacctgccatctgttcaagttttatcatgagattgcaggaattcagtcatatcttcaggctccacttccaattctaattctcttgctgtttccaccacatgtccagtgacttctcccattgaagtctggaacccctccaagtcatccatcagggctggaatcagcttcttccaaaactcctgttaatgttgatattttgatgttctcccctgaattgtgaatgttcttaatggcatctagaatggtgaatcctttgcagaaggttttcagttggctttgcccagattcatcagaggatggatggcaggtctaggattatgaaattagtttcttaaatcataagacttgaaagtcaaacttacttctgggtcagtgggctgaagaaagcaagtgtgttagcaggcatgaaaacaacattaacctccttgttcatctccatcatagctcttgggtgacccaggtgcattgtgagtgagcaggagtcttttttttctgggcagtaggtcacaacagtgaccttaaaatattaaaccatgctataaacagatgttctgtccaggctttgttctagttacggaaacacagagtagacttagcataattcttatgggctctagaatttttagaatggtaagtgagcattggcttcaacttaaagtcatcagctgcattagcccctaacaagagagtcagcttgtcctttgaggttttgaagccaggctttgactttccctctctagctatggaagtcctagatggtgtcttcttccagtataaggctgttttgtctacattgaaaatctgttgtttagtgtagctactttcatcatttgtctagattgtctggataacttcctgcagcttctgtgtcagcacttgcttgtttgtagtgcacttttatgttatggagatagcttcttgtccttaaacctcatgaaccaatgctctgctagcttgctagcttttcttctgcagcttcttcacctgtctcagccttcatagaactgaagagattatttagggccttactctggattggcctttggtttaagggaacgttgtggctggcttgatcttctatccagaccactcaagctttcatattgttaatttgttaatagtaataaggctattgtgctttcttattatttatgtgctcactggaataacacttgtaatttcccgcaagaactgttcctttgcattcacaacttggctgtttgttgcaagaggcctagctttctgcctgtctcagcttttgacatgccttccttgctaaccttaattatttctagcttttgagttaaagtgagagatgtgtgattcttcctttcacttgaacacttagaagccatcatggggttattcattggtctcatttcaatattactgtgtctcagggaatagggagactcaagaagagggagagagatggggtagcagcaagttggtggagcagttagaacatacacaacatttatttagtttgctgtcttctgtgggcacagttggtggtgccctaaaacaattacaatagtaaaataaaaaacataaaagatcaatgatcacagattaccataacagatataataatgaagatgttcgaaatattgtgagcattaccaaaacgtgacacagaggcatgaagtgagccacatgtgttttggaaaaatggtgctgatagacttgcttgatgtagggttgccacagaccttcaatttgttaaaaatctctatctttgaagtgtaataaagtgaaatgcattaaaatgagatatgcctgtattcaggtttattatttatttttattgagattacctttttgttatgtataaaaagcctggttttaaattacagttttctaggtgtgtttatataagataaagccttttggttcttggaaaacagttttgggaatgtcaaactaattttttcattttaagattcctctaagaacttatactagaggctggtcctggtggctcacacctgtaatcccagcactttgggaggccaaggtgggcagatcacttgaggtcaggagttcaagactagcctggccaacatggtgaaacctcttctctaccaaaaatataaaaaatcagccgatgtggtggcacgtgcctgtaatcccatctactcgggaggctgaggcaggagaatcacttgaacccaggaggtggacattgcagtgagttgagattgtgccactgcactccagcctgggcgacagagtgagactctgtctcaaaaaaaaaaaaaaaaaagaacttacctcagttaggacttaattatcctctttgcattactgtgggagttagggcaagacttttttgaaagtactgttgttaattgtggggtagataaatttccttgagcagatgaggtttttggtttttaaaaatagcccaaaagatactcagaaacaagatcggtttaaaaaaaaaaagagtcattatcagattgcgaagtatttgttttatgtgaagagagaaaataagagacatctataaagtaatgcctttctaatgctatttttgaagattcttgtgaaaaagaagctccaaaaatacttgagcaatggcagtattggtgaaggactaattcatccagacgaactttgtataggataatccttggttcattctataatatccagttttggctcttaatcaggattcatgttatggaaatcttctttaaaatattttatattggtttagtcattaatactaatgggtccctcacttagtctaaatgtaaggtgtcactgtattacgagaccttgaattaataagccaagtgctaattaggaaagttgacaaagaagcagtgttcagccactggggcaagaactcagtcatctcccattgtgcgagtgagcctttactgtttagtgggctctgtgattactgtctaggatcatctaaaacaaaaataggtagaaatctaagagaatgagtttgtgtgtatgcagattcacctgaatattgaggtagcacagtctgtggataagtttttgtttttttgtttttttttgggttataactgacaattgcgcatatttaaagtgtattttcacatgtggtcttataaagaaaaccaaatgatcataaaaatgtaaatgagagaaaatattcttagttctcagtgtcattcaggaaaaacttgttggaagatggtatgtgatagttgttgaggtttatttgtctagcacagtttctactcagttactttgtcatttaagatcctaagtacagagagattctagccactaccctatctctctgtctgcaatgttttttaaaagacagtgcagtgcaatgtattttctgatgatatcctttccttcataaacatctctaaagaattatttccatgtaattcttgtggccatcattggtatgtagttgtgttgactagagattttaagttgtatgtgtctgaagtactgtttccacacaacctccttagtattgttttgttttgtttttttttttttttttggggacggagtctcacactgtcaccggggctggagtgcagtggcgccatctcggctcactgcaaactctacctcctgggttcacgccattctcctgcctcagcctcccgaatagctgggactacaggcgcccaccaccacgcccggctaattttttgtatttttagtagagacggggtttcaccgtgttagctaggacggtctcgatctcatgtccttgtgatccgcccgcctcggcctcccaaagtgctgggattacaagcgtgagccaccgcgcccggccttagtattgttttctggtttataagaattgaaaccttgctcttaatttgtccaggtcttctgcctgtattctgctttcatgggaataaacaacactagttactagaaattttgagatttttttttctccttccttctcctagtacatgatgttttgagaggcctgtgtaatcctaaacgcttgatagagcacttttatgatgggagtatgagtagtatgcaagtctatcgactcctctaggcaagtttgtagttgtgtgtgtgtgcgcacacacacgctttaaaagtaaaacattaaccatgtatgtttggtaaatgctagactgtagttttaaaactggaagaaaccgttgaaagtatcttgtcaaatttgttcattttattgatgaggaatttgagggccaaagaggcaactctgatgaggccaattatagaattaattctaaggacctgcatttgggtctacaaaaccagttatggaaatatagatgaaggaagtcttggtttaagtggagcttttagttgaccataataagcttatgttagtcataagtgacatggctgtcagagttgctaagttgatcttgaattacaataataaaagtatgtcaaaacaaggagaaaggggtagcctgttagagaaggcaacaacagcagaatatttgaagtatcaaatgtggttagtcctggatcaccagttttcagaggaacattgatgaactggagcttactgtccaacttacactcctgagaactatttgaaaccagaatctcccaccaggttctccaggtactcactgtacctgacttcaagtgttcttcctggccacatgaacaagtctggttttttgcctgtttttcttaatgtaattctcttgcttttcctcctgtataaagatcacagtgacacctttactttcctaggcatgatcaggccatggtacctttattgactgattgattgagacagagttttgctcttgttgcccaggctggagtgcaatggtgcgatcttggctcaccgcaacctccgcctcctgggttcaagtgattctcctgcctcagcctcccaagcagctgggattacaggcatgcgccaccacacctggctaattttgtatttttaatagaggtggggtttctccatgttggtcaggctggtctcaaaccctccaccttaggtgatctgcctgcctcggcctcccaaagtgctgggattacaggcatgagccacctcgcctggccttacccttatttaaagctgtgaaggctggaagctgtttcccagacttcttgccaagtttggcctgaagcctcagaatacattttctccttgtttttcaaagtggctgggggtttaaatgatcatttgtgggtttgtacccatgctactaatgtcttgtttctaacaaggacatataaaatttcttggccttacactcacgtttggctttctggtgatcttgcatatcagagatggtagctgtcggtagtgctgtgggttgtctacaggaaaaacaaaaatacccctgagaaagcacacagttaaaaatggtattggaatgaccatccactacttttctaccagataatcattattttcattatcttaccttctgagtttccacctggagaggaagggaactaatctttattgaacacttaagatgtgccagacaatgaacaagtgctttacaatgtagattttgtttttccttaccttatagtggtgttcttaccccacttacagatgaagaaactgtggtacatgcataaagtaatgttatatagctagtgaagctggaattcgaattcaaaatcttgactgaaaagatcttgtttgacttttatgaccacaaaagacaaatgatattactctcttatttagaatggcctaactactaccatttttctacctaattatttacttttacacctcttgggccccctatctgttttccctggcatattttcttgagttcttaattatcttgagttcctaatttggaatcatgtattacttctagcagttttctcagataatctcctttcatttctctcgtgcaagactaatggtccatctgggagctgtttttcagggtagggaagagtcagagagaggcctgactacctctgtgcagcaagggaagcgattccctaaactatttcttaaaattctatcttgattggactaattttctgtattagttgaatatctactatagtactctttgttgacatgatttggtcctaggtgcctaagaaaatagtaacctccctctggccttcaggaaatttaggattcggtttgggagttaaagtgtgcacataattggtgagtatgataagtgccacaaggccatagttcaaccagccaaccaaccagccaaccaaaaaccaaaccattggctgttcagagtggggaagagagcacaaatctgcatagttataacagggaggctattctcagtcctggctctggatgagaatatcctggcgagattttaattcagtaggtgtagggtggcgcaggaatctgtgatgctgatatgcactgggatttatgctatcaaggataatcttttatttctttagttctccaaagcatgtttgtttttatcttttgaatattcccttgcattttcccctgcactttactctgaagtgggaataatggaacttgggtgcctgttggctgattcaccatgtttagttagtagatctgtgaatgtaatctttaatggatttaggcagaatgtccaatgtggaagtaaattcagtctgtcttggaattaattgtagaatgtagtaaagtagccttcatttatttgcatatcttttggactaaacttctgtatttaatagaatgcctcgtcatattctgtaaagtctcattaatatggagcctgtaatttaaatctgtattttggaggcacactgaggtaaagtttacccttaataagggcaccattgtttactataatgggctaattacatgtcttaatcattgtagcaggttgaatacaacctcttcttggcagtgttttactggctcctactttcaagttattttctgccttatagtagtaaaaatttagttagttaacttgtctttcctaagcatttagaaattagttgaagttgtaaacactgttagctgaatagaaataagctgacactttctcttcaattgtagagagagattatgtgacttaatcttcccatcagggggatgtgagtgattggaatgctagtggctggcggtgggtttgtttcttaaaggctatatgttgtacttcactgaaccacctgtacagctaagctgtcttgaagttttagtcattcctactcttgtggttggagtgatactgtgggtcttggtagcgtttctgccttttgttctaacatgtcagacagttactctttggccttcttcattcttatcctaattgtgtataacaactagcatttgaatacctaccatatacggggcgtcatgcttgctggccttatgtacattggcctaatatttataatacctgtgtgagtagtgctgttgttatccacattttgcaggtgaaaaagcaaggctttgagggtttaaatacttgtactaggtcaaagagctaacaaatgaaaagatcccacattcaaatccacacatgcttttagaacctgtgtttttagcttttatctgttgccccaggaccaggccagatcatcatcatcacttttctcttttccttatcaagttggtaagcggctgtaggttgttctggtgataatgagagataaaggtcatagttagtgcataatcagttagcattttaaaaataatcgctgctgcattgtgattccagagaatggaataaccataaatgtattacttctcagacattcacagtgatggtgtacaggatcatgctcactctagggcaagcaacattataacattgtttagaagcctgatttgctataaattgaggaacaaggtgtatcaggaaaatctaaaatatccctttgattatcccagtacagtgattacgaacttaaggctgggagctgaactctttacattcataccttagctcttccagctctgtaactctaggcaaattatttatgctccccacacctcagttttctcatgtgtaaaacaagggtagtggtagtacattctttaaagagattttataaggatgaattaagacaatgtgaagaacttagcagagtgtcttatatataccaagcttcaaatattgctttactatcttgagttaataggaaaatcaaagaggtattaaatggagagtggatataaaagctttgaggtgaaggagtggtcaggtgatgaggtgctggttaccttgccccttagtgtttagctgatttgtgttggtggtcctaaagtcaactcttcccagcttttaggtagtaacttcaagatgtaagtaaaaatcctaaattctgaaatattttaaaacattttaaagtggtttacattttacaatattcttgcttgtaggcaatatgaaactcaattagatggtaaaaaaatgattaccagattctttagcagatcaactctacgatataatctgaaagatagagttgtgtgcttacgtgtttttatttatttggagaggttcaggcgaaagaaatgtcaacagtggtacagttacgtacccaaatgaagagttgctgtagttgtgcagatctgggatttggtgtatgaaaaagatgcctaatttcattgggaggctgtttagatgagaggcactttccaacactgggattctatttttttgggtgttgaatgttacataccagattagttctcatttctttttttttagaagaatacgtattttagtctaagaacaatggaaaatagctttctcttttagctatttcaactcaattctaacctcattcctaacttagcctaactctatagtttattttggctgcaaaatcctgcccactttatcttctataaaaatgtatttttccttcaatgaggggaaaaatgcaagctaacatatttattttggattatctttttaccccattattttcctaatgagctctgttcatgcctctctgcaaatcttaaaaaaaaaaaagtcgattcagtttgaggatagctgaaacattttttatgcagaaagtggtttgtaaaatacgggagaattctactgaattccctcttagagcatcattcagtagtagcttactggtgataaagattactattgatgtctttactattctgggaaagttttaaagtttacaaggagaatgttagaattcagtatataaaccaggaaaaactttactttgttatctgaaaaagacctaagtggatataaggcctcattataccactcaattttcattcacttcgcaaaattgacttttatgaagctaatataatacaaggtgaaaaaaatggtccatgatcctggcagtgttgctatggactaatttccatcactttgagtcatattactataaaagggcagaaaacactgggggaggctcttagcagatttctaactactttgtttactttggttgatagggagtttgctgtcatatttttgaaaggtggtggtggtgggattgtctgctatctcctttctctgccacctcccaggtatataggtgatggttacaatttggaaaatatagaaagaaaaaaaaatatacaccccattaccttgagatacttaacattttagttttcttcttgcttttttctctttcttacatggttttaaaaatagtttttaaaatattaaatcatataccattattttctcctttttcccccctttaacactgtgttcccttctgtacagttttttttttttttttttttttttggagtactgtttttaagggatagcatcattttgttctttggagctatcccatttaaccagttctctgttgttagacagcaacgtcccccctccaaaacaacttttcctctcaattccaacattatttccttatgataaagtaaaattactggattaaagtttgaacgttttcaagtatcttcatatataaatgtgttaaattttatccaaaatgcttgtgaccacttcttatttcattcccatcatctaagtatgggagcacttgtttctccacgtctttgtcggtagtgggcattttcgctttcctacactttttcttcgatttctaggtggaagatgataccacctcacattcagtgatacttagaaatgctgtgaatgcctagtcagtccacaaactccttagcctttgttttttggtttaaacccaattctggggacttcctgatcatcccttcttggtattagctaagcttcctaaacacatggatgtttgtgtaagattagtatggtttcattaaaaccaggttgtcagccagatgtggtggctcacgcttgtaatcccagcactttgggaggctgaagtgggtggatcaccgagaccagcctgaccaacatggtgaaacccctctctactaaaaatataaaaattagttgggcatggtggcgcgtgcctgtaatcccagctactcgggaggctgaggcaggagaatcacttgaacccgggagttggaggttgcggtgagccgagattgtgccattgcactccagcctgggtgacagagcgagactctgtctcaaaaaataaaaaaataaaaaatagggaggagccaagatggccgaataggaacagctccggtctacagctcccagcgtgagcgacgcagaagacgggtgatttctgcatttccatctgaggtaccaggtttatctcactagggagtgccagacggcgcaggccagtgggtgcgcgcaccgtgcgcgagccgaagcagggcgaggcattgcctcacttgggaagtgcaaggggtcagggagttccctttccgagtcaaagaaaggggtgacggacgcacctggaaaatcgggtcactcccacccgaatattgcgcttttcagaccggcttaaaaaacggcgaaccacgagattatatcccacacctggctcggagggtcctacgcccacggaatctcgctgactgctagcacagcagtctgaaatcaaactgcaaggcggcagcgaggctgggggaggggcgcccgccattgcccaggcttgattaggtaaacaaagcagccgggaagctcgaactgggtggagcccaccacagctcaagaaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaaccggcagactgcctcctcaagtgggtccctgacccctgacccccgagcagcctaactgggaggtaccccccagcaggggcacactgacacctcacacggcagggtattctaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacggaacaaagctggatggagaatgactttgacgagctgagagaagaaggcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaatgaaatgaagcgagaagggaagtttagagaaaaaagaataaaaagaaatgagcaaagcctccaagaaatatgggactatgtgaaaagaccaaatctacgtctgattggtgtacctgaaagtgaaggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccaggcctgccctaaaagagctcctgaaggaagcgctaaacgtggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgcttcaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcagcgagacagaaagtcaacaaggatacccaggaattgaactcagctctgcaccaagcggacctaatagacatctacagaactctccaccccaaatcaacagaatatacatttttttcagcaccacaccccacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaaaatgttctttgaaaccaacgagaacgaagacacaacataccagaatctctgggacgcattcaaagcagtgtgtagagggaaatttatagcactaaatgcccacaagagaaagcaggaaagatccaaaattgacaccctaacatcacaattaaaagaactagagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggagctgaaattatggcaataatcaatagtttaccaaccaaaaagagtccaggaccagatggattcacagctgaattctaccagagacacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccgccatgatcaagtgggcttcatcccgggatgcaaggctggttcaatatacgcaaatcaataaatgtaatccagcatataaacagagccaaagacaaaaaccacatggttatctcaatagatgcagaaaaagcctttggcaaaattcaacccttcatgctaaaaactctcaataaattaggtattgatgggatgtatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttaaaagggatgtgaaggacctcttcaaggagaactacaaaccactgctcaaggaaataaaagaggatacaaacaaatggaagaacattccatgctcatgggtaggaagaatcaatatcgtgaaaatggccatacttcccaaggtaatttacagattcaactccatccccataaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatatacaactatctgatctttgacaaacctgagaaaaacaagcaatggggaaaggattccctatttaataaatggtgctgggaaaactggctagccatatgtagaaagctgaaattgaatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaataaacagctccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggatgtcagtgtggcgattcctcaaggatctagaactagaaataccatttgacccagccatcccattactgggtatatacccaaatgactataaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacccaggaaggggaatatcacactctggggactgtggtggggtggggggaggggggagggatagcattaggagatatacctaatgctagatgacgagttagtgggtgcagcgcacgagcatggcacatgtatacatatgtaactaacctgcacaatatgcacatgtaccctaaaacttaaagtataataaaaaataataataataataataataaataaaaaccaggttgtcactgaaaagttaaggaagcatttggaaattactgtaaaggaaaaagaacacctaacaaagctttcagtgttggcagtgttctgtgcccaccctttatgtatttagcaattactttagctgaaccagtttgttcatatagaagaaccagtcagaatgtctctgcccttcccttcctctaagcacacacaatggtcatctcctccctttgccttttcttttgaccatgactagcaggtcctcagctagcttacttgttatagacttgttcacacaactttatagctctgtttctgtcaggcatatttctgttttatagatgaaaactttttcttaatttaaatttcccttttcctggaatttattcatgtgttctgaaatgctgctgttattgtaacttactgactgtattgtaaattcatggattttatctgggaggatcttgactttgatactgaagagctgatgcaaaatcttaaacaggccgatgaaaaagagcttgtcaaatagataaaggagctttcttctttctatattcatcagtaaaaaatgttctgtctaggatttgcatagatgactcttttcaaaatcagttttcacctgaggtcattcaggtacctaaaagggaggggagtatctaaacagtgacaaagttgtcaacagggcgttgcatcaagttctcttacacactttcctttttgctatgaaagctgctttctcagagccatccagttactcttgtcatatatgcagtttgaagaagtttacttctgcctcttttttctcacctctaccaaggtaatgatgaccatttagaagccaaggattaattttgggaatggcttagtgtggtggaaatttttaaaaaaattctgcagtggcttaaatagtgcaagtagatttcactgtagggactgatatagcagttataagagcccacggtttgaaagcaagagaaactctaaaaaaacaaaacaaaacaaactgatgtcattggtgtcattcgaaggtttacacatttctgttcacttgaggtcttttttgtaattatgttttcacatatgtagatacctaggagtggaattgctgggtaacactgttttccaaagtggctatacattttacagttcctccagcaatatatgagggcttcagttttccacacattttgccaatacttggtatttttaatcttttttttaatggccgttctggtgggtgtgtattgataatgaccaataatgttaagcttttttttactgttcatatttgccatttgtttattttctttggtcaagtgtctgttcaaaccttttgcctattaaaaaaatttactgtttttgtattgagttataagagttctttatatatcctggatataggccctttattagtttatataattggtaaatattttttcctagtctctgacgtagagtcttgtcttttaattttcttgatggtgtcttttgaagaggaaaagtttttaattttgatgaaatctagtgtatcatgttttcttttatggatcatacatttgttgtcatatatctaagggatctttgccttagccaagatcacaaagattttctcttatgttttcttgtagatatttcatagtttattttgtaagtttgtatctgtgatccatatttgggtttatttttgtgtatggtgtaagctagggtataagttcattttttgcatgtggatatttgcttgttctggtgccatttattgacaagtctcttaaaagttttttttttctgttaaactgtattactgcagtaaatagtcttacatatgctgtgaacacacgccttcattttctgactgaattgggagaagagggaggaaaggagtttgtcttgggtcttggccttattgtagggagcttttctatcatagttcactttgctttattctgccctttaagaagatattcacagtctttgggaacaacgaatagagttctggtcaatttggctttagttaagaaggtgactctgttatcctctccctagggatgattatgaaatcttattttgcacagttagggctgggtaagcctaggatagtacaagctattggacagaacatttgttaaaaatatttttaggctgggcgcggtggctcatgcctgtaatcccagcgctttgggaggctgaggtgggcggatcacgaggtcaggagttcgagaccagcctggccagcatggtgaaaccccgtctctactaaaaatacaaaaattagctgggcatggtggcaggtgcctgtaatcccagctactcaggaggctgaggcaggagaattgcttgaacccaggaggcggaggttgcagtgagccgagatcgtgccactgcactccagcctgggtgatagagcaagattctgtctcaaaaaaaaaaaaaaatatatatatatataatataaaatatacatatataatatacataatatatattatataatatatataatatatattatattatatataatatatattatattatatataatatatattatatatatatttatttctagcatgagaatgatgaaactcttcttaaaacattttattttctttttccaaatagttgtttctaactataaaactaaaacatgtttattacagaaacgtttggaaattaccacaagtatgaagaaaaaactttcttcccctatcattgccatcctgattttggctcagcaacacttttaattttgtgcaattgaaatagggactctggaccacttagtttcttggaataatttttggatctactgaaggattcaggccttttaaaaaatatttctcttgagaagggaaaaggatgggaactcacatttgatgagcatctattgtgagctaggccttgtatcccagaaagctctgtgaagcattaaaattacattaaaatagcatgaaaaatttgtttcctctcttcatcctccctaactccctgctttttttaggcttgggttaaataatttgcccagtgtcactcagctagtatgtggtaggtttgaaaagttggggaaaacttaagtatcattcagttaaaattgttaacctgtgtcttatttcatggtttaagaaagatagttctccccccaccccccaacacagttttctggcttctgtggtcttccttttattttctatcagatttagaagtcccaagatccccttatgtcctactcaaattaagacttgtttctcttctcctttctgtattgtgctttcaactctgaggccctgttttagctttggtgtttattagctgaataaaaagataaagtgagagagcttagagttttaatagggaacatttcttgaattggattgatttcatcatcaattttactttcttaagtattaactaattactagctgtggattcccaggcaagtccactcactttcttcatctgtaaaatgaactacctactcagcaaggatccttctgtggtgtatcagcattccttattattattatttgtttttgttagtagaaccatgaaataaatttctggcgatatgggcacagagtatttgcagttgtaacacaatggtaagtatctatatctaaacatagaaaaggtacagtataaatacagcattataatcttatgtgaccgactgctgtcttatatgcggttcgtggttgactggaaagtcattttgtggtacatgactgtatttgcatttgtgtcagtgggtaaaaagcactggtttcatgtaaaaaaaaaaaagtgtgtgtgtgtgtgtgtgtgtgtagggtatttgtgattctggagcctgatttttccttcttcatttaggaggtatttatgactgtcaaggctacttgactgccagaacttgccattgatgtgctcacttcatcaaatggcatagcttattctaatctgttgtttattttgttgccatagtaacctttttgaaaacagaaaggtggttgatatgtttgtacaggaattcagggcctttcccctgattgacatctgctggcaggaatttttatcctagtgattcgggctaaggcttggggctataatgagtacaaagggaggtgggatatttggacagtttgaagcagacttctttatattaatccactctattaattgctaaattattttatttagtgatttagggctttccactcgagccagctacttgttatatgaattatatttattcctgacaggtgttatgcttgggttcaacatttagaactcaggctagagtggagcacgttgctgctacctcaggcttattcagacagacaaaatagaaaacaatgaaaggtggccccttccagatttcaccttagtacatttggactagtgaactaggatgagcaataaaaggtagttgaggaggtgtggaaatgaaatcctaaaggcaataaaaagtaaaatgttttcacatctcttattctagtgccagtgaacctttgacttggttgcagaacgaatctacatgggagcaagcagttgtttagagtaaaatctttgcacagatgtcttttcccttttcacatgttagaaaaattgggaagaaaatctgtaagtgaaatgccaaaaaactcaatgtaatctttttagaatgtctaagatggactacagaatcagtcttaatctttttcagaagacatggccacagaggcttttgtgggaaggggattgtaatttagttaaaatttagtgaagtcaacaccaggactctagcagcccttcctggtgaattaattttgttctttgtgtccttaagctttcctttttggacctcttacttcctggaggctttctctcctagcccctttgcctttgggtattctgttaccacaaaaggagttaactcttcatatggtacaatcatcatagctgttttgaaatctgttttttagctgagggaattaaggcggaaagaagttgcaaaggggtcatgcatgttgcttttccatttactgtattctcttaaagtatataatactttaaatgaactgttcccttcttttccctcaccttccatatgcttattcagtcaaaaagcccttatcctctgatctctgataagtactgggaaactatctgatcaaaaaaacctatgatcaaaacagttctttggaatgaatgtccttatctgtgtttaaaagatgctggataactcttgtgaacattcagttagtacagtttgtgggcattgttttgaggcccctacaataccaaagaaaatggtcagcaacttggcaccttaccactgaaaggggcttcatctctgaatttgcatttcgagagctcacagtgggagttacaggctttgatggtatcactggtagcccagagaaaactgactgatatgttctaattcttgagacaggaaagaaaacccatacatcttaggattttttgtaatcattgatgcataaataatttaggcaggaaatttagttatttaggatgttttgtttcctgaaatgttatttaattgtatttttctacccacttgtcatattatggaagtagtttatatgacagcgtgctcttatgagcagtcatttaattacatcttcctttggactttcatagcactgtgacttacctttattatagtacttacttacaaacttggagagaaagatgccaactgtctgtgaaaaaaatcagtctgtatttaattaaggcacaaacagagctaaaaattaaggcacaaacagagagagctaaaaattattcatatttttctccttgtaatggcactgtacttgatgcttctatttatttttaattcttaaggtaattttatttttaatttctatggatacataattgtacatttttatggggtacatgtgatatttaatacaatctacaatgtgtactgatcaaatcagggtaattgggatatccatcacctcaagcatttaacatttgtgttgggaacattctaaatccccccctttgtttaaaaatatacacttttttctatttattttgatttagttgtagaagtgccatggttggtgagcaacttggtattgctagagttgtgatggcagcaggaaataaaggtatagatagtgatttgggactagggagtttggctttaatgtgaagaaagcaagaagtccttggaaagatttgaccagagaattgacacatactatattgaagttgtggggcagttgaaccttgtgataacgtggaagatagttatgcttagaggcaaagacaacagcagggaataggtccaggagtgaggacaacgacttgggcagcaggggtggataaggagacagtgtggaggtaaacgaaataggatttgttgggaggcaatgtaggcagtgaaggagaaggaaatggttttatgagagcttgaggtgagaccgttaatgaggataaaggacaacgaatgagcatgtagaagatggattcagtgcagaacatccaaggggactaggatgtctagcaggcacttggcaattaggttatggagcttagaaaagactttagggctagagactcaaagttgagagtggtttgcctataagcaatagttgaaactgagagaatgggatggaaagatatttgttggatgcgaggacaatctggaattagctggtctggccaagtaaacatgccttttcgtcttccccgctttgcccagcccttctttttctttttcttttttttttttttttttgagacagagtctcgctgtgttgtccaggctttccagcccttcttaaagctctagtccaggctctgatgaagaggattgaatttaaaattcatcacacattgttaaacattatataaataaatggtgtgctcttaaaggcagcataaatatctgggtttcaccaaggaaggaatgggaaaatgggttaaacttaaaaaagtgaatgtgtagtcagaaaatgacagagctactgatttgctttttaaaataataaatttaggccgggtgtggcggctcacacctgtaatcccggcactttgggaggccgaggccaggagatcacaaggtcaagagattgagaccatcctggccaacatgatgaaactccatctctaccaaaaatacaaaaattagctgggcgtggtggtgcgcacctgtaatcccagctacttgggaggctgaggcaggagaatctcttgaaccggggaggtggaggttgtagtgagctgagattgcaccagtgcattccagcctggtgacagagtgagattccatctcaaaataaataaataaataaatctgttattattattattttaaaataagagttcttcagcaaaatggataggatatggacctggatttgatttttaactccttttttaaaaaaaaattttattttaggtttggggatacatgttaaggtttgctacacagataaacacatgtcacgggtgtttgttttacatattattacatcacccaggtattaagttcagtacataatagttatcttttctgctcctctccctcctcccccacccccaaatagaccccagtgtctgttgtttccttctttgtgttagtaagttcttatcatttagcttccacttacaagtgagaacatggcagtatttgattttctgttcttgtgttaatttgctgaggataatagcctccagcttcatccatgttcccagagaagacatgatctcattctttttaatggctatgtaatatttcaagatgtatatgtaccacattttctttatccagtctgtcattgatgggcatttatgttgattccttgtctttgctgttgtgaacagtgctgcagtgagcatttgtgtgcatgtgtctttatggtagaatgatttataatcctctgggtatatactcaataatgggattgctgggttgaatggtagttctgcttttagctctttgaggaatcgctatactgctttccacaatggttgaactaatttaccaactcaccagcagtgtataagggttccttttccctgcaaccttgccagcatctgctgtttttttgactttttaataatagccattctgagttgtgtgagttgatgtcttattgtggttttgatttgcatttctctaatgatcactgatattgagcttttttttcatatgcttgttggctacatgtatgtcttcttttgagaagtgtatgttcatgtcatttgctcactttttaatagggttgtttgtttttcttttgtaatttaagttccttgtagatgctggatattagacctttgtcacatgcatagtttgcaaatattttctcccattctgtagattgtctactctgttgacagtttgttttgctgtgcagaagttcttaagcttaattagatcccatttatcaatttttcctttttttcgtgattgcttttggtgtctttgtcatgaaatctttgcccgttcctaagtccaggatgatatcacctaggttatcttccagggtttttatagatttgggttttacatttaagtctttaatccatcttgagttaatttttatacagaatgtaaggaaggggtccagcttcaaacttgtacatatggttagcctgttatcccagcaccatttattgaatagggagtcttttccctattgcttgtttttgtcacctttgtcaaagatcagatggtcgtagatgtgtgaccttatttctgggctctctattttgttccattggtttgtgtgcctgttttgtaccagtaccatgctgttttggtcactgtagcctttagtatagtttgaaattgagtaacgtgattcttccagctttgttctttttgctaaggattgccttggctattcaggctttttttttttttttctgaaaagaaaaaagaaaacttttttcctcaggttccatataattaaaaaaatttttttttctagttctgtgaagaatgtcgttggtagtttaatagaaataacattggatctgtaaattgctttgggcagtatacccattttaatgatattgattcttcctatccatgagcatggatgtttttccatttgtttgtgtcttgtctgatttctttgagcagtattttataattcttcttgtatagatctttcacctccctggttagctgtattcctaggtattttattttatgttattttatgttgttttattttatttatggcagttgtgaatgggattgcctttctgatttggctctcgatttggttgctgttggtatataggaatgctagtgatttttgtacattgatttttatatcctgcaactttgctgaagttgtttatcagctgaaggagcttttgggccaagactatggggttttgtagatacagaatcatgtcatctgcaaatagagatagtttgacttcctttcttcctacttgggtgccctttacttctttctcttgcctgattgctctggctaggatttccaatactatgttgaatagaagtggtgagagagggcgtctttgtcttgtaccggttttcaagggggaatgcttttgcccattcagtatgatgttggctgtggatttgtcataggtggctcttactattttgaggtatgttccttcaatacctagtttattgagagtttttaacctaaagcgatgttgagttttatcaaaagccttttctgtatctattgagataatcatgtggtttttattagtctgtttatgtgatgaatcacattgattgatttttgtatgttgaaccaacttgcaactggggatgaagcttacttgatcatggtggattagctttttgatgtgctgttggatttgttttgcaagtattttattgaggatttttgcactgatattcatcaaggatattggcctgaagttttctctttttttgtagtatttctgctaggttttggtatcaagatgatgctggcctcatagagtgagttgggagaagtccttcctcctcaattttttgtaatagtttctgtaagaatggtaccagctcttctttgtacatctagtagaattaggctgtgaatccatcaggtcctaggccttttttggttggtatgcttttattactgattcaattttggagctcattattggtctgtttagggaataaatttattccttgctcagtctgggtgggggtgtatgtgtccaggaatttatccatctcttctagtttttctagtttgtgtgggtagaggtgtttgtagtagtttctcatgattgtttttatttctatggagtcagtagtaacattccctgcgtcacttctaattgtgtttatttggatcttctctcttttcttcttaattagtttagcgatcttttgaatgatttttcatgtcttgatttccttcagttcagctctgatttttgttatttctcttcttctgctagctttggggttgatttgttcttctctaattctttcagttgtgagattaggttgttaatttgagatctttctttttcgtgtgggcatttggtgctatgaattttcctcttaacaccaccttagctgtgtcccagagattctgttatgttgtatctttgttctcattattttcaaataacttctggatttctgccttaatttcattatttacctaaaagtcattcaggagcatgttcttattttccatgtaattggatggttttgagtgattttcattgtgttgactcctattttcattgcgctgtggtctgagtgtgtgtttggtatgatttggtttcttttacttttgtgaggattgttttatgtccaattatatggttgattttagagtatgtgccatgtcgtgatgagaagaatgtatattctgttgcttttggttggagacttctgtaaaaggtctgtcagatccatttggttcaacgctaagtttaggtcctgaatatctttgtttattttctggctcagtctgtctaatactgtcagtggagtgttgaagtctcccactattattgtgtggggagtccatgtctctttgtaggtctctaagaacttgctttatgactctgggtgctcctctgttgggtgcatatatatttaagatagttaggtcttcttgttgaattgaaccctttaccattatcccatgcccttccttgtcttttttgatccttgttggtttggagtctgttttgtttgaaattaggattgcaaccttttttgtgtttcccattgcttggtagattgtgtttcccatttgcttggtagatttttctccatccctttattttgagcctaggagtttcactatgagtgagatgggtctcttgaagacagcataccattgggtcttgcttttttatccttgccactttgtgccttttaagtgggggcatttagcctgtttacattcaagattagtaatggtgtgtctggatttgatcctgtcattgtgctgttagctggttattatgttggcttgtttgtgtggttgatttacagtgatactggtgtctgtgtttaagtgtgtttttgtattaactggtagcggtctttcttttgtatatttagtgctcctttcaagatatcttttaagggcaggtctggtggtaatgaagtctctcgacatttgctttcctgaaaaggatcttatttctcttttgcttcggaagtttagtttggctggatatgaaattcttgaagatttttttaaagaatgttgaatataggcccccagtctcttctggcttgtagggtttctgctgagagatccactgttagcctgatggggatccctttgcaggtgacctgctctttttccctaactgcctttaacatttattctttaattttcatcttggaaaatctgacaattatgtgtcttgaggataatcttcatgtgtagaatattgcaggagttctttgtattttctggatttgactgttggcctctctagcaaagttgggaaagtttttgtggatgataccctgaaacatattttctaagttgttggcgttctccccttgcctttgagggatgccagtgatttgtagttttgtcctctttacataatttctcggaggttttgttcattcctttttattcttttgtctttatttccgtctgtcttatttcagaaaacaagtcttcaagttctgaaattctttccttagctttggtttattctgctgttaattcttgtgattgtattgtgaaattcttgtagtgtgatattcagctctgtcagatcccttagggtttttttttttttttaaatactggttatttcatccttcagctcctgtatcactttattatgattcttattttccttgggttgggttttgtcatcatcccgaatctcaatgatctttgttcctatccatattcagaattatatttctgtcattgcagcccatttggcctggttaagaactgttgttggagaactggtacagtcatttgaaggacatatgacactctggccatttgagttactagagttcttgtgttggttatttctcgtcagtgtgtgtgggtattactttaactgcagtgtagattgagtatggtcaatagacttctttactgcatgttttcactgagttgaggttttgtgtagggtgtttatttgaagctgacttcttgtttctggtttcagaggggagggtatgtcaggtatctttggtgttaaagctttggggtatgatccagcaggtggctcttaggcttattggacagctggtggactaaacagttgttcagttgtgtggctcccctatgtttcctcacagttgtagccatgttccctctcagtgtcctgaaagtatgggtttctctgccccttgagtgctggctgtagttcatgacatccagtacagctctggggagatctcagtatttatgttcctcccccagcttacaggctgcagagggagagatcttattagtggttttggccaagggttgtttgcttgattcctgggggctccacctcagagagatgcaggtgagcagttgcttagtgcagtcagcccaggatggagggtcagtgctgcgggcccaagccaggggttggttccctgtctggtgatgagccgtcagaggtgtgtgggacctgtgggagatggactggcctcctctccttgagtttactgcagcttgttggagtgtggataaagcacttaatgtctttgctccttcatcagaccgagggtggcaagggcagttccacagtagagtcagtggccgagaggcttttagttgccactagaggctctgtccagggagttgctgagttggtgctagctgagtagctctggttgggggtggctggagccccaggcttggaggacctgccctgtgaggagatatgggatcagccacccacgtaacagtggggccacttttccctagggctgctgtggtatacttgaggcctgcagcagtccctggtcacctcagattttccagaatctggaggtgttaccagtgaagactgtgaaacagcaaagatggctgcctgtccttccctctgggaactttgtcccagggaggaatgacctgttgctggtccaaaggcacctataggaagtggctggagactccagttgggaggtcccccagtgaggaggagcaggatcaggactgcttaaaaaagcagtctggccacattttggtagagcatgtgtgctgtgctgggggtccacttcagccctcggttgcctcagacactctgaagctctaaggctggaacagctgagtcacccaaacagcaaagatggtagccaccccttcctccggaagctttgttccaggggaacttcagatctctgttggctggagagcttgggtgggggtggctggaggcccaggttgggaggtcctacccagtgaagaggaatgggattgggcacctgcttaaagcaacagcctggccacgtttgggtagagcagctgtgctgtgctgtgctggggcatcccttctgttctgggtcagcacagattctccaaagcacaaaggctggaatggcaaagatggtggcccacctcttcccctaggagctccttcttagggaggtgcagtgccactactggcagctggctagaattccaagccagtgggtcttatcttgtgggctgccatggaagtgggtcctgtgggctcttgctggtcagtcccctggattcagcctctttcctaggggtatttacaggagtctaacctcccaccctgctggaggtacagctacttttgccagaaagcccaagtatctaaggctccagggtcttcacgcatgccaagactccacatggctctgttggtcagactgaagactgcaggccctggtggagtgggttcacaaggcgatctcttaacctgaagtttgcaaaggtctgtgggagaagcatagtttctggggatcgctcattcactcactgcttccctgagtcggggaggaacccctggctccgtgttgctcccaggtgcgctgttttcctgccttgcttttctctgttctctgtgggtcaagttgtttccttgattaatcccaatgagagtacctggatgtttcagttgaaggtgttgtatttactcaccctttctgttcctctctgtgagagtcacacacactagctgcctctagtcggctctgttggccactccctagccgtttaaactgtttaaaaaaaaatcttatcgtgatgtaattcacatgctatataacttacccatttaaagtgtacagttattttagtatatccagagagttgttcaactgtcactgtgatcaattttgaatcttttcatcaccccagaacgagactttgcacaccttagttgttatcttgacccaaatttcgtaactgttttgagttactcactgaagatcatttggtctcttaacaggcagcaagaaattgatccagattatctcctttctcgatctgtcgtcttactgacagatttttaggcaccaaaaatcacaattcctttctgtgtatgctactttaagatagatttcttgtcttctgtgagttcatttgggagtttcagtgaaggacctgggtgttttgatggaagtacatggtttatgtgtatccatattaaatttcatcttggtgtattgggcctctcatgtctgtccttggtacatccttttagccttttaggacttctggatcttcagtctgccttttaatgtattaatgttcttagtgaacctaatatggtctgtatatttgatcatttgatcattagattttttttttaagtcattggcaaatgtgttaattagaattaggcagagtgggagtggggaagagttggcgttgcctgtacaaaatctcgtttcttgtagatatttatgaattactcattttgctttgtttacagaaccattatagggttgaggatggcaacagtgggacacgaggcatattctccccctcccacagtgcttctctaaattcctagatttcacctagaagcacagacaaaagcatgagcggcgggaggggaattttagtcacactctttatacttatagccaccatgacgtctcaactcacatttcttcagtttgttcacagcaataacataggggatttgggcataggttttactcaaattcagacacagtgtttttagttttccttagtctctgttaccaatcccttggatgataaaatttattttaaaaaaagaactgtggtgtgtcttcttgaaggtatatgctgagcttttagattattgcttccctttcaaaggcgcacagtccatccctttaacaatttgtgtctgacaccgagataaaactcaatagattacagattgttgaatctagcttcttactgcaaactactgtaatccctttgtaatcttccatctgttttattcttaaataatcttcttctgggacttaggatgtatctctttctagcctgggactaactcctttaagtcagatagtgtgacttatttattctatgttatgtaccctgaagttcattctcattgattgaaaaggaggacataaaatagaaaaagcactcttttatatactttcacacatcaccactctgagccttaagtcttagatcttccttatttgtcttgctgcaaacataattagaaaatcagaaaagctcttttttgtagtccatggcatttttccaaggtacagttcagttttggagtaaagaatcataccctttctggctttccactctaaacttctgcaaattcattcttcttcttgtaagcaaaatcagaggtgtttaattgtttagtcacttggatatatacactgaacatttttagttaaacagacctttctgctttgaattgaggatgactgttaataaggtgttagaaatgaaaatcaatcctgacttcttcttcttaatcagaatccaaataataaggactgcactgctgcagtctctatggggacacccactgctctcacttttctgttttcttctttttaaaaaattttattttttaatttaattttatttttttactgttccttgcagagcagggctaccccaaaggcagtgttcccagagtagcccactttctgtttttttttttttttttgagacagagtcttgctctgtcgcccgggctggagtgcagtggcgcaatcttggctcactgcaaactgtggcctcccgggttcacaccattcttctgcctcagcctcccgagtagctgggactacaggcgcccgccaccacgcttggctaattttttatatttttagtagagatggggtttcaccgtgttagccaggatggtcttgatccactttctatttccttatagctcatgttgacagcttttctctccaacatgggtctactcatctcatgtaaaattattactatacgttcttgttgagatcatgaaccttctctaaaaatttcatgaggttgtggatttggagaagtattcctcagtccattcaatacaataacagtaatgactatagtttattatctactgtgagtcaggcaccaactgtagcgagacattctagttacgttttcttgtatacttccccacagtgttacaaagaggacatgatccccttttttctgatcagtaacttgaacctgtaaagtgaaggttgaatgaattgccccagacctcatagaaataatatattctgcatttgtatttttaaatcagtttttaaaaagtaacacatctaaaatagtaagaggcatgtctaaaattctagtgtaggtctgtttaacaccacagtgagtgctgcttttttttggtgattgagggcctaccgtaatatatcattgtggcagcttctttggaagataagaaattatccaccagaaataaagaggacacattctcttttaaggaaaacaccatctcggcttttaaacacttttcttttttaaagggtgaaggaagccatggagatttcttaagaagagagacacttcctacctttcttttgggaagcactgtactgattctgttcagcagtgtacagaattggagccatagtagaaggaggtggagattggagagcgcctagctcagcacccttggcgactagttgtagccctgactccttggagtgatctgtatgtcactctgtatttggacacagctgtttcctcgggttgcatggtaacaaaccaaataatttgcctttaggctcttttgcttactatgtctgtcatcttttacacaactgaagcctttggtggagaaggattttgagttgactacattgcttaattgtaatgactattctgtttgacctttctaagccagagcttcacgaagagagatttgaatgtttgctccgtagaagtaggtctcttccaggggtgaggcactgtcttaaaaagttataaagaggccgggtgtggtggcttatgcctgtaatcccagccctttgggaggccaagtcaggtggatcatgaggtcacgaaatcgagaccagcctgaccaacatggtgaaaccccgtctctactaaaaatacaaaaattagctgggtgtggtggcgcccgcctgtaatcccacctactctagaggctgaggcaggagaattgcttgaacccgggaagcagaggttgcagtgagccgagattgcgccactgcactcctgcctgatgacagagcgagactccatctcaaaaaaaaaaaaaaaagttgaaaatactaacttttaattatcccttaaaaatagatattccagtttttctgatttttagtaatacatgtttgttacggaaattctgaaatatgtagaccttaacttatggaaactttagaatataaagtagaaaaatgaaaattacccataattgtaatttctaggaataatcactatgaacatttgagtcttcccctttctttttttctctttttttgtattttttgttttttgtttttttttttttttactatatatgtatggagtgcaacacatctgtattttagttatcactttacattgattaagcatttgtacatgctattaagttcctctcatagctctaatttatatattaaaataatcattctcctaatgttatatagattatttccagattttaatagtataaataaaatccttgtagacacagttatttgtaaatgtttgatttttaatacctaatacgtattagacagatttctactgcgttgaaacttagggtgatcattttgaatggcagtttttacaactgaagattttccctcctgaaaactttattttaagcatcttggataaatgtttcttaaaaaacattatatactttaataaattacttaacagcttaagttttccgtgacaacttggtgccatcattaaattataagcatcaatcttactgtgttgctggaatagtctcctccttaatggcttctatcactccagcctttcttgttcctgtctggcttctttctaaatatttgttttccttagtgtgttgcattgagtcatacttttctgcatgtacttgtctagacagtttcaactaccttcatgtcataaactatatcacttttgtgcgaatgattcccaaatctacagctctaaccaagactttgcatgaactttagatccctatatccatctttctggtgctcattgtcacaaactgttatcctttgactgtatcaaagacacctcaaaagtaacactagaatttaacttgtattcccctgaaattactacttgctcatctactttttctttccttcgtctcactctgtcacccaggctggagtgcagtggtgtgatcttggctcactgcaacctctgccttccgggttcaaaagattatcctgcctcagcctccggcatagctggaattacaggtgcccgccaccacgcccggctaattttttttttttttttttgtatttttagtagagatggggtttcatcatgttggccaggctggttttgaatgcctcacctcaagtgatctgcccgccttggcctcccaaagtgataggattacaagcctgagccaccacacccagcctgctttttcttttttttttgagatggagtctcgctctgtcgcccaggctggagtgcagtggtgcaatctcagctcactgcaagctccgcctcccaggttcacaccattctgctgcctcagcctcctgagtagctgggattgcaggtgaccgccacaacgcccagctaattttttgtatttttagtagagatggggtttcaccgtgttagccaggatagtctcaatctcctgaccttgtgatccgcctgcctcagcctcccaaagtgctgggattacaggcgtgagccactgtgcctggcctagcctgcttttccttaacagtaccatcatctatctagttaaggtgaaaatctttctagactcctacttagtcttcactctcaagtatattggatcactaagttctagccatgctacctttcaaatatttctcaaatttgttttctcctcttcatccctattactattgcccatatttaggttcactagtttttatcaggacagctgcagtagcctcccaagttccttttcacagacttaccttttcaaatgtgttttcatatcaagggcaaaaattgctttcttgggcatacatgtcatgctattttaatgcttacagacttttaatggcttcccattgcacctggagtcaaatttaactccatattagtctataattgtttctttttatctttctggcgttttctcctgctcctatcacacacacactcaccaagcttttgctatcaaacttctagcagttttctgactattgtgtgcaattttatgtgcatatgcatttgtacaggctgtttattctccctggaaagtacacagcccccgatacagctcgccctgcattttacccatcattgtaatgcgttcttagaagatacagtggaagttcactggtgtgacattattcatgaaccctgtcacccccagcctggacagaaataccttccttgctccatgtttattgagccatttatgatactttctgtggtagacaggataatggcccccacaaagttgtccatgtccttatccttggaacctatgaacattttaccttatatggcacaaggttctctctgaagatataattaagatgaaaggccttgagatgtggagatcatcttggattacccagatgggccagtctaatcataggaatctttaaaagcagagaacctttcttgcctgtgggcagagagagagatgacaattgaagaaaggtcagataaatttgactttgctggctctgaagatggagaaaggggctgcatgcagccaagagatgcaagtgcccactagaagctgcaataaaggtcagggagaaagattttcccatagagcctcctgaaaggaatgtagctcagatggcaccttgatttttagccctgtgagatcgatctcagatttctaacctacagaatgggggaacagagtttttttttttgttattttaagttactaagtttgtggtagtttatgacatcaatagaaaatgaatatactgtcattgcatcttctctgtcttatcaagttatatagctaatttcttatttttcactagatattaagctctttaaggacaaggactgtataattttattttattttattttatttgagacagagcctctctctgtcgcccaggctggagtgcagtggcatgatcttggctcactgcaacctctgcctgcagggttcaagcaattctcctgcctcagcctcccaagtagctgggattacaagtgcctgctaccatgactggctaatttttgtatttttagtagagacggggttttgccatgttggccaggctggtctcaaactcctgacttcaggtgatctgcccgcctcggcctcccagagtgctgggattacaggtgtgagccactgcgcccggcccgttataatttcatctctatcctcagaactttgcacagtgctaacacagtgttaaccctgaaaagtttgaatgtgtgaattaactaatatagtgttatttgtatcctgataatgtgttcagcaatccttgctacataccaaatccccctatttattttttgggttactgttttcactttttaaatggtgtgtttttttttgttgttgttgttgggggaggggtgcagggaagtctctttccttcttgttaactttttttctttctgctcctattttctttagccatggtggttcttttcctgttgatagtttgttgcttcaaatatgtcatttgcacatgacagtttaaagtagagtgacattgtatctaagtcccttttggatagaagtttttgtagtaaagctaagatgttgggagtttatgttttctcagtgtgtctttacaggcatgtacttcctttcccatagagaaatctgaacaagaattttaactttggtaattttattaaatgaaataaaattactgatttcgtctatttgttaaacttgcattccagtgtaaatcttatatgaataccagattcacttatcctgccttaatttgccaactataaacctggataaagtacaaaaaaacaactacatgaagacactagagagtaaccaacaacagtggtttctggagggcagttggtatgtggaagaccagcagtcactggatgagtttcttgtttttcatggcttctcacctgatagcaggcctcatgtgacagctggaagtccataggaagccttcagtggttatgacttgtcccatcaatcacagtcattggaacatgaagaaagagagtgccctgccaggggacatccctaattctgcatagaaattctatgcaaatcactgaaccatgccccataccatcagaatggggcatccacactaatgcttaaaactaaatagagattggtgctgccatcaagagacagaagtttgccatctgagtttagctacctggtaaaacaaaacaaaaagtcaggattctttggaggaatagaaaaatccagagttgccacaatgcccaggatacatctaaagttactcaaaatttgaagaaaccggaaagtgtgacccattctcaagagaccaactaattaatggagattggatcccaagatgacctacatgttaaacttagctgataaggattttaaagcagctgttattactatactcatttacacacaggaaaatctacttagaatcaaagctatgaaatctggcagagaaatagaaactgtaaaaaaatttatttgaaataaaaattttggccgggcgtggtggctcacgcctgtaatcccagcactttgggaggccgaggcgggcggatcacgaggtcaggagatcgagaccatcccggctaaaatgatgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaaataaaaattttacaggataagtttaatagcaaaacagagatgacagaaaaaaatcatcgcactgtagttcagtaagaattactgaatttgaagaacagagagaaaaggagattgaaacaaaatgaacagaacctggaaaatgtgggacagtctttaaaaggtctataatatgcatgtaattggagttctaaaaagaagggagcatgggaaagaaaaaaatatttgaacaaacaagggatgaacattttataaatttaatgtaggaattatgtagagatcgttgccgtttgacaaattaaaaggatgcttctttcacattgagcctaagaataatttaggcttgactttcttctccccaatgatctgatttatcaagcctgactgatttcagttgctgtagtgtttctttctgggtcttacagatccacactgttatgagatcactagattaaattgcagccaggactaaattgcacaaaatggtagaatatatggatggtggttttttgaaacatgccagggctggtttctttcggagatctgtagtgaacactggatctttttgtgtgtgctgcttttccctctgccctttttctttgctttcctttcctgctaccctcttcttgtttctgagaaagggcaaaaaggagactgaagcatttgagctagactggctacatcaaaggcagtgagttctattgatatctgagtcagctgcaacataaagcgactactggggaggcttttgttgggtctttactttttttttttttccccctgggtgatgttgctggtggcagtgctaggagtcagttggtaatgagtccttgccaatgtgccttgattgaaatttggaagccagattcctgtgattttaaccataacctttttagaaatgcatacttgtatgctcaacagccaggtagtatgtactgcggaagccataatgattgttacagttttgaattactgctcccgaggccctgttcctacttctttttgtcctagttgctcttgaaccaccccgatgatcactcttccctttcccacacggcgtctatgatccaacaaccaaagggttaaagtctggcatgccttcctcttttctgttttatctgactggcgactttcctcttcataaatactgaaatatctcccttccctgtccctgttgtgcctgtgcccatccttgtgtgtgctctagtatgtgttaaaaatagttgttagaagtccagttacagattttggaaggtaatacagtctagaatttaaaaaaatgagctttggatttaggttgactccagagtttataacttttgagcagtgtccttaaacaagttctttgagccctattgtccattttcttgtagaatatggataatatctattcctgagttttgaaacttaatctgtatgataagccttccacattcatatttattcctttgatttcattttggttttatcatagccagttatcctaggtcatttctaactctctagtttttgtataattattctgttttaaggaattaatttcaaagagggaggttagaactggtaggttcttgttcatctgtctttaccaaagagaagtctgaggctcagagttaaattgagctgctcaagcttatataactcggaagcagtgtaactagaatttaacctcaggcagtctgataccagagtcaggactattaacaaatttgtatcaacatctctctaacaataaggttatgtcggtttagaattttcaattgcttaccccgtccctttttcttcttttactagttctttaatttctaaggataggttaatgatgaaaccagagactaaactgtagttttctcctaaacctgcttgtaattacctttattgatctttaggcattaattactttttttatttttttgagatggagccttgctctgtcgcccaggctggagtgcagtggcacgatctcggctcactgcaagctccgcctcctgggttcatgccatactcctgcctcagcctcctgagtagctgggactacaggcgcccaccaccacgcctggctaatttttttttttttttgtatttttttttagtagagacggggtttcatgtgttagccaggatggtctcgatctcctgaccttgtgatccgcctgcctcagcctcccaaagtgctgggattacaggcgtgagccaccacgcccggccaggcattaattactttttaaccttgctgtatatatctgttctttagtaggctagagatcttttaaaggcaaatatttggatcttagtcatttttaaaaaaaattttattattattatactttaagttttagggtacatgtgcacaatgtgcaggttagttacatatgtatacatgtgccatgctggtgtgccgcacccattaactcgtcatttagcattaggtatatctcctaatgctatccctcccccctccccccaccccacaacagtcaccagagtgtgatgttccccttcctgtgtccatgtgttctcattgttcagttcccacctatgagtgagaacatgcggtgtttggtttttttgtccttgtgatagtttactgagaatgatgatttccaatttcatccatgtccctacaaaggacatgaacttatcattttttatggccgcatagtattctatggtgtatatgtgccacattttcttaatccagtctatcattgttggacatttcggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatggttgcctttctaactggtgtgagatggtatctcattgtggttctgatttgcatttctctgatggccagtgatggtgagcattttttcatgtgttttttggctgcaaaaatgtcttcttttgagaagtgtctgttcatgtcctttgcccactttttgatggggttgtttgtttttttcttgtaaatttgtttgagttcattgtagattctggatattagccctttgtcagatgactaggttgtgaaaattttctcccattttgtaggttgcctgttcactctgatggtagtttcttttgctgtacagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacatgtaagtctttaatccatcttgaattaattttcgtataaggtgtaaggaagggatccagtttcagctttctacatatggctagccagttttcccagcaccatttattaaatagggaaggatcttagtcatttttgaatcctttggcagattcagttttgtatccctcttcccatttgtactgtctagcactgcatcttattcatcataatgggcacacagtactttttattggtgacagtgatgacttgaataaaacctttgaaacaccagaataagcttttaaatttttgctcagttgttaagctttggaatcttggaattaagagaaacttaaagatcctttgatctttttcctggttaatcttctttaatttttgtccactgctatttttacaacatgatttttattttgtttaccatcccttcactttgttcccaaccttttaaaaattttatctgtgtctgtcttggtgggttcccagcatggaccattatatcctaggtttgttaagtaaatagtaatttggaatcactcattaccttctctgcattggatactacatctattattgtattaactacacacacacacacacacacacacacgtatgtaactcaatcatccgtgtattagtgcacaccaacaatcttggcacccattttatactgttgattattcatttgtgaacactatagtatattttacaagtgcttctgtgcttttctacctttatttgatgtagttgattctaaatatagaccttgcatatatgtatattcagtacttggtacatggtaggtactcaataaatgtttgagtgattgtgattttgaacttgcctactttgcgagccctccttcccacctttccgcttcacagcatcctcatattaccttgtgatctgttcctactgggccaccattaattgttcctttaaagagccatgagttatttgtgtctctgtgaacatacacacagttttatccatctagaatgacttctctgtcatccctaatgtattgtcaggcttttttcattctttcaacttctgagattgagatcagattacctctctgcagccttcctgaccatcctttctttcctaggtagaattggccactcccttgtgtcttccttgttttcatatctgtttctcttggaacatatctactttgaaggaaaagactgtatttttactgttctatctgcagtaccgaacacaatatgcctagtaataactgcttactgaattttggcgaatgagtgaataactaaaataataatgggacatttcaggggttgatatttcggcctgcaatcttttcggctctgttatccaacctgttgcccattagatccagcaagtttggtcagggtgtgctctctgtcctcatccagcttactgactcaagtgttgacggaggcagagttgaggaggacatttttgatgcctgatttctgatatgttcaagtactcaaatttgcacattttaatttctttgtatttttgtctcaataatgtgaaagaacaacaaaacttcaaaatgttgtgtgagtaggtggttcttaaactctttcttgggtgaatgaatattataagactatgttggaaaagcattcttatatttctcagggtaaaggaacttttgaggtattctatgaagacttattaaggctgcaagaagctgaaattgggaagcctgtctgtttttctagtctggccctcaatttgcattacatctttgaaatagcctgagtatactgtcttatggttgatgccccttttagacggtcagagtcttagcccttctagaggtatattgagattggaaaatcacactgtgttatgacttttcgtggttttagtagttgtcctctaagtttggactatttaaaatctctagtagcagatgagaggtaataactctttggaaacagactgagataaaattaagttttggtaaaatcagtcgtgatttgtagcttggaagaataggcatattagcattttaacaatatagctttgatgctttaaagaacaccaggctactaaagagatgtcttggttctctcagatgagttctgttgtatcactttcagatattttgttctttatccaagcaaagcacaacaagtagtttctaatatgaactggatttgtagaattttgtatgaagtctgacttaaaatataattaaattaacatttggggaatgagtttagtctttactaatttttttaggtcagagagcataacttctgtgaagctgcccccatttcacccttcatgcttcacaaatacttgtagaatattttcattgccttgcaattaggagtttacatacaggtctctcctaacagattgagagctccttgagggctgtgactaccagttgatctggcccttattaggtgtgtaaatttttttttttttttaatcagacttttgctcttgtcacccaggctggagtgcaatggcgtgatctcagctcactgcagcctctgcctcctgggttcaagcaattctcctgcctcggcctccccagtagcttggactacaggcgtgcaccaccacgcccagctaatttttgtattattagtagagatggaatttcaccatgtcagccaggctggtcttgaactcctgacctcaggtgatccacccgccttggcctcccaaagtgctgggattacaggcgtgagccaccgcaccaggccaggtgtgtaaatgtttaagaggataaatgagagatgtcatgtgcggatatatgtcctattgcaaccagaaagtgcctctattaataaggaactgcatataatagtgccttctagaatagatagacctgaggttagggctgtagttgctatgtacagtggatattactattgggtgttcctgtcagcaggattacctctttccaggtagttccagattgtgacaaatggattaatctggtaaagacaggtgctgttttaggtataaagtttagcattgatccctaagtttacttctggaatagctgctcatctggagtcatcatttgcaggccatttctggtggacccaccagctgcaagatacagatttattatttgacctgttttcctccagtgcaaggatactgtgactgttaagcagcatgcattaaataactaactcatctgttaataagtgtgcacatagactttggccagaacacattagacccctgaacagagaatcttaaaatactaatgcatttattttaggtggcaaagaactagattagtcaactaaaagcacatgaaaactgtcaactccagttttacaatctacatgccatgtcgatacagaacttgtgataatgtgaatggcatttttagcagagaattgtagtatttaaagacaaaagttcatgagtgttctgaaataatggtactttttctcaacctctcgctacatgggaaaggcagccttcaataatctctcttccaagtaacatatagggcagtactaaagaaaactgaatcagctggttgtgatggctcacgccggtaatcccagcactttgggaggccaaagtgggtggatcacctgaggtcaggagttcgagaccagcctggccaacacggtgaaaccctgtctctacaaaaaatacaaaaaattagccgggcattgtggtgggcacctgtaatcccagctactcgggaggctgaggcacaagaatcacttgaacccagaaggcggaggttgtagtgagccgagacctcgccattgcactccagcctgggtgacaagagcgaaactctgtctcaaaaaaccaaaccaaaccaaaccaaaacaaaacagaatctgcattcccaagagtccatagtagaggaggaagaactgccagtgcctttttaaaacgccagtttataagagttgtgcctgattctgtttcgatgctaataaaggtaattcactttcaactcagacatactgctttataaaacaaacatgtttaaaacagtagcattaaaacattatagtttgttttatagaggaataatctgacacctagagagattacgtggtttgtacaaggttctttcaaattcttaactagtttagaggctcacgatcggtctttttaaagtagcttttccctttccaaaatagcttttcttatccctccttgcctttcattttgtaactttataataaagtcagtatgccctaatcactttcttttgtttgaagtagccagcatgcatctgacagacatgcagttagacaaaggctcagtgctttaagcattgacagtgaagagagttcagtgattttatgttactttggagatgtggggagaaacagagatgcagtatctcaggaacattcaattttatgctttctctgagctataacatcatgactgcagttggttaagtttcagtgtaattttagtcattcttatccttattatctattcactttgtagcgcttttaaacaaacatctggcactatcttagttacctagttttatgtactttccacgtcccttgtgacttcatgctggcctcttgttgccagcctgttactgccctcattgtggaggaagctgagattttctaccaggctcagccatggaatagtgacaattggtgttcaacacaatgacacaaagcattacagcattataaagaactgttgaattgtttgaagatattttttaaaagtttaaaaatctgccttattggctgggcgcggtggctcacgtctgtaatcccagcactttgggaggccgaggcaggcagatcacaaggtcaggagatcgagaccatcctggctaacatggtgaaaccctgtctctactaaaaatacaaaaaattagccgggtgtggtggcaggtgcctgtagtcccagctactccggaggctgaggcaggagaatggcatgaacccaagaggcggagcttgcagtgagctgagatggtgccactacactccagcctgggcgacagagtgagactccgtctcaaaaaacaaacaaacaaacaaacaaaaaactgctttatttagggtataatttaaacacaataaaattcacccattttaagtgcttaggtcagttggttctgataactgcgtacgtaaccaccaccacaatcagcaaatagaacattcctatcactcccaggtttcttgtccttttgtaatcgcctccccccatccctgggtccaggcaagcactggtttacattgtgtcactacttttgccttttctagaattgcataagaatgggatcgcataataggtaatataagtctttgaacttatactagctctgtttattttttcaaactgatttgaatattttaagtcatttgcatttccatgtgtttttgaatcagcttgccttatgaaagactactggtgtttttattagaaatgcattaaatttgtagatcagtttgggggaaagttgacatttaatgatattaagctaatatatttaccatgtatctctctattttaaaagatctttagttttgtatttttttaagcaagtttttcggtcttcagtatacaggccttacacatttcattaaatttgtccttaagtatttcatggttttttatgctgttacaattatttgaaatttcaacttgtaattgtttaacaatgctatggtgaagaattggttagattagatctgagtttaaagtcatatactaggttaaaaaaaaaacaaaaaacaaagcaggaagctggtgcagtggtgcccacctgtagtcccaagtactcgggaggctgaggcaggaggatcacttgagcccaggagttggagtctagcctggtcaatatagtaagacccatctcttaaaaaaaaaaaaaaacaaagacaacaactcaacaaattttcaacaagttattgccagtctaaattggggtaatataacactcgttctggatttagaaataaaacatttaagagaagcttcagtgttcattccctgaatttcaacttttctgaactctttttgacattttaaaaaatgtagacaaaggatcttgctacgttgcccaggctggcctcaaacttctcaagggaggagatgctcaagcaatcctctccccttagcctcccaggtagttgagactataggtgtgcaccaccacacctagctttgaactcctcttagtaggaaactcttagaggatttacatattaagaacttctcatataggggaggaataaaattaatttccccacttgaactaagataataaaaaataaggttgtcatgaaaaatacagacctggtgctttaaaacattttagcatttgtagctgtgtatgaaaagataaatagcacttatataacagaaatgcataatgataaactgttgtttctagtaaatgtggaaacaggccatattactatgtatgtgacactttaaatatttaatatatgtgacatatacacaagaatatagctagagaaacagctagacatctgctaaatagtaccctttcctttaaaattactacacttcaaaaattcaaaaaatacacataggtgtttcataaaatcactgttgtaacagaatgacccacgtgctaataatttggtcataataagcacataaggagcacaactggctactttccctgaaaactgttacagtcaaaaagtaaattaatttagggaaaaaagactgaagatttcaaggtacggggtcctaaaagtaaagctactgctttgcaggttttgttaactgggcgcgggtgtgggggtgggagtaaagagtagggatgtaggcttacagacccaggttgtcaggagagcaatttgatgtggaaggcacaagtaagagaagatgtaaaccacgcaaacaaaaagtatttgaaagggaaataattcaattcagcaaatatttgagtgcatactctggaccgagattatagatagaatgaactataaaaagtccaaataaaccctccagagaatgctgagaccttggctttctgattctccacataagttaaataggccccacaggaggcccccactgcaacacgcagttggttcagtgctagattagtcatcgttagaagatggccagaattcagactgatctgaaaaaccaaagaactcaggttgcttcaaaaacccagagacagccaaagctcagaatcaactaaacatcccatgtcaactgaagaatgatggactgctttggtcatagtaagagggtcatgagaggggagggaggtgaagcccaacctcttgctagccaggggcctccctcctctgtagaaaacagagttaataaccactcgcctgagaggcctgtggtaggtcaaatgagatgccatctgtgcagcaatttagtgcacaggagatgttctgtaaacttcatctttcactgacactaatccagtaaacaggcatacctgacttgggataagcaacaagaaaaaaatgataatgggaagcaatgaggaaataaaatcctcacttcttacttgaacagcagaatccttaagaaatacagcccactcaactactagtttgaaagtttaaagtctctgtgatatcagttctttctctaggtgacttacataggatgaaaaaagtgttcccaactgtaaacatgggtttctgtatcaaacatgtggctgactctccatcagcaggagtagcagtggttaaaaaacacaagctaacatgttctcagctcttcctccaagaggtaaaagctcataagcccattattttcgtagtttaaaacatatattcctgattcctttctttccctctgccccactccccaaatgctgtctttaaatagtcagattctctgctaaaaatgccattcatgttgtcacaagttctgtattgacctggcatcagtgttgataattaattttcatgtgcttttagttggctaacctagttctttgccacataaaataaatgcattagtattttcagaaatatccttgcttggtgtataagagcaagaatgactgtctaagggattactcatgtcaggaatgttttatgattagaaattccccattagaaataaaatttttcattgaagcgattaacattaacaaaatctttaataggggactgcttagaatattgaagttttcctcatatctgtagaattttcacttaattatgacatatacaagtttttaatttgaagtcttcattgtttaaaacttttccttccaattttgataggtggtttaacaaaaacctaccaccttgtgtttccagtgtcattgttctcaagatgttaaaggcttagtattgtgaaattataacattgaagacaatatttattctcaagacaagaaccagtctaataattaacaaggtaactgacatttttaacgtctctgatcccctctgacacttgtgtgactcgttcgatagtcacataacgtgtgtgagaaggtgggccgtgcctgccttggaaatcattcctaacaggtctcgcatttgtccaggtaaggtcatccagctcagtaatgtcctcatttgtgtgagagcctacctgcctatatttagtctttccaggtggtttataattggtttagcccattggacagcctgctttttggttgatagaggctggggaggatgaaggaagtgtaaaggcttgaatttggcagtctctttgccggatatctattttaacccctcctgaagttaatttacataaaacccagctgtgtaagaatttttctaaatttaaagtttattcttattaccgtagggataggaatgtcagcactcactgaattatggccttcctctcctgtgtctggacctcctggcagcttatggttcccgtttcctttggataacaggatacagctggtggcaaaattctcacctgtggaatggccattgggagttttcttctccatatagatctttgcaaagcagcagaaaccatttttgcaggaaaccacaagcctgtgttaaacaccaaaagagaattgaaataacatgtccatgagttcctctttccagaggtaccaaccatcatgtgggatcctaagtatagtgttaagtagctctttgtcctccccttcactttgaggttgtctagttatatgatgttgaattccccagctctggtccctattacctctctggcagattaagcaaattgcttcaggctggattgcttaacacttagcagaattcatgctgcctttaatgagctaccagtttaaccttctggggctagagtgatttttagacatttttgttttgatgagttgatttttgtacttatagctataactgtggatcccttgccatcaaactatggtgcagcaaagcagctgatgaatttctctgtctctgatgttcatgtcaaacagttatttctctagcattcattgggggctcagtactgtgccaggtgctgtggcatgagcagtagtggtgtggagggtgctacaggagacatctgcaatgcagtagactagattaaaaacaagttggggagagaaggcaagcacaaaaataaaagaaaaatagaagatagtatttgacttactgctgatagtgtgggttagattatcagtgataatcctattaaaatcagcaagggtggagggcatgaacatgagcaaagacttgaggactggactgagcatggtgcatgcatgtgaggtatgcagggactggatggaaggtgtggtatggaagaaaagagtgctcagtaaggctttatagataatgagggaccctgaacactctttggaggcaccagaggggtagtgggggcatggtggatggcttctgagagctcaccaatgataaatggtatgtttaatagagtaccttatctgttggaatgtatattttcctcaccatcaccttttatttagaattagggatcgacacagtgatgaggatgtcctgagagatgtggtagctgaatgtgatagaaggttagtgctgaaaggctatcatgtaattcataacaggcaagaagaataggagcttactttattattttcttattgcctaccactgtgttaaacctttaactacacatctttaattttatgtattctcattttacagatgaggaaaataaagcttggtagttaagtaacttgtccaaggtaacacagccagtaagtgccacatttacaactcaattctaggtctttttgtctctgtctctgaattacgttagtactctaatttttatccttacattagtctgttggggtcatcaaatgattcttaaatactagaaggttgtctctaatcttaatgaggactctgcaatcatcctttcctttaataactattcatccaagtggcttgtctatcgttgttgtaaaataagtacgtttaattttttacagaagaaatgtagtgggcttaatcatgtgctggccatgtgtgtctgtggatgcagcatttaggaatatgggtcccagagtacagggctccatctttaagctctggaggttggaagctctaggaaaactaaggtgggttaaatgtgttcccaaaactgtgatcacattttatgtttatgcttttctctccctttctcgagtcatggtaggttactatttgagtgccatgccctagaactccctaaagtaaaggcactggtatcccaaaagaactgttctaaaagattacttacttctgtgaaggcagagagggtgctacagaatgaaaatagcattttaggaaggttgagtcagaggtgcgagtggggcatagagagattttctcagggtgataaggccctggtgctcaagtctacaagcagagacaggcacattggcagtgagtcctccttggggaagaagaatgatctgggctacttccaagaccccttctacctgtaagttcttgtaatttgggattgggattaagaaactccagaggctggtgtaaattgatggggcaccagctgttgtttgctgcacctcagggaagtcatggtgggagtctggcctggccctgttggctggggcccccaacagatccttgctgtgtctgggtttgagtttacgctacacaattacaaactttttccagtgctgctttttgtgaatctttgaacctgcagttgtgaatgaacagaaatttgaactgagcttaaaaaaaggaaaaaaaaaaaaaaaaaaaaaggcagagctttgttgataccactgccattatagggccatgatttcttttttccccatttagctgcaacacatttatttttcccttgtataatggctgagatttctttagtatggagctgtgtcacagtggtttatgtattttcttctctctccctgcctctgtttctaaggctgggcaactttgaggtatgtggattgacctggatgcctcttgtgactccttccccacgatcccctgcgtgcacttcctattcatctttgtagttctcagctactcactgtgctgtcatatctggcgcgtgctgttccttctatcctgtgcttctcctcctgtgtccacttggtggaactttccccatggtttgcttcttccagtaatctctgtctggaccccccatcttctagagagtttattgctccttcctgatccttgtaacatttttattattgtgctcatcatactgtaatatctgtttacatacatatgaccctttactaaagtggtaggaaccacatattatttattgctaaagctcaataacttagtacatgtaatattttaggggctcagaaatgtgaaattatctccctttattgagtttttatgtgccaggcacatattataaatatatgtcaagaaaaagataacctaaacacggaaaagattatagtgtactctcctacacaactttcaaataaactctaaaatgattataaggatgtcagagttctgattttttaaaactacatttaacttactattttaaattatttgtatttcattattgtaagagttctgattttttttccatgataattacattgatttggtgtttgtgcatgtgtttggcccaaactcaggatcatttatgccttttgggtaatccagcgttgataaagaataaattaaatgagtgaacgtgggtgttactgttttgtcgttgctgttgttttaatttgctatgttcttttgttttactgttgaatgttaccctgtgttagactcttcatttccttcatgtcatgcctgcctcctttgtcccactcccaacccctcgccttacccatttgggctcagtgctttgtgttttgtcttggtggctagtaagtaccatcatatgatagtggggcagagcagggctaactgttccgtatgagaatcagacacatattatgagtcttaacatcatttcccgaagtgtgggtcatgattccagagcaaaggatcaccagatttggtctcccgatttctactctttctggtcctgggaatgagaatcagccttatttaacaaggccttaaactgatgttcatgtgtactaaggttcaagaatcgctgcttaaaactaactgctcaattattaatgtagctgcaaacaaaagtaaagcattcatgagggtcttgtaagacttcctcagtcccttattcaggaaatatatttggcccatgtggtattttacttttttgatagaacttggcatcttcaacaggaaaagcgtatttactttttgtatcctggtcttcttccgttgttcagaatttctagctcatattcccagcctccccaaccagggcataacatttttatagccaccagcccaggctccgtgggttgaaggaaagagtttttggatcctgttattttcctggaggaagagctgaacattgactcttttacaagaatccaaagtatgcattgtcatttccatgttaaccctcactcgaaatttttgtgggttttgaaggattgactgtagcccagtcttagcaggatccctggccatggaaattcatttgaagcacattgtgccatggaagtaccctgcaggtaaaaatgctctatttatacttggctgagtcccagacagctgctgtctgcctgttgggactgggagcagatgtaggggtgatctgccccctcctatttttttgtggatttggaagcttccctgttgagagtgacaaaaaccctgtcaattgatgtggtaggtatgtcagacctggacagctggtccttagaaaatatgctgagatcaccaagttaacaggtacagaagggtttccagtttgttatatgatgttgggcctgtgactccccacccccctttttagggacatgtcattaatggtggagcgcttgttaaaggcttctcttgtagcatgtgtaggtgtggctaaagaatagtgaatttgattgatgttaatgtacatctggatacattctcattttaatttttttttattggttctagggacttttggtaaagattgtggatgtcttcagttttacacatttaggaaacagtgtctttttacttatttccagtacagttgtgatgtattgaatgacaagggactttaaaacagacatgctgtgtataatgttttcttcctgattaaaaagtaatatctgttcattatttgaatagttacaattaagaaacagattatttagggatgaaaatttcctgtaatctccagagatatgtacacttaacattttggtgttcgttcctccagattcttttctatgattattgtattatattttagaattgtagtttacccaccagcgtattttaagaagttaccagaaaggcgtctctgagtatctgaagcctttcatttagccatttatggatttcaaagtatcttatgtggggttagtctccattgagactcaggaactctgcaagagggagaagcattggcttctgctatgtgcctgtcagtgtgctttaatactttacctggatcatctcttccagtaaccccacagtataggaagcattattatgctctttctgcacataaggagatgaagattcagacaagttaagtgacttgctcaaggtaatacagttaattgtagaggacttgggattgaatttgatttattgtctagagaatattgtatggcaccctattactttcctgtattgagatgtaggtggtgggggtgggggggttaagctgaaaatatctgtgagatgtataaagctgttggatagagacacaccatttctttcttcttatttttttttgagacagagtttctctcttgttgcccaggctggagtgcagtggtgcaatctgggctcactgcaacctccacctcccaggttcaaacgattctcatgcctcagcctccccagaaactgggattacaggtgcccgccaccacacccggctaatttttgtattttttgtagggacatgtatagtttcaccatgttggccaggatggtctgaaactccttatctgaagtgatcagcctgccttgacctcccaaaattctgggattacaggcgtgtgccaccgcgtctgtcctaaggagacacactgtttctctggcttattaagaggtatttggttagtatataaacattttcgtagcttctgaggttttgcagtcatttgttcagacatacgggttggtggaaatgctttctgttccttttcccaaaccaatcacacagccatataacttcatgcctgagtttctctgtggtcctctatagtgagtggtttttacatagttctttgcagcagcatgaatttcaaaaatctccaaacttttgctattgctgatctttgtaaactttgcacacccagcgctggtacattctgatgatggtgtccacactgcactttatgaagaaaagactgatgattgtttatattaaaatgtaggaagagaattgtagcagcaacttttgcttctctaatcaacaacaccagaagagacttactgtgtgtggtcagtgggggagaatgttaatttataaattgagatagttgtattaaaattgagtgactcttattttgacataaagtgaatgtgtctcttttatacagcagaaaactattaaatttgttttttctcatcagtataaaataaagtggaaaatgtgggaagaatacaaattcttaacttctgtgcttctgcttatttcacacccctcaaatttctgattcctttcaactgtagctggctttactactgagtggtgaaattgctgaacatacttaaaaccacatcatttaagactttgaattttgacatttcctcctcttcacagtctttaaatactaggcaacctgtagggttccactgtgtctgtcatgtattgtccctgtgttacatgaaagcagcctcagtgaacttgtgaatttgctcagtcatttcactggctactgggtgaggaagaagtaggattttctctcttaaaattccttggtgaaatcattggatgggcatgatgtgtttctttaattttcattttggtaaaaaaatctactgacaaagcaaagactttcagttgttcttggtctttcagtaggtttagtttttaagtgtgtttactctgaccaaaaactgccttcctgtaatatgctcctccctttagaactcagttcttaagtagagtttgtttaaatgtataaaataagttaatgcattatatgcagcgaggttttgcatcagaaccctgagttctcaatgttgtggcaggtttaagtgtctagaacaccttttagctgttatttctattacttgcttttttatttttggggtaaatgatatcttctcagggaggccttccctcagcaccatgttttaaagggcatctccctcatttgctattccttcttctgttttatttttctctatagaatttgttactgtgtgaaaactatttattttaatgttttatttacctgtgttacccctagaataatatctatgaaggtagggatttttgtctgttccttctgtgcctacagagtcttgaggagtatggtgtctggcacattgtaggtgcacaatgacagctgaattaacaatgtcagggagagtttgtaggatggggctcgaggtatagggcaagtcagtttttagatttgaggtcattagcaggagatcctcttacgatgtggggggaaaaacacacgttttaacgtcagactgggtttgaatctggtctctccaacttaccctttgaccttggtgttaaatgatttaacctttgaaagatcaatttttttcactagtgaaataggggaaatagtatctttttagtggggattaaatgtaatatcaaatataatgctctgtaaatgttagttttgtctttcccgttgtgtgccagcattgtggaagtctgaaagcaacctgaatttaccagtctgtttctggagccttctggggtcattactttgattacttttgacagatacattcttttcagcagcctgtgttgccagcataacaatgacctgtccctttgaccagtgtgagggacagacactttgtcatccctcttttaatccttgtatcagaacaactcttacgagttctggttttgaaacatgtttagaggagtttataattccgaacagttcagatgacatcagccctttcttagagccctctaagtttgctcagcttcctcattccagtgtggcgggaaccattcagttaaattgatgtttgtggtctttacacatagtcatccgaagtttcttgcaaatcacgaaacatcagagggctgctaagtcactagtttgtctctgtagatttctctaatccaggcttgtccaaaccgtggcctgcaggctgcatgcagcctgtgaaggctttgaatgtggcccaacacaaattcgtaaactgtcttaaaacattggctgggcatggtggcttacgcctgtaatcccagcactttgggaggccgaggcgggtggatcatgaggtcaggagatcgagaccatcctggctaacaaggtgaaaccccgtctctactaaatatacaaaaaattagccggttgcggtggcgggcgcctgtagtcccagctactggggaggctgaggcaggataatggcgtgaacccgggaagcggagcttgcagtgagccgagattgcgccactgcagtccgcagtccggcctgggcgacagagcgagactccgtctcaaaaaaaaaaaaaaaaaaacaccaaaaaatcagctgggtgttgtggcgggtgcctgtaatctcagctactcgagaggctgaggcaggagaattgcttgaacccagaaggcagaggttgcagtgagccaagattgtgccactgcgctctagcctgggcgacagagcgagactccatctcaaaaacaaacaaacaaaaaaattatgaaattttctttttttgcaattttttttaaagcttatcagctattattagtgttagtatattttatgtgtggcgcaacacaattcttcttcttccagcgtggcccagggaagctacaagattggacgacactcttttaatttttgtggcttaacaaggtgttaattcctgtataaatttcactgatatttcttctgcttgatgcaggaacacttgacaagttagttaaggtagattggtccataaatttataggttctttcattcccatgtcctaggcaagtctgagcaggccctggaaagctgattaaaaggccagtgagcacagtgagcttaattgtaaattaaatggatatttaatacattaagaaggcactcaagcctttcaatctttcattttcatccatgcttgctgtttgaatctgatgggcttgaaattgactttgttcttctaaaaatgttggttggttattgctgcctttctcaagcttggttttcagtgtggatttctgcagataatttttgcacctaaaagtacaaagtcattaagtgaagatagtcaggaaggaaagagtgccctgagccaggaggtctgttatagcgcatggggtggaccagagaatgaatgggcatgggcatggaggtggttcagtcagtgtgggaaagccacttgcttgtcagttttctactgcgttgtccagcagaacacgttgaagcttggggcctgcaactggtgtggagatgattgcatttaggaggctgatgtagatttttttccctctaagtgtgtgttaactgccttttggtgaagtcttgatccgagacatacacaacttgatctgtgaggattgtaatatcgagatggttctgttatttgagttaggcatggctaggctaccaaggcattgcttttcagtcccaacagttggtcatttcaatttcagtgaggcttttgtgatttgttagaatacaaagtttgttattttgtctgtgtttttgcatgtatgaatgacactttatactgttattttgctggttagtatgtgccttcatttacctattgtgagtaagaaacttcctcagatcaaattatagtaaagtcacttggttctgtttctctgactcttaagagattgagatcactttatactcaaactcagggtgtttggtaaaggacctacccttctgagcatttatagcctagatgaagtcctggtccaatcaccaagttaaacttttaagaacatgctattcttaatgttcaggaattcaaccctggaagccttctctaaatcttaatgagatttttatgagaattcatttagtgaacataacaatcagggaatccagctattaactttgaggagggtcatgccttttagtggttagagaggcaagctgtagcctcccttctcagagaaggggaattgaggaagagagttctagtggtcccttgcaatcctcccctcactttccaggctccctagtaagactgcaagaagtccctgagtaaacagcattttgtgagtttgagggactacgtaaaaatgtaagtgaacatacaatggttttgctttgataactgttttaaatatcctgttggttgttgaaacttctgtgacagtgaagccttttgtctttatttttcaatcggaagatctttcttccccacttgaaaagattgagtctgggatcaattcctgaccccgcttccttcctaaatctcttagtgtatagcatacagctgggcatatggtaatctcgggcacgggattgtactcacagagctatgcttgacacctaggactttaggtggcttatatattttcggtgacaacttttaattttattctcatttattccatttctgtttcagtgtcctgggtcatgaaacttaatccacagcaagctcccttatatgtgagtaaatcatgagatttcttattattttgtgtttatctgttctgcttacttgttataataagccacactctcacatgatagatcctcaaggaaaattttaaccatatgtccatgaatatattggtgtaagacacttcagaaattgagtttgatttagtaaatactaaatggctaatctgtgcatggaaatgaaaacaaataatacctgtaagacttgagagttaatttagtcagggtaatagtatgcatgtatgaaacaaattgtcctgccaaacagtactgtagcttcttattttttacctgcagtgcattcctgtaaaagtagtgtggagatcctcctactgccactgtgatttaccttatgttgccactaggtggcactatgtcattggcaagagtactgttttctttaggactcatctccctaaagtgagggacttccctcattcagtgggttgtcatttcactttcttgatgctatcctttcaagcacaaaaattttcagttttgataatgttttgttgttgcttttttttttggcatcatatctaagaagaattctttgcataacctaaagtcacagagatttattcctatgttttcatctaggaattgtataggtttagttagctcttacatttaggtatgtaatgtgagagttcatttttgtgtattttgtaagggaagagtccaacttttttcttttgcatgtggatctccagttgttccagcaccatttgttgaaaagactgttctttctcccattgaattgtcttgggcatccttgttgaaattgatcagaagtgtgaggaattttttctggactctgaagtcgattcctttcatttaggttgtttttgatttctttcaacagtgtttggtagttttcactgtataaacttggtacttccttgaaatttgttgcttatggttttattcattttgatggtattgttaattttgttatcttaattgttcagttcttttttttttttttttttggatggagtctggctctgttgcccaggctggagtgcagtggcgcgatcttggctcactgcgagctccgcctcccaggttcacgccagtctcctgcctcagcctcccaagtagctgggactataggtgcctgccaccactcctggctaattttttgtatttttagtagagacagggttttaccatgtttgccagggtggtctcgaactcctcacctcgtgatccacccagctcccaaagtgctgggattacaggcgtgagccacagcacctggccaattgttcagtttttgattgttcattgcttatatatagaaatactgttgatttttgtgtactgatccctgaaactatagccttgtgtcagagatgagttacaaactataatctaacttgtttggccacagtttttaagtggatgccttaggattttctctgtacaggatcaagtgatcagagatcgttttcttcctttccaatctggatgcgttttatttctttttcttgcctaattgccctgagaagcatgtctggtacaacattgaatagaagtggtgagcgcaaacatccttgtcttttcctgatcttaaagagaaagcatccaagctttcaccagtaagtatgatgttgttaggtgtgggtttttcacaggaatcttttgttaaatgaggacattcccttctattcctagtttgactatttttatgatgaaaacatgttggattttgtcaggtgatctttctgtgttgagatggccatgtaggtttttttcctttcattaatgtgatatattacattgactcaattaaatagtttttatttatttatggagatggggccttgctctgtcacccaggctggagtgcagtgacatgatcatagctcacagcatcgtggaactcctgggatcaagggatcatcccacctcaacctcctgagtagctaggactacagatgtgcgccaccatgcctggctatttatttatgtatttattgagacaaggtcttgctctgtcacccagcctggagtgcagtgacatgatcatagctcacagcatcgtggaactcctgggatcaagggatcatcccacctcagcctcctgagtagctaggactacaggtgtgcgccatcatgcctggctatttatttatgtatttattgagacaaggtcttgctctgtcacccaggctggagtgcagtggcgcgaccatgactcactgtagctgcgatctcccaggctcaaatgctcttcccacctcagcctcctgagtagctggaaccacaggcatgtgcacccatgcccagctatttgtatttattttttgtagagacgagatctgactatgctgcccaggttgggctcaagtgatccttccacctcggcctcccaaagtgctgggattacagtatgagccatcctgcctggcctgttttaatttttagagataaggtcttgctgtgttgccaggctaccttggttgaatttttaatgttaaggcaacctggcatttctgaggtaagtatcatttgataatgctgcacaatcttttttatatgttgttggatttgttttgaaagtattttgaggactcttgtgtctatacatagagatatgttctatagctttcttgtgatgtctttgtctggttttgagtattaaaggtttttggttagggaacagttgtaaataagtagttgtgttatacagaaggatggcttccccaaatttattcacttcttaatccctagaacctgtgaatatttaccttacatggcaaaaagaacttttcatacttgattaagttgaggatcttaagatgggagcttattctgaaatatctgagcttcccgttgtaattacaggagttctcatgagtgagagggagtatcaggagagtcagtggtcagagatttgaagatgctacactgctggcttagaacatggaggaaggagcccatgagctacggaatgcagctctagaagctggaaatagcaaaagaacactttctccacatagagactctagaaggaacacagccctgctggcaccttgatttttaaacaagtgaaagtcattttggacttctgacttccagaaatgatatatgataataaatttatgttgtcttaagccactgagtttgtgataattttttgtaacagcagtagaaaactaatagagtagtagtttgagaaaattagtgataaaggatacttgggaaggaaaggataaatgcagttaggtcagttagaaactctctgatcttgccatcatggagcctgagaactttagagttagtaaatactttagctaatatatgcttcaacctctcccttttagacatgaggaaacgaggtctgaagatgttgtgataagatggcacagctaattggtggtaaattgtgaattgaacctttgttttctggacttaagtcatagaaaccactgtaaaccttgttaagctttaaaaagtttcattctgttagggaagcacagctcagttctgagtaacatagttaatacactaagtgctttgtatatgtttgtgtttaattgacttgagcaggctctactgaagaatacttctttaaacttcaggattcaagtatgtccatcaacagtaatacttaatggggcaatatgttatctcctttttaaaaggagagtaacagtgtattggattctcagtgaactgagtcaagttgcagggatttatgctgttttggtgaggaaaagtagctgttttatgatggctcattgagcagggtggtgggggaagttctctgcacctggacaaagaaataagcaagagaacaaagactgtgaagattttcatttagatcatatttgggatctgccaggggtgagtatcatcattagaagggagaatattgctgctaaataaggaaaaacactgtacccggagaagaacttttatctgtcagttaagacaaataggctggactccaaataaatattttaatcagactttgaataaagatgtgtccagaatacgttgcaatagttaaaaatgtaaggaaggttccaaagtgtacaggtggcagtactgttggatgtttcaattaagctcttttaatgaattattttcaatgaaatgttcaccataaaatgtgcaggaccctggcctgaaactttggagaccagtagctcaatatggctatgccttggttttcctgtctgttagctctgattgcatgagtacaacctttatgttaggcaagctagttacatcactaagtcgggtttttctcacagtcgccacaaaagtaatgattattgccagatgaattcataagaattgcattttcagttccatttagtggtagtgctaaaaactctgagtagcttagtagtatccttcttggtatgagggcctggattgtttagagagaggaaagatggagaggcagtggcagatgcaagaaatatttcaaaagaaacagcagggccaaatgctttattagactatagggagtgaaagagaaccatgaatgacagttgattgagaacttgagtgtgagtgacagctgatgccatcattgggtatagagaagaaggagatgatgatcttgttctttacacatgttaaataaagtcacatgggtatcctgttcataggtggaggtgtgtgcttgaaactacagagcaaggaagttggttttgaagtgaaatcgtttgagtcttctctaagaaattgattcttttgacaccatgtgactgtaagaatagatgagctctttgagaagctaaaagagtggatggaattagtatagtggactgtggtgtagaagacaaagtgagtcaagaaaggagttccagaaacctgggttgcattttagccttaaacattttgttcctggtgtttcttaatttcacttatacatcaggattggaagtaaactttgggctggagctgggcaatttattcttttattcaggtgccttctttgtgccaagacctgttctggatgctggagatttagccatgaacaaaacagaaggtccctgctctcctggtacttgcattgtagtgagaagaaggaagacagcaagataacatatcaggaagaaaagttctatgaaaataaatgaaatggcgatgtgattgtgcctgaccaggggctgttttatcttgggtggtcagggaaggcctttgaggggcatgtcatttaggctgagacctgaaggagccagcatgtgaagctcctagaagtgttctagcccaagggaacaaatgcagaaactctaaaatgagaagtagtaacttaatatgtttgaggaacagaacagtggctggggcttaatgagtgcaaggggaaggggtccaatctcttctgcatgaggttggagatttagggaggagatgaggaagaagctggatcttgtaggatttaacagaccactggataatctccctgggcctaccttccctcacatctgaaccctactacagctcctatccctgtgtgtactcagaaaacattagagctccttctggcttgaggtcaagtcagacctcttagggatactgggatttatcctaatgtggatctgctgaccctgggcagatgggattcttagatagtttaaacatacatattttggactacccttttgaggaaaaaatagttttagtcctttctagttgtcattaagatccacatttagatataaatggatgttcttgaattgaggaatatgtatatatttatatatatttattatatattatatattatatatattatatattttatatataatatatatattttagcagatttggctcttatgagaggacagtgtaataaagaatacttctttgtttttatattgtttcatggctggattgctttttgggaggaaaaaaactattttcaaaacttggtactgttactccatttgtgaacctgaataagtggtgtataatatgatttaatagtagtcctttcattctctagttttctgtgggtactttacctgcagttgtgtaattcatttgcatcacctgtaacctttctagttgacagctccttaaaaacaagagctcatgtttgcatagtacctcatagttaagaaagcacatttgcatgccttacgttaatgcatgcagtgctcacagcagtgttaccagtcccagagcagagaaagctgcatcgttactttcgtcatacataaggaaacataaggttaagacggttcatctagtgaatggcagaagtggggctttacccagaaatggttactctgaaattcattttcattcttctatataccaagatgtcttattacaaataccaagtccacaactgttccataagatgcaaacatgtcatagcacttaatattatagagacttgcagaaataaaatccttttaaagaataggtaacccaagtttactcttccatttcatgttttaaaagatttaatgggttttatttgaaataactccaaggccaagcacagtggctcatgcctgtaatcctagtaccttgggaggccaaggcaggaggatcgcttgagcccacgagttcaagcctgcagtgagctatgaacataccactgcactatagcctgggctacagagcgagaccccatctcaaaaaacaaaacaaaactttaaatgtacagagaagttacaagaagaatacaataacttcacctctatcaactcttgttaaatttagtcacatttgcttattctctgtattacatatttttatttattttagtcatttgaaagttgcaaacagtatactctgttccccttaaatatttcagcatatatttcctaagaatgaagacattctgcttcataaccacagtataattaacaaaaaacaggaattgtaacattgatgtaatactcttacatgatgtaagtctatattcacatttctctaattttcccaataatgtccattatagcacccttttcctttttcaatccaggatttaaacacattatatctctttagtctcttaattttattttgtagcatgttttgtcatgattttggcaatggactacatgagtgatgttcttggagtatcacattaggaggacacatgatgtattcttttccaattattggaagtgttaactttgataccttagttaaggtggtattgaatctacataatttatctgttccagaggaattgggcatataagagatggtatgagtagttgttcactttccccctctaaagttgtttctggtttggaggtatcttttgcatattggattttcctaaaatggggtacccttgttctgcgcaaggtgtacccttgaatataggcgaaagggctaatgtcaacagagagctcattttgagtgataaattgcctgaggtttaagggggcgttgtctctgcctttgtggatacacatggttatttaagaaatgtaatactcagctgagctataatgaccatttttaatatggaacatagtaggcacttagtaaacattcattgagtgagtgaatgaactacagtttagataagactactaaaattttaatgaaattcacttcattttgacagagctacttttcttaaaattgctcatttgtttcccaggtttcattcattaatctgcctagcataggccctgagtagctagtgatgtcacctttgttactgaaggtgtggccaacagggaaatgaaggtgataaccttgtctttatggtgcatgtggaacctttgaaactgtaaggaaatccttacagcatccctgtgaagtacagctgagtgtgtttgatagttttattacagagatgcattctgtgagataatatcttacctagttgaagaagcgtactagaaatagtgcctatatctctccagtcctgaattatcttagttcttttgggagttataatctgagccatttgtttatagcaagccatgtgactgcttctattttttatgaacatagtacatgccccctttgtctctagagctctcctcactgtcaagatacaaagcatagtcttgtcctagacggggtaagggacgagggatgctgtcagatgataaaagaaaaagccaagcacatgaaggaaaggttggtattaaaaaatgtattacatttcttaaataaccatgtgtatccacaaaggcagagacaatgcccccttaaacctcaggcaatttatcactcaaaatgagctctctgttgacattagccctttcacctatattcaagggtacaccttgcgcagaacaagggtaccccattttaggaaaatccaatatgcaaaagatacctccaaaccagaaacaactttagagggggaaagtgaacaactactcataccatctcttatatgcccaattcctctggaacagataaattatggagattcaataccaccttaactaaggtatcaaagttaatgggctctatctatcaccactcccacactctaagccctactggatctagcaacctagcaactagactccagaaacagtaaataaatcctccctcagactaacagctgaaaaggaaacaagagttttagacttctgatgaaggaggaggaaagggtctttggatgccccttatgtcaggccccaggcttagtctggaagagatctgtctaggccaggcctgaagctctgcaaggtacaaggaaataatagctgtcaagaattaggcgacgtggatgaatcccatacttgatatgccagagaaagtcacttcctctgtcctctcatcattttactacacccaagtgaatgtcccacactcagttctacatgtaggaatggactttatgggagaggtcaggactggtgacgaatttgatgagtcataggaatcattgtatgttaggagtggttgagcccagtcttccggaagagtgaggatattgaactacagagagagattgagggaagttgcctgcagtttcacagcaggttacgagaggtctgaacaggtagcagaatctgcaaataattagcttatctggtgtacaggaggcaggtccctaattggtttgaatttaatactcaaagtacatgcgcagagaagttatagtataagattcagaacaaatgggctaagtaagagaaaaaaatgtagcaattggaagatgaagaagagaggaatattcaaaaagatagcattgtgctcctttcttggtggagtgaacaggtgaggattatactgtctttatggattataggtacattggaaaatagtttacagttattatttgaaattcctctatagtgaaggaagtagtcaagataaaatgtgttttgtgacttttgatataggaaagtcagtaatagccatctcaataaagtatatgctcagctatttcatctttatacttagagattcctcaagaggatggttacacattagctctggatcagtgagagtaagaccaaggccctggaacagtaaggctttctcttgtaaagctcagttcccatggttctttgatgctttttctgtgttagaataatgttctttactggtttccaacatgtttcggtgggcattggacccttgtggttaatgatctgtgcagctgtaactccagagtggctggctctacagaacactgactcagatggcttgtattcgatgctgataattcactaactaaaacgactataagaacacatttcaagaggagaaatttggggtgcatatctcagattcttcagttataaacttgcttttttgtgtctcttaagatttatggtctattgaacacatctctgtgtctccctcaggaaagccaaacagcatatttttgcccctgcaaattaaacactttttaaagccagtgagttactcagatgtgagatttcaattttttccaaggcatgctcgaaggtaatatatgggataataatcattacctgccatatgtttgggataaaacccacacttattagattttcaaggggaagagccattccaattataaaacaaatttccagaaccccaacagatctggttgattatgtcgtccttcctctcttgttttctctcagtaccaaatgtttttgcatgtaactgcttctgggaggaggcaaaacatcctgataatagaagagcaccataagaaagaattatctggcactagatgcctttctttatttaaaatgtgcaaaacaaaatctccagtgattttaaactgtttctattagaatagggaccgttccttatgatattgttctgttttcccaaggaaaagttagggtgctattattggttgagaacctactcttggcaaggaaacatggccagcacttaatacacattacctgatttaatcatgacaatagacatatagggtttggttattgtatccactttacagccagggtggatggtagggttcgcatcctgtgagtggctacaaagcacccccacctccttttttccctcaaaagcccatttaaagaagggaaatcagaagagcgtatccactggacttgcatttagatcttgagaaaagcttatcagagtgattttctaccaccacattgggttcctgtttactccagacttacattttcagcctccgtgaagacttggactttgcgcgtagattaacttgcttctctgtttatgctaattaaaacagacctcagaagacgagcatgcaaacggagatactgtgattaggaggaggaggttttaaaatttttatcagttaaaaaaatttattcctgaacaagtgtagtttgcataaataatcaaatttttgaagggccacagaaattaggttacctcagcttagtgttctcagttgcctccttatagggaagactaatttggtaatggcacagttttatcgttcttcctaggaaatgcatttccacagcaggctctgaaataacctggctgtgcttctcacttggctgttaggatacattttgcttatacaaagagccttatcagcctcctgatctcttaaatggattacctgcctttgccttaacaatacatttctgataggtctgctccagcatctgtgggctggtggccttgtccagccagatctgagacctgccagaagaataaggaaatcaagggttcctccgtctagcttttgatggttttacagagcaggaatttcagtttctttctgttggactttttaatcagtttccagaaacttgctttgaatttgaagttaatgggcttttcatttgtaagtagtattttctcatttttccttggcatttttagaacagacaaaggtacaaaggtcaaagacttttcagagcctttttacaggatactttttcaataactgggtgtttgccaagctatcacataacagtgaggggattaaaatttccatttggtactagtgaagaggagtcttgctgtccaagaaagattaaaatatatcactctgtacctttaattcatttaaaacaagtatttgtgaagcacctattaggtgaatgggacatttgatcttagaggaatagattctttcactggggaggaaggggctcagatgcatgcgtagataaattacagtgcaaggaatacctgttggagtgctgctagacgagctgtgcaaacagtgattgttcatggcagggagagaggaatggaatattggcagatgtaattgggaagctttcagaaaaggtgggggctctaccagcctggatagataggctgtggagactgggaagagcagagtgagaggaggaagcacagtctttggagtaaggcatggaagagtgttatcagttgtggggagagactttgcttgaccagggtgggcagttcacattgaaggatacctggagatgagattatatatagctgctctgtttagtaatgtagtcattagccacatgtgactgtttaattaaagtgaaataaaattaaaaattcacttcatcaaatagtgctcagttgctacacatagctagtggctaccatactgattgcagatagaaaatatttccatcattgcagaaaattctgttggtcagcactgataaaggaagtatggggttttacacaggataacagtgtgaagagcaactggagatcttttgaccaggcaaatagtagcatgatgaaagtcatacccaaaataaagagtagaaggagagcagtgaggggctgtcaagtaggtaggcctatcacttcaccgttacagcacacagaatgagatctggggatgatgaagctgttccgcaggaagaacatatggattttgtctggtagaatgactgaaaacctcaaggagccacagaatggccactgagggttttagtgtgagggacagagggagaatggtgtagcatcaatgagcaaacagtttggaggaggagctgccttggaagcctgagggagaacagtcatgttttttacaacaatgtgtggtagtaaggattaaatgaagtgagatatatatatatatatatatatatatatcacattgagcgagatcatagataaaactttagatataggtggttttaaaaagagacgtacccccgttattttgacatagtgcatgtaaagttacattgtgtggcttcgtcttgcatcttctgcataaatacttgcgctgagagctctttcccttgttagcttaggtagcaactaccttttactgaacaccttccttgtaaggtaacttactttatctcctcacccatgtgagatccattttatagatgaacgaacatagctaggaagaggtgaagcggtaattcaaactaaaaacttttgctcttcccatttcatctctgcacgtgaggatggtttcactatcagctccccaggttgatactattgaagcttgatgcttacatcacatctacatttagaggttgtctttggcactgaactctatttaccatctctttttcaaatgtaagacatacatcctataaaacttgcttactctcagtggtaattggtatgtggggtgacctggaatgactgccatctggacttctctagggcgctggctcttggtgtgaggtccgcaaccagcagccacaggcatgagcaccactaggaacttggtagaaatgcaggtgtttacgccccatctcagacctaaatgccagagggtggggcccaaaaagtcactttaaaataagcccttcacatgattctgatgcactccaaagtttaagcatataaaccaaatgaacaaagaggatagttttgaaaagcctcctatgaattaaattggaactgtatgggtacatttacatttttcaacacggctgactgtgtaacccatcagcagtggttgcctgtaaagatgcatgggaaagtgtatatattaagtaagatattatttcagaaggacagatctatggcttttcttttttaaaggctagcttcctgagtaaattatcactgcgttattgactcagaataatatcaaggtgtgtactatcaaatacagggttgggtatctctttgtaagagatagcagtgattttcagtggataattaagggaattagcacttcacatttttttcatgatatttttatgtcacttagaatttttcacgaattattccttgtatgattgtagataattaaagccccatatgctttgcagtagtagcagcagcgcagattatgatgcagatggaattggtaagagcagtaggttttgaaatgaggttgtagacgggctgctgagactgatttttggacagcataaatgaaagcagtattctgatgtcagcatttggagtttaaaaatccctagccatggatcccgtgctgagtcattggtacttcaggtaaaccaattccaactctatgtaagctagccttcagccatgtgaaactgttaacggcatctcttcctctctctgaactgcacccccgagccctgccaatccctaacacatgcataaagaaaaacacttatctttcaggattcatttcctgccacttgtctctgtggagcccctcctgagctttcatcctcctgtggatccatcactcctactcctatgccccggctactctgtgcagactttgtaataagagcttgagcacttcagatgcacatttgtatgcatgccttttccgtttattatgttccttgagggtaggggctttgtatttgaattattattttattgctctcatttttacttcagcttctatcacagtactttgtgcatcataatgctagtgttttttattgtttccaagtagaattaaagctgttctttgggaaagggtgttgcctcatacatggatgattataaatgtctgatttgccaaagatgagagttttctttttggttaggatttatgaccccaaagggaaggttactgtagttcatcagccaataaatgaaaccacacagggggattttgtgatctgggacaatgtgtcactttgctttgatctttgggtagagcctctaagaggtgctctcctagtgaaaacctggaactgatactaggtgaaaaaccggatttcaaccactgtagcctagtgcttccgtgtggtgtgtgggtatttacttggaacactctgtgtttgcttcttactacacaaatctcattttattggtctgacaaacctatgaattaggtttgagacaggaagatttatattttaaagttctagtatgttgattgtaacattttcattgctctctttggaaattctgtcacctgagatgagactattagctagattcgtgaagtcagcccactgaatctataattcagaaatctataaatagctcccttcaagtacaacattgggaacatttatttatatcagcacggaggtagaaattacatttttctggaggatacacgaatttattgattgatcggttggtgatgcacatctttagtactttttcctcattcagacacatttcccccccagagattctgcttatttccttttggatccttttatgtgggggctgtaacttagggtatttatctttaagtatagagaatgtcacctgtactcccagaaatgtgtttgtttgttaccctttttaaaccaggaaagagctattggctctggtgtctttggagcccttcacaaagctctgtgtctggattaactgttgaccccatgtgatatacagagcatctggcggctggggtggaattctcagctgtctctctttgttttgtccacagaaggaaatgtgagttttatcttactgctcaggcgatggtacattccttttttggttcatgggactaccaccaatctgattgtgggagtatttcctaccattcctgtcatcttccggaatttgttaaagaaggccaggggtgatcttcacctaccatcactcgtgaacaccattttcttctcaatcacctcttgtgttcctaaattctactttgagtgaagtgtattattgtgtagtttgtcctgtcttgtatggtttagggatcccaggcagcataatattaagaagctacaactgtgggtatttcttacagccagtattgttcctccacaaatcctcattttccagatccctgtgaaatttattatattcttgccaccatatactcgtgattatgtgttgcccatatcttgctaagtctcagaatacaaagtaattcttctccttgaccgtgagacagagataggtgtttttaaaaatgaagtaccgatatttcagtttttctggtgagtatgggacgttgatttttcatttgccatactgtatatgtgtgcatttgtatgcagtagaggttggcagaaatgtgtattgtgttcaaacgctgatcttaagcctctgtttattccatacctgctagtgcttatccactatgctatatgtcctacattaatttttctcatttaatcatcttaatgatctcatgagataactattttttttctacattttaaagcagaggaaagtatcagagaacttttgtcacttgctgaggtcatgcagctagtaagaacagagttagaattcaaaccagacctttcttcagaaacctaggcttttaatgatgtcagtatattgctcctctgtgtcagcgtttaaccctgcatggtgtagggaagaagcgggctattgcctaggatttgtgaaataaggatgttggtgagattattaaagtcagaaggaaacactgaaaagtggaatttgttgggaagaaggggaaccatttagggacagacactagacctttgtggtaactggtacggcggagcatggtgctgtggggtcactggttctcaaacttgagcatgcatttgggtcaccaggagggcttattaaaacccagattgctgggccacaccccagagtttctgatttactaggtttgggatggggtgaaaaattgcatttctggtaagttcccaggtgatccaacactttgagaacccatgtagagaaagtgtatgtgcttaggagtcaagtagacacagctttacattcctgccctactgtgggaggcttagagtcttcatcttaaaagttctgtaatatagggtagtatgtatattacaggatttttcatgagcactacatgtgatttagaaagtgacagcaatatttggcaattattgaatacttactaaacatcagttactttgagaagcatttaacatatgtaatttaatcttaagcagttaagtatgtcattcctacatgtaaaaatcttaatacgtatcagttgctcagttaatattcctgcacacctttatcagtaggccttcttaggcctggaaatgtgtaatatcccttagaaagattttcataaagttggcttatttctttaaaaaatgtcgacacttaaaaaggaaaacttaaaatacgtgtttttgtgaaatggttttactggtaacactagataagaaaagtgataatgtctgaaatgatagaattttcttctgattacttttgtggttaagtactgtgggttgtttgatactcatgtaactattcgttagaaatcagaaagcttaaccagctttacaaaaaagctggtttaccgttaaaattaattagatggattttcttctcctaaatttccatatgacaccttttcagacagtttctttcgtaagacttatttgccatttagttaaaattcttcacctattattaagtaaaaccaaaaagtaatcaattttattaccatactttatttggctctgtttgagaaatagtgtgttttactagaagagattaagagaggtagagacatggagattatgaaatgtgggatgtttctatttacttgggaatggatgggaacattttctttgtacctagtgtatgctacgtacttggtataccttgttaaaatactttagtacttactttatgtcgtggtaaggggattaaatggcaaccttaatttgtgtaagacatttaagacactcctggcacatagtaagcatttgatacaagagccattatttcatgcatttcagatatgggattataataatttccatcctcttagagtttacaatctaggagttcttacagggaatttgaggtagctcctaaaagaatcagcagttttaaatacacagctggtaacaagggaagctggtattctaagtcacgtgatttcaaagcctgtggtcttcctctggtactatagcccccaaagcaatgctgtccattctgtattggtaccttcccttcttaatcttgtagttgacagtgtcccacttcccaactttgaatgtctcttttccatggtctcagcatgttgtaccctgggttaggaatgatgtgtgaccagaggtgattcaacttgacctgctgggctccgtgacttaggcattgctggtgcagagatgacgattgtgcaaacctgatggactcatggaatcagagggcaccttgatctgcctgcagtgggtgaggcatagtatgtattagatcaggtaaaggaggcccttcatctgaggaaggggcccaggtttctacttagaaaagaaaggcattgtatttcatgctttactctctcgctctaatcatcagtgtgacagataaagggagcagcatggccgagtagtgagacaggtaggaagagtgagccttgaacatgtgttcatgaattctcaggggcttggtatacttgtagcaaagtgtttgaggagaggctctgtgagggagatgatgctggaggggtcagtgagggctaggtttgttgggggctttgtgtgctgtgtgttgaagggacatgctcaggcatagggctttatcaggagagtagcttgatcagattgtattttggagactctgtgcttcccagtgtgtggaggccagcttagaagcctggagtcccaacttaattgatgactttggagaaaaacaagagaactgaggataataaataaccaagaaagctaggtgaataactgtaagatataggtgagagcagaagtcagatcttcagattttaatgacagaatgtcaccttttcaatcagcaacaaagtagccgagtataatcttcaaccatctgctctctgggagaggagagaggagaggggaaggagcgaggaatgaggagccagagagattgattttagctaatcacttctaactctttcattaaatttttatggagaattaatacaggctgggcgcagtggctcgtgctggtaatcccagcactttgggaggctgaagtgggaggatagcttaagcccaggagttcaggaccagcctatgcgatgtggtgagaccctgtctttacaaaaaaaaaaaaaaaaaaaaaaaaaaaaaaaagaaaaaattagccaggcatggtggcgtgcatttatagtcccagctatttgggaggctgagacaggagggttgctcaagcctggaagatcgaagctgcagtgagccatggtcgcaccactgtactccagcctgggtgacagggcccaacaccctgtctccaaaaaaaaaaaaaaaaaaaaatccttacatgtctgcattttagccaaatatatggttttgttagcaaaagagagaatgtctctttaagtattgacctaattaataattctaccacttccagagagttgtgaaacatttttcagaggtagagacactctcgcttgctctttctcgctctctctctcttgctctctcgctcttgctctccctcgcaccctctccccctctccccctctctcccatctctctctctctccctctcttttgctctcactctctgtgtgtgtgtgcgcacatgtgtttgaaagccagcaccatctgaacaatttagctttgctggacaaaaatagacttgagagggagaattgtacattgaaacaagaagaacttacactcttacaatttttcaacactctcttccttttaaggaatacttctcattaaagggaccatacattaaattatatccaaacttgagtagttttaatttcttttctgtctgaaatccctgttagaacaatctctaaaactactccatagacacagaacttgagtagatttattgagcgccatctgctggctttgttttaatggaccaaataggtggtgcctggacatctttaagaattatcctgtatcttagtgttgcaaaattatgaagctggaagacagtatgaatttgggctatgactggtagtagtatttaaaataatagttttgtgttggcattgagaaaggggtatggttttggcaggagaatacacacaacctgattaaaaaagaagacaggttatagggatttcattggccagtatctttattgggcaaaagattagcctagtttaaataaaaagtaaccttaaatgccaaataaaattctttaatattttctaacagtgaagtcaacctaagtctttatctggaatgactttatgtaaaagtcgataaatttcttggtggatttctattcgtgttgcatgagatactttgaggtgtcttttaaagaaagatttataaaaatggctttgttggctagtttcaagaatgcgttttattttgagggatgtggatactatcttagtattttcctgctgagacagatataggaaaagcccctaggttaaataaataagggtgaagctgttaggtgctcttcttgtcattagtctttttgaattttagttatattttaagtgacttcttaagggcaactgagctaaaaatttggcatacccagaccattagactctagatcttttaattaatttctcatccagtcatcttaagtatttaagatgaattgtagaaagattgtcaggccgggcgtggtggctcatgcctataatcccaggactttgggagaccgaggaggtgggcggatcacttgaggtcaggagttcaagaccagtctggccaacatggtgaaactccgtctctactaatacagaaaaattagccgggcacctgtaatcccagccactgggaagactgaggcaggagaattgcttgaacccatgaagtggaggttgcagtgagctgagattgtgccactgcactccagcctgggcaacagagcgggactccatctcaaaaacaacaaaaaaagaaagattgtttacagaaagagagaccagaaaggaattcgtgcattcatttggccaacatttattgagcacctagaacaacgagacatacctttaggcaatgatgtagcattgaataaaacaaatatggtcccacctctcaggaagcttacgtaacagttgggaggaaaggggaactcagataaatacataaatacatgcttttagaattttatatatacatataggtataatatataatgtattaaatagacatacatgaataaatacgtgtcagaaagtaaatgatgctatggaaaaaataaagcagggcaagatagataaggagagttagggtaggagagctcatacttcattgaggatggtcagggatgacctcactgctaaggggacatatgaagaccaatggttattagtgttatataaaacagttgtttatgatcgtcttgcctgaccttcaccaaccatgtacagaaagcacatgggacagatgatgttattaatcgtttcatgggcccccttggtctagaatataaaggctgatccttggcactgctttatgcccatgttccctatgctgaagccatggtccgttagtccttgaatacaccgtgtttgttcagttctgtgccttcgtacatactctcccctccttggagtgactttatctcttgtcttcctagtcagctcttacatggcttttgaaattcataaattttactttctctgggtagcctttgtagtctcctctggcaaattttcttccttctctttctttatcttctgttaggccatagcacttttgaaatgtttctatttatagcacctgttatatcactgtaactgtatgttggcatgagtttcttctactaaatcagggggtcttaatctgttttttgttgatgtctttgggggtgtgtgaactgctggaaaactgtactaaaaggttatattagactagtggttggcaagctacagcctgtgaaccaaatctagcctgctgcctgtttttgtaaataaagttttgttgaaacacagtcactcccatttctttatgtattgtctatggctccttttgtgctaccaaaaaaaaaaaaaacataagaaacgagtagttgcagtagtaaccatatttcccacaaagccgaaaatatttaccatctgagtcttcacagataaagtttgccaatcctgatattagatgaaatggggattaaaaaggaaacatttggtgttgtatggcatgaagctgactgccttttccttgtgtctagaaaccacagcaaagacagaacaagtcacctaacttcaagtttctctttgccccaagacagagggcatgacattcttttagtcaaccaatttggatgtcaccaacacctgatgacaggtggtggtcgtgtggccaagaatgggagcttctggggactggtgtaatcagcttgcttcctttagaactgacatccccaaagcagcggcaagtgggagtaggatatgatggcagtagcacctaatcaccctcctccactcccacacatcagactggtggtgctccctgggcacaggtgggcacctgctggaaaagttttcagtgtgcttcttctgagacttgcccatgagggcgtggcaggaatgggggccatggatcctggcaaggatatattcctaaactgtccttgatggtgtaggtccctcctccttttctctgtggcattttgctttgtccatttgatgccatatctttacagatgggtttcagcaagatattctcaaagcatttcaagcaggaatgagccctgagtaatattgatggagcctctcttttcctcaggcactttgtgtaattttttttttttttttttgagatagggtctcactcttgtcacccaggctggagagcagtggcacagtcttggctcattgcagcctcgacttcctgggctccagcagtccttctacctcagcctcctgagtagctgggatacaggcatgcactaccgtgtctggctaatttttgtattttttgtagagatggggttttgctgtgttgcccaggctggtcttgaactcctgggttcaagcaatccacctgcctcggcctcccaaagtgctgggattacagacgtgcgctatcgtgcctggccttgtgtagatttttttaaaggtaaggggttgaagtggggaattccagccctctgacgggggtggtggtactgctggctctttagctgagtcctctatcgtgtttcatctggaccactcttgatagcttcctaagtggtctttctgtagtttccttgctctgtcctgttctccgcagaggaaccacagtaatcctttgaaacatgaatcatgtcactcttcttttcaaaaccctccaatggtttagcatcacactaaaaaagaaaaagaaaaagaaaaaaaaatccatattccaacctcgccttccatccagtgttcattcatttgctcctccagactgacctttgctattttttgaacacgctgagtttgtacttcccttgcactcgatatattccctttgccttgactgctttctttatcttcccttaacttgcttcattcaggtttcagctcaaatttgccttccttggaggagcttttccagaccaccctgtcaggaaaagtatcctctcatccctatttcagacaaactttaacccctttatgctgtcttactctttctaatagaactttccctctaatgttactttctataatttgtcttacctgctaaaatataagctccatgagggcaaagggccttgtctttcatgtttgaggcctagttcttaacagtgtctgacacatattacagtaagttttgtaatgaatgaattcattttgctgacaaaatgagtttcaagtggttcttatcaggggtctgtagctattaagtgactgattctgattctgtttcccagcctccatttttatatttcactaccatgtgtggcggctgataccttgttaccgagtagcatgttgcatttaagaaatagtgagtgctaaataatattaaagatttttgtgcatatgcttgctttgtaatggtattgatttcccagagaaacgaagctactcagagccattcatgctactttgaggtaatactaaaggaccaacagaacaggatagctctgttcagtgatttaggattttagatttttttcttctggtaggatttctgttttctagcttgatggcaataacatcatatatttacgttctcatcctaaggagccttggggtactgctttgctgtgaccgtgccttatgaatttgtctttcattttctagagcactccactaaattaggcagcacaaatgtaactcatttatcctataattaaattttgtgatattctccttttgaatgaattccgatgtaaggaaggccaagggatagcacttcagggtattcacaaagttagaaatacaaggtttgtgtttctttggggtttgctagtgttacatgacattttataagcgtcattatatccagtgtttagaaactctcaggtctgagagctgaatggttttggatttagtttgtagcctctgtcacctcctccgacatgtcacccctgtccactggttgcaaatatcatttctttcaaacataatttgaaatcaggtgagagagaatcggtattcctcaggctccttccaggtgacctgtgtttgagaagactgtgggaggcctccctgccctgcgttttgctcaggcagtcaagggcctcctctaatccctgcagtccctggtccttgcttctcttactatgcttttgatacagctgcaattgttaccttatgtgtctttttccctgaagaggctgtgtacaaagatgaatgagatgcagtctctggcccagcttcactgtaatggcataagctttcagagagtatgcgcctgctcgaggtgatctgtcttgagctttgagcagcactgggcttagacatttctccacagaagtctttttggtcatattcttcaaggtagagtttgggcattcatctccctgtacctagagaagtcagtatatgtattaatatagcatttgttatattactaataaatgtataattatattagtaatacattttattgctagtatacaattattgaagtaataataaaaggaaatgtttaaagtaacaaaatattttcagatattttaagactcatttacctgtcaacatgatttcatataatgtttgtattttaaaaaatgatcccagtaatggatggcagttctatatgtatatttgctagcagtaagtcatttgaaaatcctttaattaatgcaggctaggtttccacctgattatcacagatgaacaattatatcttgtcaagattgtatcatcctgaaaggctttcatagttaccaagggtgttattaacaataggtggttaaaataaagagaactctgaaatattttaaatggtgtggaattgagtgtatcatgaatctgggaagggatcattattttggtttagcaaatgagctttctgaaacatttgaaatgggaaacaagtattttaagttttggctgcagagtgctcacttgtgactgccattaatagagagagatatggcaaatcccatgtttttaggtggcgcttgagtttgggttcctcttgggtccatagggccatttctgggttcaaggcacaggaatagatagatgaaagatatgttatgaaaaaacccatttaaggctagagaaaaaaaaaatttctgagtttgttgcttttcttcagacgtctctcttccattgtttgttctgaggatttctttttaaaaagtcattccttttaatgctgcaagacttttatatccttgcctcttttggctttgctgatcctctcttctctgatttctcctcttctcggactggcccttccttgtttggcctgtttctctggatccatttcttcttactgccttcccttgctggaacaccagcgtctagtcattggctctctattaccacaaactcatctacagtcaaggttttagttcttaacttagtgcaggttgactttcagatctgactggccaggctagcccttttttgacagcttgccctgttacctacctgttggatatagaataagtacaaatatctatcctgtctaccctgctgatacatgaaacttaagattcaaagccccatcatcttatcacaaattattcccacaagccactagttttccttagagatacccctttttctcttaattctgcttgaggcttactatcttccagtcccatccagtcacttgtcatatttcatcaaattattattattgttaatttgagagacaaggtcttgccctgtcccaggctggagtgcagtggtgtgatcatagctcacttagtctgcatctcctggctcaagagatcctcccaccttggcctccccaggggctgggagtacaggcatgagccactgcgcctggcccaaattatttttaacagaatttttttctcacatttattatttttttagattggtagatcttgctaccatggcagttaagcacttttaactttctcacattgtgtttttgtattattttctccaaatggtttctttgtctctattctttttccttcttaggacgtgactgtgagagaaatctttctggaatatttgctgcctttaacaccccctcaccccccatttttctttcagtatataccacataagactgtctttttttttttcttcgtcgcctacacaggttcaagtatgaatcttttggcttgccattaatattcggcataagctcatctctgccatctttatttactcagttatggaacaacttcctaatgctagatgggccttgtgtgaagtttcaaaaagacagtttttgctttccataagcctcaggtggtgaagagaaacatgtacagcgcagtgcacataattgcacatctctctgactttgtcacacgtttggacccaagcaacacgtttgggtttgggtttaccgtgagtgtaagcagacctcttgcttctcctcccttctccacctccagactcttccatctttcttgttcttagcaccctctttctcctataccctgtagtccttcgatgcctgcgacttgcttgctatgtaacatgttccttctatcaacaatgatctctttacacgtatctcttttttccccacacctaactgtgtctcctcttaacttcaaggtcaggatatagaggaaagaatacagacttaggaatcctacttggatttgaattcccgcttgaccccttctagctttttaaaggcaagatttaaaaaatactctcggctacagctttctcatctctaaaatggagataaagataccttgcagtatttgcaaagcacctcagtcagcccctcacctgcagtaggcattcagaaaatgcagtagtatgtgctgactcatcttcctttctcacctttaccatgctcctacagtgttgactatttttatgtatgtatgtatgtatgtatgtatgtatgtatgtatgtatgtatgtatgtatgtttttgaggtggagtctcgctctgtagcccaggctggagtgcagtggtgtgatctcggctcactgcaagctctgcctcctgggttcacgccattctcctgcctcagcctcccgagtagctgggactacaggcacccaccaccatgcccggctaatttttttgtatttttagtagatgctcctgcctcagcctcccaaagtgctgggattacaggcgtgagccaccgttcccggcccagtgttgactatttttgtaattttagtttagtgataaaaacgtctgtggtgttgtattatttatttttcctaggtcctcgggtaaaaggcgcttgtgtgagcatggacaggctccatgctctcagagtgaggctgaaggaacttctacatttgctgttaatgatagagctttcttcacatctgtattgatagggcttcccacaaccccagcccttaatttattttaaagcctttttacagttttttgtgggaagccttggaggttttacaattttttatttttatgtttttaaaacttttaatgtggacataattccaaaatattaaaaatattaaaaaataattttataaagagttttccaaaagtagtacaaagaatactcatatattctttactcagggcaacacctgttgttaacatcttacgccatttgctgtatcattttcactctagcgatttacctgtaggccgacaatttttttccttaattatctgtcagtaagttacatgtatcctggctgtttatttcaaaaatgcttcagtatgtatttcctaaaatagggatattctcctttgtaatcacagcagggtagatactgctctttagttgtcatgtctcttagccttctttaatgtggaacacgtccacaccctttctttatcttctgtcttttccgattttgaagaatacagtgccctctcctcttgcttaatagactgtttctcattgtccgacgtttccttgtgattaggttgagggcttgcatgcttggtcagagcactgcataggtaaccttgtgtctttctcagtgtgtgactctggagacacatctgtcatctgtctttattgagatctttattttgattaacctgttcagtgtattggcagatttcgctgaatgaattctcctttttttttctttcttataactaataagcagtctttggggagacacttaaagactgtgtaatatgtatgctgttcctcatcagaatctccctctggattgagcattcattgataactttttgccagagtgaatctttaccatatgtttgcgcagtgataattttactattccagcaatctcccctctttaagcagtcagcccgtcattctgtgatactcataggaactcccttctctgctgtataatttatctactgttattaatatggactcatgacttcctatttgttaaaaaaattgtttataatttattgctgttcttgattgtgtagtctttaaattgtcccaggtttgtacagaggaagccacttgagtctggcttctgtgtccttaagacatggccccatcgtttttttgagcacttcattgttttctgtcaaaacaagatattacagtctcatcttatagatactctgacccaggcctggaatcagccaagtctctgaagggactcggttctttttattggagaatggtattagtgaccaatgcctgtacactagataatattcattgctactgagtgttcctctgttgtgtaagcctttaatgaaattgaacactggctgccatgagttgccaagttaaaatgccatgactttgccttttagcctatggaaaagttgtagctacctgtcagtgtttggttgttttagcagagtaactgggcaaagtgttatcaattgcctatcaattgtatgtttaaaggagagaacgaagatagttatgtgaatacaagcagtgttggttaatgagattttgaggggttttttttttttggtactgtaataattgccacctcatggaaaggtaataccctgtaataacactcagtttttatttagtttacttaactctcttgtttcacttttcccaaatttgcagtgggtataaatcctgtcattttgtcagactgggaaataaatttgggaaggcctgtgaaacttttaagattctggattgaaaggtagtttttgttataatttcacaattcttggagcctacaagaatgtctttacataaaatatgtgactgcaagatataaaaaataaactcaggaatctaaattttataccttttaacttcaaatatttgattataaattatttgagcagatatttcttggaaactattctgaaataatttcaagtttatagaaaagctgtaaggatagaacagatattacatcttataaactttatgcccctattttccaactgttgacattttgccatatttgcttaatcattctgtctcttatcatttctttcctgaaccattggagagtaaattgtaggtctcacgtccctttactccaaacgctttgttgtgtggtttctgagaacaaaggtgttctttcataaccacggcacaataccaaaaccaggaattttaacattggttccatgttaatctgtaaacctcattcagattttgcaagttgtcccgataatatccttaatagcagcttgtttttattaagtattcactccaaaatcatgtgttgtgtttagttggcaaatctttttagtcttctttactctggaacaggacctcaatctttgtcttttgttaatgacattttctgaagagttacagaccatttttttacatagatgccccttcaattcaagtttgtctgatgttttctcatgactagattgaagttatgcatttttgttaggaacactgtaagtgatgctgtgtccttagtgcatgctatgtgaaatgtgatgttagcttatttctctatggttatttttccttttttttttaaatcatttgattcaggtgttatctgccaaagttctgctttcccctttgttatttataagccttaagtgagcatttctccaacatctttgttgtgtttttaacaacttctttaacattttaaacatcttttctgttgtccaatttttaacaacaaagatgttaaaaatcagaaaactcagaaaagcacatggtgtattaaaattccacctaggaataactgccattaaagttttggtgtctccctttctgtctcttcagatgcaacttactagtctagacaaagcaggtttctcagtgaataaaacatgctctaatggggtgtacatcctggcacattataatagtagtcatttattgaatattatgtgccaggcacttgatataggtgctttccttttatcaatcacttaattcttcaaaacgaccttatgagataaggttgatgattcttgtcctccattatggcataaggaagttaaacaacataccccaagttaaacagatgtaaagtgatataccatactgtgataaagacacaggcaggttggtgtcagagatcatcttcttaatcacggtgatacactaacaagttataaactaacaagttaacttaaagtggtgataatactgaactgctgtgaggagaactatgatgacactgttacctataacctgtgatggtttgtacttgactagggttttgtcttatagcaagacctccattctttccgtaagtggtgatgtctcttaaatgggcctgccacggccttccttggtcctccctgtggaaattctccccttttcccctctccttcccttctgctgacctgttctcagtggtgtgctggttaaaaagaaaaaaagaaagccctcatttatatcatttgccaatttcagtggtgtaaatactcccataatggttgatttcaggtatccacaccacattacgaatacagatttgacaagagatgtgagttgtgaagacacgcagcaggacaccattatgtggaatttctgctgtctggatacaatagatacaaactttcagggcatggagaatagtatgttgtggtaaataattagaaagtgataagttttgagtatttatgacatttgtttttaatgcagtttacttagttataagcctatatcatgtaatttttaataatggctgagtttaacagctgtcttgcagaattcctgaaaatttaacaatgagcactcatgagcctacacaagccagctccagtataccactgtgatttctttgctgctgactgggcccacctttgaaaatctatggctgacacttccttactatctaagatgacatcagtgccatcctgtctttcactcttcctcctacagggctttctatctcattctcctaatccatatctactaccttccctgttcaaagcccatttctttccattcatccctgcactgtaatttgactcttcccatcccccaaatacgtttccctttcccatcacacttttttttttccccccatcaagttacttttcccagttaaaggaaagcctcagaccactagtatcttgggacatggagagtctcccagcaagatgttgggtcttatgaagtgaggaaatctttggtctagaaaaggaaaatacgttcttagaattccagggttgaaatctaggtgaaaagatttttttaaacttaatatataaaggaagttacagtgccattattatagtatgtagctactctaagaattacttcaggatggggaaaagtgagaccatggctaccatttaaaaccccattttaaagtaactgttttataaaaacctgtttttatttgcaaataagtgatttgataggtgatattttagaacacagtttatttatatgggggtggggggagctaacctatatttacagaataaggcctagtatagaggtcttttccattagtttttgtgtcatctgtcagcaaaactaattaggaccctgaaaaaattgtcagttgcagggatacatttctcactaatgaagaaacatggaaaatatctgtgtaaggggatcacgctgtttcttaagttcagattattggaagagggtggtgatgtaggtgtgtactcttcctgaggttgggtcaaactaaaatgataattgagaatgtcttgaatattgcccttgttaataagttgatctattttattttatttagaaacatggcagacttgttcactgtgtagccagactgatgtgtctatttattcttgtaggctggtctttcccaggcacagcagaataatttattaataccagggtattctttaaggatggtaggattaaagcatcatgacaaaaattgttacctagatctgtttttccttgttattttttcatcaccattctactcatttaatctttaaaagccatctcaagtaatagtaggtacctggttctactggagtaaaatgggagttagtggctgaaatgcagtttgttatttgctgtcagtgactttatcagtgtgcagagaatactccttcaaggaaaacaggtaattttaattccaggtgccttcggaatctaaatttcaagaggctttgaaatgaatggagcttctgtgttctcttctcttgaatattttgggcataaggtagtgtgacttaatattaaaaacaaacaaacaaacaaaacaacaaaaaaactacagaccaggtgcagtggctcatgcctgtaatctcaacatttttggcaggccaaggctggaggattgcttgagttcaggagtttgagaccatcctgggcaacatagggatacctgatctctacaaaaatttaaaaagccagaagtggtggcgcatgcctgttgtcccagctacttgggaggcagcagggggaggatcacttgagtcctggaactgcaggctgtggtgagccctgattgtgccactgcactccagcctgggaaactaagtgagaacctgtctcaaacaacaacaaaaacccaattaaaggtatgaaagcaatttaaaacttacttgtaaaaagaggttcatattgaaagcattgctaaaaggatttcatctgcctataattagccacctcctctgtccccaaaggaaggcccagacttcactagtatcttggggcacagagagtctcccagcaagatgttgggtctcatatgaggacaaaattcttgatctggaaaaggaagatatattcttagaataccaggttagaaatcaaagtgaattttttttttttcctgtaaaagtccagatagtaaataatttaggctgtgggctaagttctcacgtaatcattaccttttatggcccattgtagtgcaaaactagccatggatgatgggtaaatgaatgggttgggttcaattaaacctttatttattgacagtgaaatttgaatttcatgtaattttcacattaaaaggattaaaaggccttctttcttccctaaccctaacccccacacccgcccccacaaaatgtaaaacaggggatggtgggaggctggaattgacttgtgggtcatagtttgtcaacctagtcatagtttgtcaacctgtgctgcaaaggatggaactttttatttgtacttttttcaggctgtgaggatatttcagtaccttgagaaatggactcttctcatacacgctgcaaaaacatctttttaactggttgcatcatgccaaagaagattacacattttaccaggctaagcttttcaaaaatgtttccaagagagagtcttataaacaagacagaagtctaattctgagtagtaactgaagtcagtgataattctgttttaccagccgtgatattccttggattaggatactgttgaatgctccactgtggtagtcgtagtagtcatggacccactggagcattgtttgttaatagacctggttcctaggtttgacttgatgatttttgctttttagtgtttagtaaaaaactaccttctgctcagttatgctgctgggcttagtaaattgtgaccacagggtggtatgtttctcttgttggctttaattgttgctaaaatcgaaaggaaaaatattctgtacataatgagaatttactcccctaattatgatgctaaaatggcccagccttctctagattgatttttctatagtgcattattaagatttatatagtattaaatctcagtgctttaaaccttgatgctttgtaatcttttgttatggttacaacaggaattatatagttcgtaattgggagaatgctaataattaggactgtatttcatagaatatatttagccactggccttgatttaaaaaaaaaatcaatatataaaaactactaaagagtatttgcggctgggtacggtggcttactcctgtaatcctagcactttgggaggctgagacgggtggatcatctgaggtcaggattcgagaccaacctggccaacacggcgaaaccttgtctctactaaaaatacaaaaaaatttagctgggcgtggtggtgggtgcctgtaatcccagctactcaggaggctgagacatgaggatcgcttgaacctaggagttggaggttgcagtgagctgagatcacgccactgcactccagcctgggcaacaagagggaaactccgtctcaaaaaaaaaaaaaaaaaaaaaaaagcaactgaaagacaaagatgtcttaccttctagtagttgcaaagtcatagacaaagttattggctcaagatttttgtctgattttatgggattaatgtaggggtggataaagaagagtaggaatgtcagatggtcaggaaatacaaattattagaaaagcagcctcctattgaaataggttaaaaatattatagaccgagagttgaacatgttccaggagctttcctatacagtcatgtgttgtttaaactatggggatacgttctgagaaatgtggtattaggtgattttgtttgttgtgcaaacatcatagcatatacttaacacaaacttggatgttgtagcctgctgtgcacttaagctggagcccaagctcgtcttctttgcactctaccctttccaggcaagcctgttgctggagaatgtatggacttggtaatgatttatgggatatagaatttagagaattattgtcaactggaacacaggagttaaggagcattctgagtataaggatgtgatcatttattataccccctccatcctctctgccttatttttggattttcttctatgtctccccctgcccctcccctttttaacccattcatcaagtaaagttttccttcatcttgttgattaacttacttgtctaatgacctccactaaaatgtaagtttaaagaagagagagcgatcttattttcaggttcattctgtattgtgaatgcctagatgattgcctggtgtataagtgctcaatctttatacttgtttcagcttaccagaatgggggcatggtttagatgataaatttgattttcccttaaatatgatgtttgataaagataggctgcgaagaggaaccttactaatgtaaacttgctatattgtttcctttcctagggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtaagtatttgaatgggatccttactagcttttcctagttcttaaacccttttattcgatgtttatgagtatagagtgacaggaagagtgaagtgtagacagtataaaaaaatttattagtttataaagcagtttgaatatctggtcctgctggtattggaacagattgccagttttttattgctgtgccattttatgtatattactgttatgtcggccacctaccaaattctgtaaattataacttatttaagaactgggattatgacagttgaaagctgtatttatcctcctacttggcaaaaatgatgttgaaaattcaaggatttaaagattctagagagtctctaggtatattattgccaaatttttatggacagggaataaaagaaggtagtcagcatagataccgatttcttttctgaagagtattagatatccttccttgtaacccacagctccagtcatcttgtttcctgtgatgtatatcatatcagaaaggcttttctggaacttgaggtctgctctctagcaggtaccatccagtatcaccattgctgaacatttattatgtgttggtgatggggagaaacagcttcttaacctaggtataatcgatcagtccgtgactcagttctcattaggaaaggaattgaggtaatttttataaacataatacttcctataataggaacactttagggttaaagttcgagggctgtgtgtttatatacctgtgtgtgcatatatatctagaaagggcatataagtagatacaaggagactgcaagcagatataagggaaaaggcaaatacaaaaagcatggcctgtgtcctaactgtgatcctcagtcacaaatcccaacaaagtctgttctattggtggagagggatgtacctggaagcccttatgcctttactggtaaggtccttaaattaggatgggcagcaggcaattactttctcagagtcactgaacttgtatgacagcctggagctctaagtttgtaccagatccttgtacattgtcctcagcctccctttctgagctctagttcacatttcttcccttgactttgattctagtaccactttatatatgtctatgtaagtacccttgccctgcctacccaagccaagcagaatgggtattagactctgctcctttcctctaatttggtccgaatcctcagaaatcattcctgacccctttgctttggccctgtagtcctacctagtacctggcttttcttctgttttctgctaatcatctctcctcttagccacatttcagtatttttccatcatgcttatgaggtcagataccagccaccccccccacccccacccacaccccctccccccgtcgcccccatcccattggcctgaatgttctgcttcccacctgaatttagtcaggcagctgatatgaggtgcctcatcacagcagaggtaacagaaggattagagtccttgaaagacctttttttacttctggaaggccaaatgcagagtaaggcaacactttaacgtgtgagcctttgatatgtgtgcaagggtaccagtgagatccttagttggtatagtagaaactctgttaactaagcaaaggagattcctgaccggaccctattgctctgcttatcacatatgagatttttctgattacttgtctttttcagctactgtcatttggcttagtttggtaatttattgtggaggggtagagatagaggcattttgggggttaacttgttttgcatttcttgtttataacatggggtaaattctttagcctggacctaaacttctttaaatctgcctttgtggacttagacttgtgtgttcccttccttcaggcccttactcagtatcacctcctcagtgaggcctttcggtccagctcataaaaatacacagctgcctcctctccacattccctatccccctttcctgctttatgtttctccattgcacttttcaacttctcacatatattttacttatttatcttatttattttctatctgccccaactaaagtgtcagctttatgaggacaaggatctttgtttggtttcttcactggtatctgctaagaaggctgttctaggaaactgtcacttgatagaacaacatttcacacatccagcttcccagaagctgctcttctagaaagatgtgtatgtatgtgaatacacccacactcgcactcacacgtaacccccctccccgcccccctttttttgttttttaataaattcaaaagagtctctggcttcttgagttgcatttttagcttggagaaggaatacgatgatttttgtgtaccagttagctgcattgatagcctcagatttcctgtttgctgagggcagtgttagattagtcaagaatctgcatggaaagtccagtcttcgtggaaagtccatgcagtgcactgtgcatcccagttcctggataaatgtgcatggtctgtttgttgcagcagctactgcctgcagggatgtctctgcactctttgtgcttacgtgtgggactagctctgcaatttctagtcattttggctaagagaagaaaaagagctttgtgtcttgttcttgtcccccaccccccaccccaagaaggagtcttgctctgttgcccaggctggaatgcaatggcacgatcttggctcactgcaacctccatctcctgggttcaagcagttctcctgcctcagcctcctgagcagctgggattacaggcgtaccaccacacttggctaaattttgtatttttagtagagatggggtttcaccatgttggccaggctggtcttgaactcctgacctcgtgatctgcccacctcggcctcccaaagtgctgggattacagacgtgagccaccgtgcccagcctcttcttgcttttattattatttttttatttttcatgtttcatccagattgctggctctgatttttctttgagttctctgtatgtttcactgtgtgttttgtaacattttagtttttcctaaaaccaaaggattgattaaccttcaaaaggcagcactttttgatgttagtctgtaaccttttatcaaatcaatatttccctaaatagagttgacacacagacattctaaattatctcctaataaattgttttgacttcggatattgaaattgcaggcccatctccccacccatctcagttttctctcttttttttgcgtgttttgtaataagtcctacaatgaagtgtgtgtgtgtctgtctgtctgtccctccctcctgccccctctttccccattcccctgtgtgtgtgtgtgtgtgtgtgtgtgtctgtgtgtaattacaaagaagttgtaaaggccttttaaagtagttatgatgtgatttcccctcctttttaaaaataaagtattttaagcgtaagtagtaacatcttagagggcaggtacgtggagactttgactttctattttatctatctttaaattttttttttttttttttgagatggagtctcgctctgtggtccaggctggagtgcagtggcgcgatctcggctcactgcaagctccgcctcttgggttcacgccatcctcctgcctcagcctccgagtagctgggactacaggtgcccaccaccacacctggctaatttttttgtatttttagtagagacagggtttcaccgtgttagccaggatggtctcgatctcctgacctcgtgatccacctgccttggcctcccaaagtgctgggattacagttgtgagccaccgtgcccagcctgaattgtttaaatgtttacagtgagcatgttatttttatgatacatagtaatttttgatgaaaacattctgaaggctgaaaagaatgtcctgtcttttgaaaataaatccatctttgtgctgattaacactggaggctaaccaaagcgttataataaaatattacatttaaaacacctatgaaagtggctagttcaagaatataatttgccttgaaacatagcttgagatggaagtatacttctagtaatgaaagatcttgccttagtaataaatgaaagtaaaatattccattattgtcccttcatagaaaacaaatacaaccctaaatgacattttaattaactagtgattttcctctaaagctgagatttgtttttttaagacctatgtaggattggcaaatagtgtacaaaatctggacatcctttgaagataattgttggggtgggatgggggcatagagtactgttttattgtgttcatttttattaatgaaactgtgaatttagaccaagcagtgatttcatagtggaagatggaacaggatgtttagtgggttttgtatactatttttgtaaaaggctttggtgcagaatctttcataaaatgaaatctattttcagcatgtctgttatttatttttagaattcacagcaagagttcttgtttgaagaactacaaacctttattgactccaaatttgactcagctctgttatattttccttttctttttcactgataagggagggtactttataaagtagatttgtcattaaaaaagaataatacatttacctgatcagaagttcttttgggtttaaagaaaaaaattgcagcccagattgcaacaaatggtctgagttataatatgttatgtctttctttttctttctctctttttttttgttttgttttgagacagagtctcactcttttgtccaggctgaagtgcagtggcacaatcacagatcattgcaggcttgacttcccaggctgaagttattcttatacctcagcctcccaagtagcactcaccatcgtaagtggcacgtgtgtgtgtccatcataagtggctggcacgtgtgtgtgtgtgtagatggtgtctccctgtgttgcccaagctggtctcaaacttctggtctaagtgatccttctgcctccacctagcaaagtgttgggattacaggcgtgacccaccatacctggcctctttcatttctcgtcaaccaagaattactttctagcagcaggtgtccagtattaccaaatggaatagcatatttgaaaagaagttgtagacttttaatttaatgggcttcattagagaattctgacaccccccatcccccagcctggccctgcccctggcaacgcctgtcaaggtaatcagttatttttattggactttttctaacagtctccctattctgaaatactctcaagctatctctagacagatgagattttatattctagaaaacttaaattactgtcctaatgctagttagtacatatagtggttatactggaaaaacagagtgagaactagttgaagaggaaaaaaatctgttgtctactgtccttagttgtaattttttttttttttttttgagagggtgtctcgctctgtcgcccaggctggagtgcagtggcgcgatctctgctcactgcaagctccgcctcctgggttcaggccattctcctgcctcagcctcccgagttcccgagtagctgggactacaggcgcccgccaccacgcccggctaagtttttgtgttttttagtagagacggggtttcaccgtgttagccaggatggtcttgatctcctgacctcgtgatccgcccgccttggcctcccacagtgctgggattacaagcgtgagccaccgcacccggccctgttgtaatgttaggaggaaattatatatttcataactttggaaccatgaacacagcactggaatcctagggcatacaatattaagggagtgatatcctcccaagggggtgaaaattgccttttgggaccaaaaaaaacttacagtgatatataaaacacagttacacaaatttgtggtatatctgtggtattaaagtttcatgaagtgaggagtgagtagagaataatgtctgaaaaggctctttgggatatgataatggaagaaaaggctgagaaacactgccttagaggtgtgggctggaatatagcggagcacatttttagcattaaatctctccttcctcctctaaaatgctcatggtgaaattcctgtgcctactctttgttctcttctgattaaatactcctgtacacatagagacattttacacatataccaaatttgcacactactattaggtccccaaaacccagcagtgggtgtatacttctgcacataatcctatttcctattagagtctgaatctgaagactgaaaatttgtttcctttaaccctatcatagacacttcataaggaagaaaaagacaccagatttttagagactttgatgcgaaactgaagtaataaagatattatttttatattttccatcattttttctcttagaaggtgacatctgtgtgggactgggcttggctggcccagcaaacacttttagggtttctttttggatagctgatgaaacaaagttcctattgtttcatcctcaaaagagagggcccagatgggatgcattccacttttagcttaataggaaatgaagtaattcttgggctgtgcttcagcagttttgtttatcagtagcaatatttcgtttccatgggtgcggtgctccatatagtgagaaggagcctgcaggagagctctcccaacctcgcacacacacacctcctgacctgccagcataaaaaaggtgcagattaggtgattttaagagggtcatcagtagttaagtttttgtttctcacctaggtgctccttgtgtttttgtttattctttccctcctcacttaatttttttagttctatagtgccaatggcaagctttgttgggccatgctggagaagctctttgtagagtattagggatctgttttccttgagtttcctaaacagaagcattttaatagctaataataaaaactaccagttttagttgcccattttatgccagatactttgtgcacagctctaatgtttttaacaatccgtaaggttgatggtgttctcattttgtgtacaaggaaaacaggcttcaaggttgaatgactttctcaggataaccaaatctgttgcagtggagctggagttcaaacctaatattttctacttgacagctaattgccagcatacttgatgaggatccctacagtttactcagctgggagcagacttctcccaccccataatttatatttgtcttgtaagtggacttgatagtgtgagaagttcagaaattaattcctaatttaaaatacggaattaaagtttgggctgtgtttcttccaatagtttctctctctccttcccctctctaaatcctctagagtagctgccttcataagttcagtaaaattttcagaacttccctttttaaaaaaagattgggatttttattttcctttcttgttaccaggaaatttaatcaaaggaaaaacaccatggaactaactgaaaatcctgctattgttcttcctactgcagcttctgtttttatgcagaaagttagattgtggttattatatcaaattggatacagtttctcatccccatgtctttgcagtgtaattgtagacattgttaataaccctgcagttggccaggcacggtgtaaggtgtaatcccagcattttgggaggcctaggcgggcggattacgaggtcaggaggtcgagaccatcctggctaatgcaatgaaaccccatctctacaagaatacaaaaaaattagcggggcatggtggcgggtgcctgtagtcccagctactcaggaggctgaggcagaagaatggtgtgaacccgggacgcagagcttgcagtgagccgagatcgtgccactgcactccagcctgggagacagagcgagactccgtctcaaaataaataaataaataaaataaccctgcagtctttatgtacaaaggtagtcatatgactaatgaccctgttgcaaatagtcatgtctctagcgctaatttatgatagtaagaggtttggtgtaggcatacgcggtgtaaaattattgagtctgtattatgtaactttttaaaaaatgctgatttaccccccaggtgctttatcagaaaggttataggaattaaaaaataatcttgagagccacttgaacctaatggaaaacattaatgtgagagagtaggcctgccaaactggtgtggttgatttccggacagtagggtgaggtactttattcttgatcagtagtaacgcttccaatgtactcttaagtttaataaagactaatccaggaaaccctgagttccccactcatcttttaaccctcaggttttcttttgaaaaagaagcctctaatcgtaccaaacaaattccagatttatggcatattttacttatgatgattcatagtttcttcttcagattttgaattcgtgtctgaagggaaaatattggattaacaattggacagtttctcaggtatctctttcatggctatttctgacattctgccttctcggttatacagtttgattttagttatacacagagctgacagtagctcacacatccatccattcacctgctaacaaactctgctaatgcagcagaaagagataagcatactgttgttgccaagcacaacccccgcgccccaacacacacccatcccgcgttgttctgtttctctccctgtcgttcgccctcatcccattctgcctgagtaaacagtcattttagcaattcgggacaaatttctgtgctgatacttactttggcacttcacagttttgggtaaggtagcattgcttcaccatggctctttgctgtgtgaatggtgtttacttttagtggtattgtgactccctttctgattcaagggttcaggtttctcatctttgcataggcctgaggaaggagatcaataagaaaggaaaaggactggttaaatggatagggctgtggatattctgttttacatagtgtaatctctcttctaaggcactgtaaatttaaggtttgaaggcataattcaatttggatctcagattacttgcatcatcatcatcattgaattgtgaaattttgacatttattgacatttattcatatctacctcaaaggactttcagaagtttacagattagcttaattttggataaatgggacaatgctatatattgattctgttgacgaaccacagcatttcttctttaaagcagttctcctgactgacatacgtatcactccatccatccatcgttcatcatccatccaccatcagtttatttggaaattaagtgaggctatatatggtgttttgggtgataataataaagaatttaggaggccccttctagattttatttatttatttagagacagggtctctgtctcccaggctagagtccagtggcatgatcttggctcatggcaacctctgcctcccaggttcaagtgattctcctgcctcagcctccctagtagctgggactacagatgcccggctaatttttatttttagtacagacagagtcttgccatgttcgccaggctggtctcgaactcctggcctcaagtgatctgcctgcctcggcctcccaaagtgctgggattacagcatgagtcatcgcgcctggcctaagtccttcttaattgccatctcctttgtgaaatcttcctgcttttgcccacatatggaatgcaccactcctctccccagattgcactgtatttagatatttaggtattttagataggaaagttcttgtagaactcctctcattttgacttcattgcagttatctgcaacttgattctctgttatgaaccgtaaatctctggggagttgagactccttactttactcatcttcaccttctgatcatagtgcctggacttgatggatgtctagcttttagctcttgaacaaaactgagtcagatgttagagaatattttaaaagaaacattttctgctagaaaaatagacaaatcttactaactgaatcatttggcttgtttctgctaacattgatgtctgtgtagttaggctggctgcccttcaaagaaatattgcttttttcccctaattctctttcatatattaaatgcataaataccgcatatacattattataaagtgtgcatgcatgtgcacgtgctcgcacttgcacacacacaccaggcagcggatgcttcagcttgctacagccttcttagaaagaattcgacttggaaggcagtgggagtatcgtgtggattcagtgttcatgtgaagacttatcttcatggttcatgaaccaattattcttgcttaaaagttaaactagcccatcattccaagtgttaggctcctcttaggcagggacttagctcttagccttcttcctcttcaaacacattgccctgtttataggcaatgtgatacaaaacccttgcatcctgatataatagaccatgtcctttggcatcagcctcgactctgaataatgaattctgcaccttaatatctgtgtaacatggggcaagttacttctttaagtctcagtttctcatctataaattgagaacaatacatgcctcataaaattgttgtggagagatgactgtcagatgcctggcgtgtgctaggtacttgcttggtaaatgtttcctaccaccctaaaattacacagcagtgagagatttctcttgccacaggatgagggcttaaggaggcccttgggaaaaaagcatgtggaaaattaacttacttattattctgattacatggaagaaacattgtctctttcaaagacagcagaaagcttagttcattccaagtctgaaacctctgttggcctgtgcccgtggtatggaaattcagtcgcagggaccatgtagagggtttccctccatgcccttagctgtagaagagcagtctgaatgtgttagagattcagggaagtggcacgtgcatgggtgcccatgattaatcaggcagagcacaaagtggcgttacccaaacaaaaacattaactctactttcttttctgtcatcagaaagataatgggagaaggatggtgataggagcatagttctggctatttgagatcagtgtgtgaaaacaggggaaatagtgttcattgtgatgagtatattctgaatattggaaatatttaattctgtgaggctaaaatttcaaaagaaagcccaattgtccaagaaggtcttacccatagacacgtggtgttaaatcttgctgacctgtctgcagccgaactctttggagtggcatgcagttttctgcctccaatcatcactcctgaggtgcctgccagtctgtacactgggcaccatggagtccttggcatgtttgcgtttcctgaactgggctcccagccacagcattgcattatcctcatgcaaaccaggtaatttcattgaagtcctcattacattagtggttgagatgggaaataatgtgtatctgagaacaaaaatcattacttattttttaggccttggattgctcatagtagtaaaataaaatcaagtaattatgtacttttccaagtgcttcatcatgtgagcctttgtatcgtgataataaagcaagtgctagtgaatctgtaaaattcttgctatataacttgtatgagtgatattttttcctgttatgttttcagatctaatttagttcagtagctattggactttccatcatatgctatgccttgaaggtccttcagctttcattcttaaatatgttcaaattgaatagcccttgttgacattcagagcctgttcggttccagataccatgttataggcatggtgaaagctgggatacaaagttttttgttttttgttaagggaattcatatttgcaaataatgttaaaagctgaaaatggagttttaagaagtttggaaaaatgctgtcagagctcaagaggaaggagggggtgttttttaggaggagaaatttgtatgtcgtgaaataagagctaagaggatccactagcgtcctttcagcagtgaggctctaatactgttttatttgctgcctgtgtttcctttaggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacatgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaactcctgacctcaggtaatctacccacctcggcctcccaaagtgctgggattataggcatgagccactgcgcccggccagaactccactttttcaaaaatatttacatagtaagtcctcttactcaaacaagggttttcccacataattctagtagccaatgacatctacttgatgtcataattgtatagatattttttaatgaaacataatgtgtacctggagttcaataagtaacatccagtttcccttctgagttcaagtccaattgaacgatttgggagtcctgagatagaaaccaaaatgtttattactgatgaaatctagattggaagcctgatgttagagctcctgccagaagggtctgcttgtactttctatgtcttcaatgaaagagctggtcagtcacaccattgccctgtagagtccacccagccttgagtattgaattattttgggtaagcagaccacaagtcactctccccacaggtgagcagttcctgaggagaaatacccagaggggcctgagccatagcatagttagtttctacactcagatgaattttgtcttcttccatggaagaatggtaaagaggtctttgccagctttgattctcttaaatctacactaaatttaacagttaaacctgtggtcagccgtcagaacggtgtcccatactgtcaggtgcatactgtcagattctacctggatagtcctgcccaggtaaaacctgaaaggaagtatcaaatcaaggaagaaaggatttatccttttcttcttctttttttaagtatagtgtccaagaaacttctgtcttgctaatatttagagatcagaatatttgacattctgaaaaggcactcatgccttatataaacctggtgatgggccttaatacctctagctcctcctatttctgtattgatacaggaatgtttattctggctgcctttcacaaatcagtgtcaagatagtactgcattagttatttgtggggcttatggtgttttatggttttgttttgtcttgtttaaagaggggcccaggagttggatagttttatgttgccatgattaaaaacaactattagaaaaagcaaacatctgaaactttggacatatcacttcctctttctctctcttttttttttttttttttgagatagagtcttgctctgtcgcccaggctggagtgcaatggtgcaatctcggctcactgcaacctccatctcctgggttgaagcgattctcctgccttagcctcccaagtagctgggaatacaggcacatgccaccacaccctgctgcttttttgtgtgttttagtagagacggggtttcaccatgttgcccaggctggtcttgaactcctgagctcaggcaatccacccgcctcagcctcccaaagtgctaggattacaggcgtgagccactgtgcccggccacttcctctctttgggccttaacttccttgtctttaataggagggaattggccagctttaatttttttttgtactgtcagtgtactggtaaattttctgttgcacaaaattgctcaagcagtgctaacaaaggccaaaccaaatttgaacacttgaggaaggaaatacatattaaaaccacaatgagatatcattacacatttatcataatggctaagatgaagaataccaagtgctggcaaagatgaagaacatatcatatgttgcttgtaggaatgcaaaatgtataaccactctagaaatatttggcagtttcttgtaaagttaaacatacacttagcgtatgacccagtaatcccacttttgggtgtttatcctagagaaatgaaaatctgtagtcaccaaaaagtctgtgcacggacgtgctcatagtaatgttattcataatcttcaaaaactggaaataacccagatttccctcactgagtgaatacagaagcaaactataatatatccatacagtggaatactactcagcaataaaaagaagcaaactgttgacatgtgcaacaacttggatgtgttttaaatgcattatgcgggaaaatgaagtcagtttccaaaggttccatactatgtgattctatttatatgatattctggaagatgcaaaattatagaaaaagagaacagatgagtagttgctaggggctgggagtgggggaagtctgactggaaagaggtatcatgagggaattctttgggttgttggagttgttttgtcttgttcgtggtggtggctgtaagaatctatgcatgtgttaaaactcataggagtgtacatcccctaaaggtgaattttattgtacatatatttaaaataataaaataacaaaagaaattgtgtaagttgtatactttgcaaggtgaaatgcatgcaagtgacttgatagaagtgtctttaagtcaacaactgggatgaggaatctgattttctgtgctcagttcacattctgcagtttaaattgttctattaattgatgattagaatctgggaacactgggtacagtaagggagagaagcatcagttaagagttcatcacgcctgctgttgagggacaaatgtaatggaatagtctgttcacatcaatgagttgcacataaatacttttaaataggtatttaaaggagaaaggtacaaagtaaccatgatgcctgaggtaatacaggtaaataaggcaccttgttacataacaggacttcttgctgttgaaagctaggatgtttagagatattctagcctaatacttagacaaagtagtttatgtaagatttatggctaatcctcctactgttttaattgtttagttgcagtgctttttagctttcttcaggtcagtgactcctttggaaattgctcagatttctcctcagaaaaaaatgtttataggtgcctatgtgcacacatttacatatgataaatttcttaagtctccctgaacttcaggcatgagcataaagttaagaattctgggtttaactttgctcttacaaagtgggaaaagcaggggcattggagtcagtttgtttgcatcctggcttcattgcaagagtttgtgcaaaatactcaatctctctgttacttaatttcctcatctgtgaaatgggggaaagtgtattctgataatgtgtgctagtttataagctattcattttgaatgtaccatttggagacacaaaacattgatgttttacttgttacaaaaattaatcttcactttaaatatgaacaggagggagtttgtccttttaaatcttccaaatgttctctcatccctaattatataaacaagcttctacacattgtactgtttgccacagttctgccttaaatgcaggtgataaggattcatctgggtgtggcgtgaatggtggggtaaggacatttttttctctgagttttccaagtctcacttagtttctcagctcggtggttagtgaaaatggtaagctaggggggtgttttccctgagagacccttgtgcagtagccgtcagcataactcccaggtaatgtagggtgggcccactgcagacttgctctagaggaagcagggagaaacatcctgggggaatcttcattcttatttactcatgatattgtataaccaagtgaaaaagagatctgatcatctttgggggcaagaattctcccctcaaagagaaatttgggtggagaggtggaagacaggtttaggaaaaactgcagtaagaacagcctgtgtattcccaattctatacatctgatattggttaataggtcgcccaccataatcatttgatgattcagttcccacctcctttcagagtgtttgatagcttttctttctttttttttttttttttgagacggagtctcgctctgtcgcccaggctggagtgcagtggtgtgatctcagctcactgcaagctccgcctcccaggttcatgccattctcctgcctcagcctcccgagtagccgggactacagacgcccgccaccacgcccagctaattttttatatttttagtagagacggggtttcactgtgttagccaggatggtctcgatctcctgacctcgtgatcctcccgcctcggcctcccaaagtgctgggattacaggcttgagccaccgcgcccggccttgatagcttttcataaatattttttcgtagctacattagtgtttgtgtattttttttttttgagggagtcttgctctgtcccccaggctagagtgcagtggtgcgatctcagctcactgcaagctctgcctcccaggttcacaccattctcctgcctcagcctcttgagtagctgggactacaggtgcccgccaccacgccaggctaattttttgtattttttggtagagacggggtttcaccatgttagccaggatggtctcgatctcctgatctcatgatcctcccgcctcggcctcccaaagtgctgggttacaggcatgagccactgtgcctggcctgtgtttgtgtattttttcagctgtcatcactgctgaaaagaaaataacaacatattttaaaactgctagtggtttttttttccccttggcagaagattaatatttattgatcccaagactagtagtggtaggacttgagctccaaaaggttttgttgcctctgaaaccttgtttttgttacaaggttacaggtctcatttttccacaactgcattttctcacagtggcctgttctccttcctttcacatgcagctgagaattcctgcatcatgtgggactttaggttttttaagaggtagtccagaatagtacaaagaatggtgattttggaatcataggtatagattcaaagagtactgtaagctgggcttgctggggggattgatggggtaggagagtagtccttgattattgtactgatctcagaacttagaacattttacttagagaatctgaccatttataaaagatacaaccctctagcaggctcatcatgcttgaatgcctactaggcacatcaacttttttgcagatctgagggaaggtgtgtgacaggtgtgtccagcatataagtaaatagaaagcaggatgtgagacattttctgccttccttctctgtgggtagaggctaagcctacagagatctttccaattaagtatggttaaacaggataaccagccaacatggggtctatggaataacattacagcataaagaaaagggaaaagtatcataagtattcagatggaagattttctgagtatgctttctgtaagaaacaaaaaaatgtagatgatatttcccatttgccctttaaagagctcaataaaatcaggtttattatgaaattagagaaggagacagcaaggagaaaagtaggttttatgagtcagtgttcaagtagagaagcagaaccactaagagaaataatatgttgagatttattacaaggaatggcgcctttgattgtgagggctaataagtccaaaatttgtagggcaggagggggagggaagatcatgggcaaaagtcagtccaccaacatgggccaaaatatcacgtgaggaagggaagatcgtgggcaggatggagctccacaggcacaggctagtgctgtcctccacaggtggaatggaatcccttctctccaggggaaatctaagacctgctttcagagccttccagttgatgcagtgggattatcctgcccacataatccaggataacctcccttattagatcaactggttaggggctttaattacatctgcggcaaagctattattatgacgacaaggatggaaggggagtgagttggcaaaaatgatgcagccatccacaatcctaaagcacagttaattcacactggggacaaaggactcagttgacactgtaggaaaggccattagtgatctaaaaaaatgaagttgagtaactcagattacagaggagtactgatgcagagaaaagggaacagagattgatcctaaatgattgagctctgcagtttaaacacaaaaggaagaaagcagtgatggaagctttcatgctcttaaaacaacacagactaaaggaaactaaattcatatattcgtttatccctttgcaccttggcctcttctacaaacctaattcacatgacccctgaatcaaataaaaatgtgtgagaaattaatgggagaatacctaaaactgggggtatatgcatgcggtggactactcagcagtaaaagagaatgtactactgctacatgcagcaatgtagatgaatctcaaacatgctcatcgaagaagccttacacaagagtgtatattctataatttcatctatatggagttgtagaacaggcaaaactaatgtaggtgaaaaattcagaacaatggttaactctgaatgaggaggagaggattaactggaaagtggcacaaaagaacttttttggatattggtaattttctatatgttggtacagatttgggttcacgtgtatatgcatttgtcaaaatttatcaaatgggtatactataccatatgtatttcattgtatataaatcacctaaaattgtaactacatattgaatgctagttaattatatgcatgctgaagtattttggggtgaagtggactgatatcttcaagttattttgaaatgcataaaaataaggtggatcgatggggaaatagaaggaagaatcgttggatatatatgtgataaggcaaatatagaaaaacattaattgtaggatctaggttgttgagtgagtgtctggctatttgctgtgtgattctttgaactatgtgtatgttggaaaagttaataaaatgttggaagaaaacataaaaaggtgctttttaaaccacattagtttagcttgcttgtatgattgcttgtttttgtatttgtggttttatttcctagcaaaaagaaacagggtggagtaatggaaaaggttttttgtttgtttgtttgtttaatgcaagacagaagaacttttgattttaaatcctgatctgactgtgggcaagctattaattctatgaatctgccttcatttgcacaatgaagataaccagacctcatagggttactgagaagatagaatggaaaaagttgacataaactgcctagcccagtgcatggtgcatagcactacattgttttctcctaatctgttatcctcagaaagggtctacacaaaagcagatgtggtaccagttgctaagactttcagaaattgagagaggatgtagtgcagaagtcagggcatcagcttctgagcaggcgtgtggctgtagtattgggatttctactgaaatgctgagctgactcagaacaaataacaaatcagaagagtggttgtgggagggtggtaaagagacagctgcttcaaggttggaaataactagcctctaaagaatcaggtatttcctagttagtgcctcattagctctttgttcttgataaggatgtcagaacaactgtaaggcaaaagttagatggtgctatttgatcttttgtgaggattctatttgtccttttgtctggccttgccatctgcgcagaggtgttgattattaaaatttgtacctgcacatgtagttgttgcttctggggcataatctttccagccatgtgcctctggttaaacaccctttaaatcctgaattggtctatgcatatacagttctgtagggaaaatatacaatatgaaaaattgtgcttccaaggaaatttaccttggaaatagggataccagactaatacacagatgacatttggaaacagtgtaattcagtgtaaaatcacagcttcaaaaatctgttcattcctttgtgatattcacgtatagaagcatttgaggacttcacagtaaggagaaaaccactggggtccaaaaagtccgagtgcttagtgaagaagtttagacccgtgggaggccatgaagaaagagatgatagctaagctgaggcaggcacaacttcagggtgccattcccagctccctggagttaagtgtagtacagccttgtggggctatatgtggcatccctgcaaagacctcagctcctgtcatcctaggttgggcactgaggactgctgaaggaagagagtattgctagtgaaccttgaatgtaatttgatgtccaagaggacagtgaagagagccgggaaacagagaggaactgggatttaatgaatgtctactacagccagtcataatactagcatttcatctacctcttctcatttgttacacctctgtgagtgaggtgttggtatctcactttagggatgaagaaagtgaagttcagagatgttacatgaatcacgcttggtcacacagatggtaaatgccagattcgaaccctgatttgtctaactacaagcccttcctcattctgtcactttcagagtgactcactttactaagagggagcctttatttcaagttaaataaacgttttcctttctgcagttattagtggattgtcttagagttagtcttccttattgtgccaggagatgcatttcttcctctcattaaacaaataaataaagctggcagtgccagaaatttgatttgcccttattgtgtaggaataaaaagacccatgtgtactgaacaagcagaacctgtttttagtgtttaactagccaactcctgtctgggtgttcttttaaaaagtaattataccatttatgatacacccatttaagtcccaacagctattccctcttggacctcatgttgtggggctgcatttgcttctgttattattatttgagtaaaagaacgtgtgtatgggtcgcctttatatgcctgcctgtgaaattggttgaacaaacactgtgtattaagtcagaatatagaaatgtcctgattctcttttgcaggactgtgttcgattgaagattttgcttcctatactttctatgcttttgtagctttgttttgcctttacttgagggctgattctacctggccacaataaagctgttcacactgtatgttgtagcttaactttacaatcttaggcacttggaggcagtggtgtttacataacttgtctttatgtttgtttgttttttgtttttatattttcctcacttacgttcattttctcccccatttacagatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgagtaagtgctccttctgccttatttccctcctctcatccccagccccacccccgattcataggagtaccacccacttggcatctcattgtgtgtttgccgcaaattaaaacctcagctctgtatcttgccttctgctggaggtttgtaagcttgctcctgctaaccacttcattgtctgagagagaaacgtaagtcgtgttaaccattttctctctcgtctgcctgcctgccttcttcaattcttatctcttatattttactattttactcaaaagtcagaatgagccttgtctgtggaggtagcataacattaccaatgtatacagtttatcctggtttagtacaagaggaaacagatttcctatatcatatatttttttctggtatgtctttaagacttgaaagagttaattagaaaccagtacttccatattataattgcatacagaaaatattgtaaacaattaagttttggattgaatgtaatttctgtgaataaaatttgagagcagtggtttcttcatatgaacagcaataaaaagcaactgaattgtcctggaaatgtgcagtaggaaatcctgtctgtttttgggctcaattattatatgtcctgactctttaaagagttctctagaggaaggttgttagtcaaaacatttgaagagcgctcttttattcttgtataaataaagaaataaacacactagagcagccaaaagtttttattggaatgtttatataaagaagtttcaagaatagtttctgttgtttaatacatttttattagttttgtggttatcatcattatcttttccaccacattatctgaacaagtataaacccattggatctatgttctttagcaattgagggacctgtgcaaattgagtcagtattagcaaattctcagatattttgctcatgccagatttaatttagttgtgctttatgttttaccatttttaactgtgtatatagtctggaaggaccaaaaagagacctcagaatgtagtgctacttacggttatgtaaacagctttttcttgattcacttgccaggcttatacctttccccatcacgctagacagacagttctttgcagaaagctttctgatgggtgctacagatacagtggtggtaggaggggcacttatctcaaatgagctttggatacctgagctctcctaagacagtattccagggagtgatacattctactccttcacacttcccatctggccaatgattggattcattctacggttagcctcatggcctcaggaagagaggccttgtttcagaagttgaaacagttaactctgcataactattgtgaagttcaaatgcatttcctctaaatttgatttttgctgggaagcagagttggttaaggactgccatccaaatggggaaataaagtgattacaacagcttcattatatccttggaggggatgtcacaagactgttattgcagcacagctttaaggaaactagagtgtgtttgttctttgacttttttttgcttactttaaaagtactacttctgttacatgtgggaaagccacttacctccttttgaagggagattggtaagggaaaaccaacctgagaaatcaccaatagaggaccctgataggagaggatgagcaccttgctgcagatctagctcttaacttgaattctgggatgttactgttgtgaagcttagaaaaagttctgagtcataattagcgattaaaaaatggaaagggggcgattgtcccaaatcactcagtgtgagagtgattctagtagaatttggtagaatttcagttgttaaagaatcaagaatgatcattttgttattggttttcttttctcctttccttcccctttcttttcctatatacataacgtaaaaatggttaaaatagtaaattttagggacagcattcagtagcattcagtaccatcacaacactcacagagttacgtaaccatcaccactattatttccagaactttgtcatcacccaaactgaacttccttttctccagcccctgataacctctgttctcctttctgtctctaagaatttgcccattctaggtacctcatataagtgaaatcatgcaacatttgtctttctgtgtctgtcttttacatagctaatgtcctcaaggttcacccatgttgtaacgtgtcagaaaaacaatacgtacttcaaaattgctaaaaaagaatgtatttctcaccacaaaaaaataagtagctgagatgatggatatgttacttaggttgattttatctttctatggtatatacatagattaaaacatcacactgtaccccataaataaatttatataattgttgttaccaaacacacacacacacacacacacacacacacacacacacagccaaaagtgtaaacaacctagatgtccatcacagataaatggacaatgtggtatattcatataacggaatactacagccttaaaaagaaaagatcatctttaacagatgaaactgagatccagagagacaaagtggttggatgaagataacaaggtggtatgaccagaaatagaagccaaaagctgtccagagctctttccttccactcctgggattcttaaaaagtggcccaagaatagacttcatggggtctgtatctcttgaaattataaaggtttatgcacatgtttttctgaataaagcatttgttggtgagattcacgaaggggtttgtagaaagttaagaatcgccacaatgtatgatgctatctttcttttttttttttttttcttttctttgagatggagtcttgctctgtagcccaggctggagtgcagtggcacgatcttgtctcactgcagcctctgcctcccaggctcaagcaattcttctgcctcagcctcctgagtagctgggattacaggcatgcgccaccatgtccggctaatttttgtatttttagtagagacggggtttcaccatgttggtcaggctggtctcgaacttctgacctcgtgatccacccacctcggcctcccaaagtgctgggattacaggcgtgagccaccgcgcccagccatgatgctatctttctaatagtttgggtatcttcttccccaccctgctttttaaaaatgaaattgtccacatataagccggcctcttttattgcctcttttcagttagtatgaaattgaagtatggctatgtatattttacatttattgaataactagttgcattctacactttactgaaaagtcaagcttatttaaccccatttatagcccttcccaagtacatttgttgttttaattccttggtgctttaccttgttttttgctttttaatttttaagtggggtgtggggagccttgtgctggttagggcccaagttctttttgtgtttctttgttcaaggcttattttgattgccagtctattttgataaagcaagtcttacttctgcgaaaattatgattagccattcttggacatataaggattctctaagacctatccctttagaaaacacttgaactttattttaaatcctaccagatagtaataactactcaggacattttttttacagtttcccttttttgtaacccatgattgttaactttcactttgttcagtgttagggaaggcagagcttttgttgacttgctgtttcactttagcttatatttagatcttacattatgaatatgaatgcatttgtgatctgaaaattcatcttaaatacattgtatttaagtttcactctaagtaaatgaaagaattcatgtagggagcataactcagtgattgacatatatgttatctcttatttccctttctttaattttctgtcttgcctgagaaatcttagccccagaagagtacccaaaacatgtaggcctacttttcctttagttggacaatcatctcctctgatttgaagaccccacccatggtcacctaactagttagtaatggagagaataggtaaagaccccagtttgcaggctcttggtgtcatgaatgctaggaagtgacaatatcagatgagcgtggcattgtagttatctaagaagaaaatattagagccagatgttattggatctggctgatctcttactcacacatctcaaagtagaaatcttgggacttggatcacccatgttgggggtatgagggagcttgagagtaagaggaggctccagctagtgactaggtgtgcaaacttggaagtcaaacctaggtttgcattttggctctgccatttgcaaactttccttgctaagccttgatttcttcatctcataaataaaggatattgctatttacttcctggatgataacccagcctttagtgtatgcaatatgaaaaattagggcttatttgtcatacagattctggttatttttgtggagcaaataaaggtgcataaatatttcttcttggagaaagatggtagtatagtatggtagaactgcttacggattaaaagcttaataaaaatctaagcttgcctacttagtagttagtgtgacttggaaaatgtcacctatccactgagtctcatgtttcccctctcttaatgataatacctgttctgcctacatcacaaggttattttaactaaaaaaagattggtgcaaatactttgttaaactctaagatactctatttgaacatttcttatatattaataataataatgacatcagtaaaattagagttaactgatcaatgaaactcaaattccagttgatcggtctaccagatatcttgttttgtaatatttcttgtagttctctgtgaattaaagttagtagagagattggagaattgtagttagactggctggttttgaatccagggtctacttctgtgaaactgtattatttatcttgggtgattcacttaacctctccaaacctcagtgccttttttttttttttttttggtctcacaagaagaagaagaggactgtcttcaatgggttgctttgagaaataaacaattcatgtagagagcataactcagtgattgacataaatgttacccccatttccctttctttaattttcttttccttctaatgcctatgtcagtttttcatacttcagggaaattttaccagaatcttgaagtattttaagcatcatttgaatgtccctacttgatgtaggacttgatgtagggacttgatgtaggttggaaattattccctagtgtaatagatactactttaaataaaattagtttggccctttgatacatgctgtgatgttgatgcctgtagattaatggaacaaggaattctagatggataaaaaatcatttacagtccttccacccttataagaagagtatttattttaagaatttcaactctggagtggtggcatacaagtgctgaaatatttcagttgccataagagccagtttaaacatatttgtcctcataaatgtcatcttatttttagtatcagctgaacaaatcttcatttattgaatgcctatactgcactagaaaccatggttggtacattacagatattgtttcatttcaaccttatatcaacctcgtgaaataggcattatctgtgttttgcgggagaaatatggaggctcagataattaaagtaactagtccaaggctatatagaaaattgtagagctactgttacacagacagctgtggaatgccaaggcccatattcttccctctacaaaaatttggcagagagaaagaagagactcaggacgaggctactagggtacagtattaaatgactcttaaatgtaaagggttatatggtttctagtctatatgttttttgaggaaaacaaggttcttactataataactgtacatttatattacccattatatgacttttaaagtatggttgattacatttaagctaccattttacatatggtaagtattgtcatctctgattgattgattgattgagacagactattgctgtcacccaggctggagtgcagtggcatgattccggctcactgcagcctccacctcccaggttcaagtgattctcctgccttagcctcccgagtatctgggattacaggtgcacgccaccacgcccggcttatttttgaatttttagtagagacggggtttcaccgtgtcggtcaggctggtctcgatttcgtgacctcgtgatccgcctgccttggcctcccaaagtgctgggattacagacgtgagccactgcacctggccatctctgttttataattgaggaaactgaggccagagaggtaaagtgacttgcccaaggtctcggttcacaaggttgcaaagtaacagaacctaaagtgcaccgatctgtccagattgaggggacacatgtgaatgttgaacacagacccagcctgacaagctctaggtactcagtcatgatttactgtagtgggcactattggcccctctcaaagggtttgtgcctgtaagctctcaagtccttcttacaagacacttgcgcttgaaacctaggtgtagggttaggtggtggagtgactactcaagaatacatatttcacaatggaaccaagtgctattgagcaagatgttctgccaacatagtaattttgcccttttagattcctcttcaggtacttgacaagtgggtcctcagtagcccatctggtgcaaaacaagtttggagactttgcttttgcatagtaaagcaaaagatgaaacaaatgtacagacataccttaaaaataataaccagagaggcaggatttgggataacttgacatctggccaaattcccattcatcagtctgtccatccctttgtatctgacttcctttgtcattgtgtgatctaggtctttgtgtcttggtaaagataaggttgtagaactgagtggaaactagagaatgggggaggagactaacatttattgaatattgaatacctgctttgtattatgcacagtactaccttggtgctttacttgcgttttcatttaaaacccctcagcaaacctcggggaggctaaagcagcttgtccaaggccgtatagttagtcgctcttttcacaacctgtctttaggttgtatttggatttattcatagaattttgtgaggaggcatgtttggtagcattttcaggcttttaacctaattaatttatgatggttaataactctggttctcagtgcctttttttccccctaagttttcagctggacaactttaagcattttgacattttgtattttttaaaccatttaactagtaatctcaggattgcctatctggcaacatgctagaaaattgcaaaatgtactttctgaagataatattgtacttatagagcaatttattgtattcgttgctaggtattttgtgtaaattctcatatctttatcctctccccagccctttgaaggtgggcgttttatctccattgcacaaggaaatgtaatagccatagctggtaagtgatggaggaataatttgaaccaggttgtaactccaagtcctgtgaacttttacaaactcccttgggctttctaagaagatgggtaggaatttaaagttggttggaatcacagagccattccaagcatcttgtgtttctataaacttcttttctctccctgcagaatgacacatatgtactgagcaaggtatgtgtttgttcttggttgccgtataacatttagacttcagagtggtcagagttgtgaaattacactacttgatctgtggtaacaaattatctatggcaacagcatgtgatttgtttctgacttcacttcaggcttaagtggaagaaaatacagacctggagtatagggcttgatagtcaggtgtgagaaaatgaaggatcagttgatagcaccttctgctcttaaaagctacatgtgatttttacttggtcaattctaaagttttcttaaacgcataccaatagaaagaatgacttgaacattttacctgcatttattattggcagaaatagaagtgattggggaaacaaggaaagtgattagagaaacaagaaaaaaactaggtgtgttgaataaacattttcactaaaaccattatttggctggagcagaatatcaccagcatagaatgaagttacgcgatacaagaataaatatgaggtagtaaaaaaatacaaccaatcctatgcatttattaatatctgcctgttctgttttgaaagtttaaccttatagtaggagaacagtttctcagcattaccaacttctagattgttcttgattcattaaacagcatatacaacttgtcctggcacatcagtaagacctctatctagttgaactacagacagttataattcagggaagtttttcagtaacatgttctagaaggaattttgtgttaggattctggatttaatgaatcacaaaaatcttttagctgctgaaattggttatcattgtataataatcattttgacaaggttttgtttaaatctttaatgtccatagacataaataaggcgcagtattcttaagtattcttcttaaagcctattttgttttattaatgaaaacaaaatgtatttgaggtacctgatatttttcctaacacttttaaaaatacatttatatcaggattgaggataatttatcatcgtttttttggcctttttttttttttttttgagacggagtctcgttctgtcacccaggctgaagtgcagtggtgcgatctcagctcactgcaacctccgcctcccgggttcaagtgattcttttgcctcagcctcctgagtggctggaactacaggcgtgtgccaccatgcccggctaatttttttgtatgttttttcaccgtgttagccaggatggatttatcatagtttttatacatgattttggccattttttcttacaaaatttggagatggcaatgttgacattctgctcttaattttattcttatgtgaatgattttcaaattgaacttaccctagaaagacacatggcctaaatggaatatctacaatttaaaaaattgttttatttaatgtttagtgttctgaacactagttaataaaaagttaaatctagagttttaatataatctaacatctgtaattcttttttttttttttttttggagacggagtttcgctctttttgcccaatttggagtgcaatggcgcgatctcagctcactgcaacctccacctcccagatgcaaacaattctcctgccttggcctcctgagtagctgggattacgggcactcgccaccatgcccagccaattttttgtagttttagtagaaacagggtttcaccatattaaccaggctggtcttgaactcctgacctcaggtgatccgcctgcctcggcctcccaaagtgctgggattacaggcatgagccaccgtgcctggcctaacatctgtaattcttataccatttaaattttaataaatatttgttggcttaataaagataaaatgttcttcctaaggttatctagccggtgcactatctcttaatattcattttaactgtcaaactatttatccatttgaaaactctttagttgtttttgcatatgacattaacagtttctatagtcactgattattgtaccattttattcttatagtacatattttatgctttaactggccaatagaatttctgcataaaaagcacataaggagatttgtactttaaatcaggggtccccaccgcctaggctacagactggtactggtccatggactgttaggacccaggttgcacagcaagaggtgagtgtcaggcgggcgagcgagcattaccacctgagcttgcctactgtccagtcagtggtgacattagattctcataggagtggaaaccgtatcgtgaactgcatatgtgagggatctaggttgcatgcttcttatgagaatctaatgcctgatgatctgaggtggaacagtttcatcccagaaccattccataccccgccccctcatctgtggaaaaattgccttccgtgaaactggtccttggtgcgaaaaatgctggggaccgctggtttagattatgtagagaatgcttacatagtactctttattttaatagtatttcttgtattggtggtgctgcctcactgatagtgatggtagccctgtaatcacttaatccttgttcagcaggcatccatctctttggccttaaaaatggcaaagctgaacttggtgtgtccctattgtttaacatctcttataggcctcagtttcttcatctacaaaatagggaaaaataatatgtacctcatagatctgttaggattaaacaagaacatgtttataaagttcttaggagcttagatatctctttatttggagagctaggaaggacaattcattggaaatatttcaggtgcgtatgaatatgatatctcttttaaccaccattcagtttctgacttactgtttcctagtcagcctcaccccacaattgtaactatctcttaacctagtggggaaaccaagccccattttccttacagaattttggagggtaaattgtggtaggtgttgtaggggtagttgcttgacacttaccccacaagcaggcttcccttacttttttttcttttttttttaagtctaatactcagaagttgccttcttttttggttcattagaattataccagccctctagcataccacacagtcacaatatatcaatcgtttcgggtgtccagacagctaacattttgaattcacattcatttaatcctcatgacagatttagtattttcactttacagatgaggaaattgaagcgcagagaaatttaagtagtccaagatcacaaagatggtaaggtgagagtaaggaatcaaaccaactctgtctgactttccagcttatgctctaacaattaccttataaaactttttttgtttaaaagcacaaaatttagagcaaattactcatagacagtagttgcttcaaggatgtgccttctttttctttgcactctccttatgctaattattaaggcgagagtggcagttctatgttccctcccccccaaaaaaaggaaggaaaagaggaaaactaagtttcagtgctaaaatatcttgtggccctgggtatgcaggattgcatatctgaccataactagcctagcagcgagttccctacggatagctaaaatacatcattttgaggtggattagctaccccccaccccctacccctttctggcatttagcttctccagctccatttgagtagagttgtggttgggtttgtagaactcattaaggttggacactattatggtgatgtggttttgagaagatattgcaatagccctcagaaaaggaactagatgctgcagttccttgtcagaagtaaacttggagcgaaacacgcctttaggaggggtaaccaggctgctttcctctatttttaaagctgtagtatgaagccaaaactaaaagaggatgggcttgcgatattcggggtgcttgggcagccatgtgtgagtatcagcttccagaccaatgctttgttaatcttcattgtttattctctgacattttctctggctttttgctgtaactcaacctgaagcatcattgaacttccctgaaggacttgtgttgttaggatcagaaaagtgttcttctctgcagttaagttaatttgactgggttttctatgtatgttagcataaaaccccattgttttcttgcgcatgctaggcaaggtaagaaggcagagactgattggttgttgattattgcatggcaggtagaatgctagaaaattagttgaaactcatcctgggcttattgaattttgttgtatcatatacataaactgtggacacttggtttggatgctgtaaccttatctctgagaaatggcttctaatttgtgttattttgcatttgaaaaacttgctatggattttataaaacttataacaaaaaccctaatatactttattagcttctgataaatattacatcagacatccagttagtataatttgaatgtggtttgaaacttttttagaggtaggtttcgttgtgggtagtggaaggaggcacataagttttagagttagctctgagtacagattgtggccgtttcacttacagctgtgaattcttggggaaattattcattaagtctcagtttccacacatgcaacatggaaatacactgatacctgcctcagagtttttgtgaggattaaaagtaaataataaaccaacaacatagtcattttattatcgctatcaaatatgtaccgtacataattttatgtgctatacttttatatgactggcagcacagtaggtttgctttcaccagtatcactgcagatatgcagtgcattacaacattatgacagccgtaacatcattgagtgataggaattttccagctgcattataatcttactggaccatcattccatatatggtctatcatagactgaaacatggctaagtggcacatgactgtagtaaatattgttagcatccttcttttgttttgtcatttttgccttcctccccctagtgttttctcacccctccaagaataaaatcctagttcctaccaggactcacaaagctctgtgaaatctgaacctggtgcaactcttgagacttcatttcataacatttttctcattcccatagctctgtctgcacagctacactggctgtaacctccctggccagctcattgccacctcaggatctttgtacttgctgtacacattgcctgatgttcttgttccctaactctgcatgctggctctttcataccactcaggtcagttgttaggtcacctcctcagaaagctcttcagaagaagccgccatttccagtcgaagacattttctaccataagcacctgttttattttccttaagtgaagatttggatttgcgttttagaatacatacagagtaaataaaaattctctacacaattttgctgtaaacgtcttctgggatttttgtgtatacacttccttttagagaatatgtgcatttgaagtggttttgttgtttaaggtgtgagtgttcagtcgaatacctcttagtgccattttaaaatgtgatctaaagaaacattttgcttttatcttttctttctgctcattaatccacataaattactacactaaattgatttagaataaacagattgcttggaattaattttaaaatttattttttagccctcatttcagcccttagctctgtgaagccttggttgatttgcctaaacgctatctatctgcagaaccttggccttgttacttggaagattaaataagatatttatgatgaaaatgctctgaaaaactgaatacagctttttacaatcgttttatatttattatgtactgtgatttgttcctgatatttcacatttgattcagggaaatcatttcaacaaattatagagcttcttttgttgtcgtttttgttaggtgtggttttttttgtgttttgttgtttgttttgagataaggtctcattctgttgcccaggttggagtgcagtggcccagtcatggctcactgtagcctcgacatcctacctcaacttccgcagtagctgagactacaggcacgcaccaccactaactaacgcacctggctaacttttgaaaattttgtgtagagatgaggtcttgtatgttgcccaggctgatctcaaactcctggactcaagtgatttgcctgcctcagcctcctaaaatgctggattacaggcatgagcccccatgcccacacgacagaacctctttagaacatgactgttaaagctgatatttggatacttttgattttaatagcaataacaacaataataaagactgggtgggactgaacttttaaaatactcttgctattgttcagttggttttcagctttgctcaggcctatatgaagtttacctttgggagaaaatgaaaccttgtccaatgggtctatagcttataccacatgccgtattcctatctatgctatgcctcttatctcttctgccagtagtttttctccccagaatctgtgcacattaaatttcatttttccagtagttcatttttagaatctttgcttcagtgatgaattgaaaagttaaaaaaaatctgatcgcttgtaagtaatttgagaagttctctgacccaccttacctgtttattgtgcagtgctattatgagggagagtaaatcaatgttatatgtttctgcaaaagcagcaaattacaggagaaacatgagaaaagtcacatctagtttgtccaaaagacattatctctttatgaggacctattttattaatgtaactgtttttaaataggattaatcaactttaattataacttatgaaaagtgccgaatcaggtcagtgggctatataaaaatacgcaaggtcattagaagcttattggacttgttgagtatgggttcttttcttgaattttagtgatgataacctcacacatagttaagtgaacttcgtgcctgaagatgggggtcctgcctagacaaatgagcaaaaatgtgtcttttttcctgaactggaaaagctagtttacagagtgatgacttctttgtgattaaagttaccagtttctgtaagtatggaacacatcgcttctccattaagttggaagcttgttaatcagctgattttaacgttcaccattacactggagttttgggttcatatttagttcttaatctttctatcatgtttaagtttctcatgatcttcagaaataaaactggaagaaatggatgtgcattcctttctctcctgattctgttatttaaattggtaatcctacagggtttctgtttgattttgttttgtgtttttgccccacgagaaagctaaagaaactttttgacattttaaagatgagtgtgtactcctcccttccctttcccctccctcctcctcctccctccctttgccgtcccctccccctcatttcttggaaatttgacttttttttctgtcatcggtttgaaattactttattcagttatatcattctttccaagtttcagcttattttgtaagcaattctcttttttcctgttctcattaccactgttgttgatcttggtcaacagtggtaatgttctcgctttgaaaataattttcaggggcctgtgtttctcagcctcactaagtggcgtgaagcactggttaaacagaagacagttaagtagctagtaagccaataactgtcatggaatagacagagacaacacaagttctgacatagatcaacctagtttgtgtataaatacaaatttaaataatatttaaatagaaatctctatttcagtggtccccaattttttttggcaccagggactggttttgtggaagacagttttttcatggacctgtgggaggaggggatgtgatggttgaggggatgattcaagcgcattacatttatcatgcactttatttctgttattactgcactgtaatatataatgaaataattatacaactcaccataatgtagagttagtgggagccctgagcttgttttcctgcagctaaacagtcccatcagggggtgatgggagacagtgacagatcatcaaacattagattcacataaggagcctagatccctcacatacgcagttcacgatagggttcacgctcctgtgagaatctagtgccaccgttgatccgacaggaggcggaattcaggtggtaatgcaagcagtggggagcagctgtaaatacagatgaagcttcactctctagcctgcacttacttcctactgtgtggcctaacacgccatagactggtactggtttgtggcatgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccacctaaaaaaaaaaaaaaaaaaaaaaaaaaaaacagtaaaaataaaataatcaattaattcttcctcttgctggtctgtcactcagtctagagtgctgtggtgagaccatagctcactgcagccttgaccactcgcctcagcctcccatgtagctaggactacaggtgtgcaccaccaggccgggctaatttttttttgcaaagagtgggggtggtctccctgttttgcccagcctggtcttgaactcttagcctcaagcaatcttctcacctcagcctcccaaagtgctgggaacacaggtgtgagtcactgcacccagcctatttatttatttttaataattaagttgtacataataatattcatgatgcacctgcataagacaggtttattttattatcagatattacctcccatattgtatggaatttttaataacagttgtagctgatgctccattttgtagtctgatagtttcactttgtcatatttttatctatttctatggtctttataaatatttttgaggccctcttttattatgagtaaattattcaactaatattgaatatcaatttctgatttttaaaaaaattaaaactagtgagtgctagagtgagccttatcttttacctactgattttttgcttctgttaaattatttccttaggctaaatttcaaggaattgtataattaggtcaaaggaaatgatgtttgcaactcccatattcattgcaatgtggccagtattaactctgcttttcttttttaagtaactgccacctgtaggttactttaatgcagtgttttacaaccttggctgcacattaaagtctctgcaggagctttaaaaaacactcatgcctgaggaccacctctagagattttgatttgatagatgtgatatgccatctggatgtaaggatttttttttttttttttttttttttaagacggagtttgactcgccgcccaggctggagtgcaacggcgcaatctcggctcactgcaacctccgccccccaggttcaagtgattctcctgcctcagcctcccaagtagctgggattacaggcgcccgccaccacacctggctaatttttgtatttttagtagagacggggtttcaccgcattggccaggctggtctcgaactcctgacctcaggtgatccacctgccttggcctcccaaagtgctgggattacaggcgtgagccaccatgcccagcctctggacataaggatttttaaaagctctccaggcaatttcaaagtgcagctaaggttaaaaggttactttagtgagattgagcttaacattgcatctgaaaattgatttatttgttgaatcaggttggtggcttaaatctgattcagtaagaggaaccaactaaatactttgatcacatcaataaatttatacgtctgtctagtataaaattgatttaactttaatttttactaatcttgtgaatgttggtatattagatatcgatgcatctataactaatacagtggcagtatgctgaaaatcacttttttcgagatcttgaaaccagtacagtaaggtaggactaaaaaatacaactttggctattggagtgatgtagtattccagaagttatggactcattgagaaagggagtgaagtagcccctcaggatgaaaagcaagagaaaaatgaccatagacgccatggactactaacttctgtacccatatccatagtacgcaatgatctagaacttgcacactagtctctcaaaatgtgtatttttaaaattatttatatttttagtttcgtctgtctgcattctctgctacaaaataggcagcagaggtaggtttgtgttttggtttagattgttgatccaaatgctggctggctccattacttagtagctgttaggcaagttactacatttctcacaacttcagtttcctgacctgcaaattacggtaataatattctccttcacagaatgattacgagagtaaatgagatgatgtgtaccaaatgcacagttcaatatctgatacattgttaagcagttgataaatattaacaataaaaggaagtggttatgttgtggaaatagaaaccagtatttaatgagtacttactagtagtatgcatattaagaatatatatctcggccgggcgtggtggctcacacctgtaatcccagcagtttgggaggccgaggcgtgcggatcacctgaggtcaggagtttgagaccagtctggccaacatggcgaaaccccgtctctactaaaaatacaaaaattagctgggcgtggtggcaagcgcctgtaatcccagctacttgggaggctgaggtgggagaatcgcttgtacctggaaggtggtggttgcagtgagctgagatcgtgccactgcactccatcctgggtgacagagtgagaatctgcctcaaaaaaaaaaatatatatatatatatatatatatatatatatctctgtccttatatcttaatccttgagcctctgtaagaaaactgctgttatcccactttccttttctttcttttcttttcttttctttttttttttttttttttttgagactgaatttccctcttgttgcccacgctggagtgcaatggcgcgacctcggctcactccaacctctgcctcctgggttcaagcgattctcctgcctcagcctcctgagtagctgggattacaggcatgcgccaccacgcccagcaggttttttttgttttttttttttttgtatttttagtagagatagggtttcaccatattggccaggctggtctcaaactcctgacctcaggtgatccacctgcttcggtctcccaaggtgctgggattacacgtgtgagccactgcacctggcccccacttttctttaaacagataaaaaactctggctcatagaagcgaaataatttgtcttagatcagaccatggtataaatgggattctactcagactttagcacctgtacttttcccataccacactatgatttagcctctagggaagtctcagttgaacataattagatgaatttgtagtgaattggtatttttttcctcgtaggaaaaggtaggttggtgtcaattttgtgaacaatatggtgagcaatgtgggcatgccattttccagcctgtcggaatcaatattgtccttcatttgagtagaatgtgcttgtttttttttttttttttttttttttaaagacggagaatgagaatttgggctaggcagtttgtccaacattttgtcagtctcttcaacgctcactattctgttgatcaatgtagcagatggtggactttggaactttttatcagagaatgtgtgttgagaaatgttctacttggaaggaacattcctttgactcataaaaaaatttttctcttaaagacctctttgctccttgttgcattcaaattaccctgaatacttcctgctgtgggcaccgcatgaactgttcctacaaaagccagccctttccacttaaagtagtgcagcattatataagggggagagcacaggctttgggagcagcccaacctggattcaaatctattacttgttagcaatgtgctaagtaagagggtgctaatatttattgactgcctactgtgtgccaggcattattaaataatttatttactatcctcattaatttccacaacaactttctttgctttttcacagcaaccttttaaaaggactgttacattttttataggtcaagatgcatgctcaaagaggttaagtatctagctcaagttctcacttcttgtaagtggtaaagtttgattttgaactgaggtttatcaaactgctaatgtatgtggtataccttgaacaaatatgttaatatttctgttctcaatttcctcatctctgaaaccggaatactaccactttgaaggactgataagaggattaaattagtgtacttaaaattttctgtcagtatctgtttaagtagatactcaaataatactagtttcttccctacctttagtaagtaataataacagaagaatgaagcaattttcacctctgcctttattaaaatgttttacatttaactttgtattttgaaaaattttgaactcagaaaagatgcaagaaacgtgcaatgaactcctatatatccttcatccaaattctccgattcttaacattggttacatttgctttatctgtgtgtgtatacatatacatatatagaattttactgaagtctttgagagtaagttgcagaatcatgaccttctgttcctaaatatttcagcatatatttcctaagaacaaggacagtcaatacagtaacagtgcatttatcaaaattagtaatttatcattaatacaataatctaatatatagtagtttatattctacttttcaccatctgcttaatagtgttcttttaagtatttttcctcctgatctggatcacacactggatttagttgtcatgtttagtctcctttgccacctgtgccttttgagccattactgccactacattgggttgtattagaattacttccttagattatctgtctcttcagagagtgatgatctcaaaccatcttaaacgttgtgagtaaaagagaagaatatttgtactcttctgccctggagtgaaatcccaacaaatacttgagtaactgtgtatgtcaagagattgtgctgagtggtggagatcagcaggtcaggagatacacggtcctggttctcaatggggcttccagatgagtaagattgttatagtgcagttcagcaagtcttgctgagctcacaagagagactgctcctggaagtgtgctggaaactagatacaattcagggctcccaaaggatgtttaaaaacaatattaattacctcatgacaggaagattgaaaatttcaaggtaatcatattgtcagcttttcatatcttaaagtctgttttgaaatcgggttgaatgtgaaaatctaagagactttaacactgtctgatgtagtagtaatgaaacaatgcctgtactgcatcattgccacaattggtggtaaagtaccatttcgtttattcagggtgatagtttcctcattggaattaaaaaaaaaaatcagaaggcagtagaaatctctatggaccttcctgcagtatttatattcgttcatctacagatctttctttcacttgttttttgtctggttttttaaagtgtcagctgaggctatggtgcctcttaattcaccaactgaaacaaccagaatttctagtgcatttggttatgctttcctgtcctgcaaggcctgatttggttacaatataatctttgttcacatttttcaaggtaaattttagatacccagccatagtcctctttatggcagaaacacaaggctgacggacaacttaattaccaactgtagatgtaggaagggcttccagtcaagagaatgctgagtagttattttacaagtctaaaggagactgaatgtggaagatggatttaaaatggaaatgtggtagtagtacataaagaaattctgtgctagaattgtagagcattcagatacacctaggattctaggtatgggcctcatagttcacctaagaaggagagtggacagagagagagcagggccttgcctttccttccctctactggtcctgtcacacatagccactctatttctgcatatgattttatctgaaaacatgcagctacttagaagtttgaaaactagtgtcttagttgtatttgtgaaattgtaccaagccatggtctctcaggttccttgcagctctgtataaagcctctgagctgctttattcacaggtgtttgctgtccattggttgcatactttgggaacataggtgcatggtaacattggtgcatggtaacattaagttagagcatactgtgaagcagatgatgttggaactaatggttcatgtgaactatttgtactatcactaccagtgctacagagagacaattcactttatttatactctattacagtgtcttcaaatgttcatctcaaatcaggtacattttgatcaatgctgttataccattttatcataatttaatttgcaacagttttttgccttagtggtacataagatgatggtgcctttacaagtaatagcatcttaattttgatgaaatatgctatatttagtgcataagatgccacacatataagggtaaaactcctcatacattctttcctgcttttttgcatctatgaaggtggcaataacttcagtaagccaaactgtggctaacagtaattaatattgagacattaatgttgagacagatgtcatgtatctttgtagctctagcctctagcatagtgcctaccacttaataggtgttcagtaaatgtttcattgaatggtcttttaatattagtttatgaggctagaccattaaaacaaagttttagttgggagtaattagaaaaaagaaaataacttactttttttttttttttttttaaatggagtctcgctctgttgcccaggctggagtgcagtggtgcagcctcgactcactgcaacctctgcctcttgggttcaagcgattcttctgcctcagacttctgagtagctgggattacaggtgtgtgccaccacacccggctaattttttatattttttgggtggagacggggtttcccagtgttagccaggatggtctcaatctcctgacctcgtgatctgcctgcgtcggcctcccaaagtgctgggattacagacgtgagccactgtgcctgaccggaaatgactgactttattcaagagaaaaataatttgtacaagtaaggcaagtaatcatagtatattacttagatcacctgtgtacaacatttctagatgcatagtaatgtagatactgaatactgatcctaccaaaattgtaacttttaaaatatttgtatatatttaagagatacaagtgcagttttttgtttttttgagatggagtctcgctctgttgccaggctagagtgcaatggtgtgatctcggctcactgcaacctccacctcccgggttcaaacgattctcctgcctcagcctcccgagtagctgggactacaggcgtgtaccaccacacccagctaatttttgtatttttagtagagacggggtttcatcatgttggccaggatggtctggatctcttgaccttgtgatccacccacctcggcctcccaaagtgctgagattgcaggcgtgagccaccacgcccagccacaagtgcggttttgttacatggacatattttgtagtagtggtgactgtaggcttttagtataaccatcacctaaataatgtaccttgtacccattaacaaaattataattattatgaagagaaaaggacaagctgtgtgcatgtgcttttggggaagaggggcagacactaagctaaatactcattttctatgttgagaagtcagtttgtaacctcattggtctccattcccacattcctcttctgtgtgcatgtccggttctgctttgtgatgctgttgtttggagatgtgtagtttttatgtaacatggcccaaaaatgttaggccaagattttatttgttaactggccaaaaaaaagtgataaagagaaatactttgtttactcgtatttttatattatgtaccaactttggatcttaaaccctcagtaaaatgcaactccagcagacgctgtcccacacctaatatggagcttctgttctagttagagagctgagaaaagtatataaatacctattaaatagcccaaagaggtgtgtgtgtgtgtgtgtgtgtgtgtgtgtgtgtgtgtgtattttttaaagccagtagagaccaggcgcagtggctcacgcctgtaatcccagcactttgggagactgaggcaggcagattgcttgaggcaggcagattccttaagtccaggagttcacgaccagcctgggcaacatgacaaaaccgtgtctctaggaaaaatccaaaaattagctcgtatggtggtgcgtgcctgtagtctcagctactcagggggctgaagtgggaggatcactggagccccggaggttgaggctgcagtgagctgagattgcaccagcacactccagcatgagtgaccctctatcaaaaaaaaagaaaaaaggaaaaaaaaagtcacaagagagtaatataataaggaggaggggaaagatcctatgtccatagagaaaagaatggaaaagcgatcagtaagccagaccgaaagatgggtgggttttggatagtctggaatccctggatgatgaggtgtctttgaggaatgcacatttacagtttggctgcagaatggggtataagaagattaattgtggctggaaaagaacatcggtgaatacggagaatggtgatggcccggcagaagagttgctggtgtggcatggcctatagaggcactgtggtagagtggaaagagatagtattctggctctgcttattagctgggtgaccttggtcatgaagttctgtggctctttgctttatatatctatacagtagagataggatgcttcgcagaattaagattatgatgaagagagaaagcctaggtgatacaggcacacatgtatttcactctcaatacaaaaagaacaacaaaaacgttgttttgttttgtagaacagagcttttgagcaaaagaatgatgtcactattgctttgaaacagttgtttctgatagattggggggtagtgaaggccctagggtaattgccccataacaagagtggctgtaagagtccaggtaattcagtcaaagtctgaactagaccagtgcctgtaggatttgaaataaggagctgaatgggggaagcattgcaaacacgaagtcaacatgttcagaatgttctgagcaagggaagtggtattgctagggataacagtggtttcataaatggaaataggtttggcattgctgctgcttttgattatggagtaacataaaattgaggtttgaaatttgaaggtgcccattagacaccctggtaaagacattcataaagtagttggaagtgttggtgcagaactaagagagactttgagtcaagagaaagagattgtgggggtgaattggggctgtgggaaaggatagatgaaagaagaggactgaatgcagagaattgatgtgttcacctctaggagatgaggaagaggagccagggaaaacagtagatgtataggatggatttttgtggatggcaaataagaatacattttaaaagaagaatcagatcaacatatttttttcttttcttttttttttttttttttgagacagagtttcactcttgttgcctaggctgcagtgcaatgcatcgatctcggctcactgcaacctctgcctcccgggttcaggcgattctcctgccttagcctcccgagttgctgggattacaggtgcacgccactacacccggctaatttttgtatttttggtagagagggggtttcgccatgttggccaggctggccttgaactcctgacctcaggtgatccaaagtgctgggattacaactgtgagccaccatgcccagccagatcaacatttttaaattctgcaaaactcagggttgacagggataaagaaaggccactgggccgggtgtggtggctcactcgtgtaatcccagcacattgggaggccaaggcaggtggatcacaaggtcaggagatcaagaccatcctggctaacatggtgaaaccccgttgctactaaaaataccaaaaattagccgggcatggtggcgggcgcctgtagtcccagctacttgggaggctgaggcaggagaatggcgtgaacctgggaggcggagcttgcggtgagccgagattgtgccactgcactccagctgggcgacagagcgagactccgtctcaaaaaaaaaaaaaaaaaaaaccactggattttgatatttacttatcactggatacctgtgacaaagctttggtagcattcagagtgagtaggaggccgggtgtggtggctgacgcctgtaatcccagcactttgggaggtagagaaggatggatcacctgagttcaggagttcaagaccagcctggccaacatggcaaaaccccatctctactaaaaatagaaaaattagccaagtgtggtggcacacgccctgtaatccctgctacttgggaggcggaggcaggagaatctcttgaacctgggaggcagaggttgcagttagccgagatcgcgccactgctctccagcctgggtgacagaacgagactctgtctcaaaaaacaaaaaccaaagtgagtaggagccagaccacaaagccttaaaatgttgaaatggctggaaaggaggtagagatggtgagactccctgaaggaaagaggaagaggaagacagaacatgtttcagtgcgttcagcaggatttctcgatgccagcactaccgagtttgggcctgataattctttgttgtagggagcagtcctgtgctttgtaggatcccctcctactcctgagttgtgacaaccaaagatgcctccagttattgtcaaatgtcccctgggggccatattccttgggtgagaactgatcgacagggttgaataaggattcctaccgctggagtggggaaggagctagtccagaagtgggtggaaaaccacaggcagccaggggatgatttactgaagcagggacccaaggagggcaggaagaaacagagcaaaacctcggtctagaagaggtatcctgaagttggagagggtggggaaatgcattgttgttgttgttttttttttttgtaatgacagttgttttggcttacattagatggcctcaagcttatcactgagaaaggagaaaaggtcttttgagaatgaagtaggcaaggttaatgtttggcattagaggaaattatataaactttaatcccagtgggggaagattagtgtacaggtgagtaaaaggattactgagcagcaatgaggcctggctgaatggaacttttgaagcaattattaaaaagattggtaaaatgtatatctcaaccacgctgatactttttatatttgtgcgttttacagactagacttatgtactttttttttactttttattttgcttatttcacaggactttgtagatttcaatgttattgaacttttatttcagttatttttaatggctacataatagtctatagatctgttctttaatttaccaatcagcgcttcagttactaactggttagattgcttccagtttttaatgaagttgtgccaaaagttgcagtaaacattcttatgcatagagttttgcgagattttactagtggacccagtaaaggttttatacggtggtaacacagagcaggaaatgtattttctgaaatgtcacattaatgaggccacccttgatccaccacatttaaaattgcaaccttcattcctgctttaatctctgtagcacttgctatcttctaggtgttttacttatttatcttgattgctgttgtctcccttgttcgacagaacagggattttggtttgcttcaccagtaccttaaatagtgcctggcacatacatacttgctgaatgaatggatgatgggacttacccagacctgtaggcgaaatgagtttggaagagtgtcagtagcaacagatattcatggaagccagtgggaagatacttgcaatgactgatctttagtatctagagggacaaggaagcaacaaaagtccccagggacatgaattgggagattgaagggttagtacctggaggtaattgtgacaacaaaagcacattcctctggaaggtgagagtgggagaggtagaaggtaagtaggctgtggttagagaaagggatttcccaaggtttagatattagaaatggaacagtttgagaattaaattctcaaatttaattttgagaaggttggtagaatactccatttcatggagaatggactgtatcactttttaattgctcctgccttggcaaacagtgtcctctaatcttgttatatttgggtcatgctcagtggtggtatataaagcaggttttgttttcagagatcttttttgttggaatatggctgtatgtgataatctgattaagcagatatgccactaatgtctgccacacaataaggcatgttagtgactatgtcaatgtaggcttgaaagctacattgatagagaagttgtctccccgctatttgacttcttgagtcgtttctttgaactgtcgagagtattttacaagtgcttttctgtttgaggtcatttcactcagagtatagcaacttagtaaaatatgtaaaacatgtagtatagcatatgccattcttattttaagctgcttttggggagccactcttgggtatggaagttgtaatagtagtttttggagtacactttattattattaccgtcagccagtacatgattttccattgccttatacgttttccactgtagcattaaaaaaaaaattttttttttattattacactgtaagttctgggatgcatgtgtagaacgtgcaggtttattacataggtatacacgtgccgtggaggtttgctgcacccatcaacccatcatctacgttaggtatttctgctaatgctctccctcccctagcccccaaccacctgaccgaccccggtgtgtgatgttccccttcctgtgtccatgtgttcttattgttcaactcccacttatgagtgaaaacatgtggtgtttggttttctgttcctgtgttagtttgctgagaacgatggtttctagcttcatccatttctctacaaaggacatgaactcatccttttttatggctgctactgtagcatatttttagctttaaaattccaattagtctcaggtgaattgttaatgacagacaggtgtgacttagtagaaaaaactggagagacagttgaagtaatctttctcatatttttcagtggctagatagcatgtctgtaatttcttaactctttagtttcttctatttcaaaacatgataatgatctcaaatataaccttcctcccaaaatctcagggatactttaccaatctattgtttgctttggtgggattataataactgtgatataggttgggaggccaaggtgggtggatcacctgaggtcaggagttcgagatcagcctggccaatgtggcaaaacccctgtctctactaaaaatacaaaaaaattagctgggcgtggtgggacgcgcctgtaatcacagctactcaggaggctgaggcaggagaatcgatgaacctgggagttagaggttgcattgagccaagatcgcaccaccgcactccagccttggcgacagagcgggactctgtctcaaaaataaataaataaataaataaataaatatgatatgatatgggatattcaaaggtgttaatgttgtaaggaaaggaaaaataacatttcatataaggaggaaagggttgatggaaagcataatctattattgtgcctgatctttgagctgctaggcaccttatcagaatgctgtttgaggagtgttttcattatgtttaaagctttcagagaaagtaggattttctgatacaagtagaaaaatagaaaaaagtagatatgtttttctacttttaagaagggaaggcttactaggaattatttttaaatgaatgaaagagtagaaggaggaagaataggcagtatccgtgtgtgatttctctgtgtcaaacaccatagatgtagttttttatgcacattttctctaattctcaaaacagtgcttagattataatatctgtgtttgcatattatgaaattaaggctcagaaaagttaagaaatttgtctagcatcatatagttaggagataaaattttgtacccagaaatctctaactctgtataccacactgtgtatcaaactaatgagaaagaatagtgacaccaacggttaggacttcagacatttacatttgtgctgaatgtagaagagggtgcttaacacttgaaatgcgtgctcaagtacaatagttaataatatgagattgtgtggggtatgattgtgtgcctcatccctgtttattgtatgccccaagattctttcatctgctgcaaaaaagcacagtgcagattatgtgtggtatcacagcaggcattacgggcatgggtatgccttctggatgcaagggtggaattggaggtgctgtagcctttagaggagaaacccacttgccttgttcaaatcagttggcgtataatggtggaaagttgttatatttgtttataatgatatgagttgagcaaacttgcttgttttttaaattttacgaattttaactttaagttcttggaaccaagtgctttattccaaataggatatgataattatattgacaagtgttgaacaatatgtcattgtaacagtttttctttgtgtaattgacttcaataatcttgagggtgttttctgcacctattgttagaaaagttggagtgcccttgtaagggttggagtgagtggttcttctcttgccattataattgactgtagttagcatatggtctaatttattttaagagcacctcttaataagccttgattttgttgaaaatcaggctaaaaccatcttccttgcacttcctcattacttggttgttagcataatattaactattattagatcccacatatctctttatcttgatctaaagaacattgttagggctaggagtcctgcagttttcatttaacccatttgtgatctcttgtgaggaggatggagctattggttatatgcctgaatcatttgggaggtatatatactaatttttgctgttgaacctcaaagaacaatcaggttagaaatacgaagtaagacttagaacgttaagcctatgcctgggaggcagaatgtatatatattaaccagagatgcttgcatgtagggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatggtaagtcagaaagcttttatttttaagtatatgcatgtgtatgtgtgtgttttgtatgtgtgtgtccccgccctcctccaatgaaccttgatataattagaacataaaaatgctttcctggtgggaggctgagacgggcggatcacgaggtcaggagatggagaccatcctggctaacacggtgaaaccctgtctctactaaaaatacaaaaaattggccggcctggtggcgggcgcctgtagtcccagctactcggaaggctgaggcaggagaatggcgtgaacccaggaggcggagcttgcagtgagccgagatcacgccattgcactctagcctgggcaacagagcgagactccgtctcaaaaaaaaaaaaactttcctggccaggcacagtggctcatgcctgtaatcccagcactttggaagggccaacacaggtggatcacttgagctcaggagtttgagaccagcctgggcaacatggagaaactctggctctacagaagttagctgggcatggtggcgtacgcctatagtcccagctacttgggggtctgaggcaggcagatcatgtgagcctgggaggcagaggttgcagtgagctgagatgacaccactgcactcctgccggggtgacagagcaagaccttgtctcaaaaacagaaaaagaaggactttccccaaagattctgagacctgtaaagcagtattagcagtattaaatgttaccacttacagatcagagctagcattaaggttgtagccgtagggggactgagaggtttttttcattggttttgggaataatggaagacacacatttcaggtacagaaatatgcaacaactagaactaaatttctggcataaaaggatatttgtctgtgtttggcttaactttacaaaatgaaagaaccaacagtttctgagattgttgccaaagaacaagaaccaaatttaatcaggagtatttttacaactattttagtggcgatgatatgtaccatttaaatatagtgttactatatttaaatcaatagttgtatggtacaaagatagctaaaaaaaacagaaaagattttataatccactcaagtcttcaagataaagttgttgccagacataaaaacattacagactccctgttagcatttattacgaataacataaacgtcatatgtgtacatctctcttgggcataacatctgaaaggctgtgtttaggtaatttttccacccagtttatttcagagctgatttgatttggaaaccactggacagtaatttcatttaaggtcagctcaatgccagaggcttctttgggagcatgcattatttgagaccagcaagccaagaaattccatagggttatgtgatgctcccacttttgtgttttagaattgtgtttgttccagagcacgtgacatttcattttcctctgaatggacttctaggcaatcaggtttttccttagagctctttttactaggtgaatggtagttcacttgaaaatatagttttgcaggtaccaaagctacctgccaagatatggaaatggttggcaggcaaatacgagaaattaaaactgtgggaacatacatgtgctactttctttaggcaacactacttgtttcgccagatttctgttttataatgtttaccatttattaaatttaatgacttcatttcctgatttttaggagactgtcgtactctcagcaggactggaaataagctaattttgaatactcttaaggagcctaacacagaagcttttagtgaaagtccattttgcttgtacactctactagaaagactttaacaagcatgacacattttacacttgtacatataaacttttacaataggctcagtaggtagataggaatggtctgatgatggaaccctgtaagtgcccaatatattcactgagtgagtaggtgaatgagaggatggatggcagtaggtatgcatattattgcagtagatcaggtaatgaatgaatggcgagcaaaccagatgtttggaaaaatagattttaggtgttgagaaaatatttttataagaatttttgaaattttgatataaaggtaaaatcactaaagatcacctgtatttgtttttctccattttaaaccttgctgcatgcacatgggatttttgcatatttataaacttagattaataatttttttctaattgcaatatggtcctcatagttaataatggctagtatttcttccatcagttttatgaaccttgattttcttaatcattcccatgctgttggttatatctgtttatattttttaaatactttaaagttgcaaaatccatttttgagattacatatagtatccataatatactctgacagtatataggtatatgttctcatttattttatatttaatatgttctgattttatcaaaaggtgaaagaatatctgccatgccactgttcctgaaattatgaccccataactcgatggttaagttagattggttggaacatattttggggattaaaggacactgaactcagtaagtatttagggcacaggcacattggctgcaccttgtaatggaaaagagctaggatttgtttttacttgtatatatgaggcagggtgtaagtagactctgcccttctgaagacaatgaaaaatataggtgggacacagtggtgtaggccctataatcccagcactttgggagaccaaggtaggaggatcccataggctcaggtgttggagaacagcctgggcaacatagtgagaccccgtctctacaaaaaataaaacaattagtcaggtgcaatggtgcacacctgtagtcctagctactgaagaggctgaggcggcagggtcacttgagcccaggagttcaaggctgcggtgagctgtgatcacaccactgcacttcagcctggcctcagaatgagagagcccaccttaatgttagcagctcaattgaagatattcactgagctttttaaaaatcaggtttttgagactcttttatttttattttttttaagacggagttttgctcttattgcccaggctggagtgcagtggtgctgtctcggctcactgcaacctccgcctcccgggtacaagcaattctcctgcctcagcctcccaagtagctgagattacaggcatgcaccactacgcccagctaattttgtatttttagtagagacagggtttctccatgttgaggctggtctcgaactcctgacctcaggtgatctgcctgcctcagcctcccaaagtgctgggattacaggcatgagccaccatgcccggcgagactcagttttcatctacttcctaaaataagttcaaaatttagaaaatagatatttcatatatcctaatctattttgaacatcccagtatataggcagatatgaaaggaaagtaatatcagaaataagaggaaatttatttgtattcttttagattcgcttatcatgtgaccttagaagagctagaatagaagtgagttctgtccaacagaatttttgctcagaggtgtcagtgacatcttctcctacaggcagttttttaaaagtgtatttcatttcctcctagaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcaggtaagcaaaacataatacaaaattaacagtctgagaagcagattcccttaagagtcactgtggtgtcctggtaaaaatataggcatctttgttgttttgaggccttgcactcattgggtaggtagccaagttaatagtcaccaccatcaggaggggcacgtcatctcagggttggacagattttgcttcctgtattgtagacttactgcttggttgcttaagcttataaacactcctgtctcattctggagtggttgcaactttgcaaacctagaaaacaatgcctagatcacaggtactctaaagtggtgaaagaatttagcagatgtttttattcacatggcttaatccttttctctagtaccatagaaaacagtgccaaaaagctgtgttttatctacaagcctgaaactcccttcctcccctatcatcctagtctgtattctgagcaaatttagagtcagagtggtttcatgaacagctgtaagtattgttctgagctgacttcccaacatccaaaatggtggtattaggtcattggtggttttttgtttgtttgtttttgttttttttgggctaggggtgttgttgacggggaactccttccttttcctgcttggggagtggacctctagttccattgcctgttgcttttgggcagcagtctgagaattcaagaccctgcacagtgcaggggataggatgcaggatttccgcccaagcccagtctgctgagctgctgtcacagggcagaccttgtgtctgctttatcttggtgaagcagctgcactgagcagattgctcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtaggtaagaagcagcctgttttgtctttattgtttatttttgctgttcttttcaatttttgaaaatccctttacacatatgtattaagaatgtgggggagggttatggagagaaatgaatcaatggagcaaaagaagttgctttggaagaagcgcaatttaaatacagtggttattttccctggtaaagggcttttagccgtttataatctttttcctccccagttgagggatttaaggaatccgaggtagaatttttgatgactttagctttttagttttattaatgttttggattgttagtgatagatacttgctggctgttgtctcaggatttaaatgaggtctctaatttttaaaaaaagccacaacaacaagtctattttgggggccctggcaggttggcatttcagaagaatgggagtggctgtaagctgatgcctggtgatgttcttttcatttcggtgctgcgtccttggccacatgggccggaattatttctctttctggctcagtggtcagaatttgactcaagcaagtgtgaactctgtggggattgtgtctgtagtatcctatgagaaaaagtaaaaaccagggagaatttcagactttgatttttattagcacatatagtaaagatggtgagaaatgacggatgtttaggattttgaggttttgagaaggaagaaaaatgtatggactttcagcagtatatatgggcttgaggttggtaaattttgtgtaggtgagttacttgtcctgttaccaaaaggagtcatactcatggtctcaaactgcagaggaactctgtattgatggtctcagactacagagaaagtagccagtcatgaagaaattggtactttcttcagaaaatggccaggattgggaaaatccctggtcacattactttagagaaaaagcacctgagtgtgatctcagagccaaagggtattttctatcaagtttacattctactcatagatttaatcatactgttttgtgagtgagaagacataggtttaactgctgatttggaaggagccagtttgaaagaaggggatgtggcccttgacccaccaaaagcattgaccacagtgcttaggaaatcagtgatgcatgactgagccacgccagtcctgcagaggctgccgacacccgtcaagtgtgagtaatcactgttttctagtgtgactggttgctgtgccaagatgcatcttttcaaagttgataggtataggaaaggaaggaggtaccaaaaatcacatccccagaggaaagcaaccctctttccccccagaaattactctgactcacttagagatgttttgatcaagggatagttctaaggggattgcttagtcagattttaactttaataacattttatgaaatttaacacagattttggttctttgggcaaggaaacttgtttacccatttttaaactgctggtaagattatataattataaggtcaaagaaggaagaaaagaggttcatctatagaaatgtaactcttacaaatttaaggtagacttttgtacatgtcatgtgctcctagaataaaatcttaatataatttattctttggtgaaagaaacttctgtgctctttagtgtggggagcatttttcttgccagagtagtggcatcactaggttaataaccacagatgcatttccacatgaaatcgagatgacagttccatttgcatttggattattaaggtgaattttgactgttcaatcatgagtcccgtttaaagaagtgtcagaagcctaaatttgcctcagacatcatttatcatttccttcctgtatttgcttgaccatgtggtggtcaggtaacaaaaaccaccactgtttttggtctgtcaacatggccagcaagaggacaactatgtaattcttgagaaaacatgcgcagaaacgtttctcttaagaaagggatagctagtctgtgattaggtttcagttttggaagaaataagggttaaaaataagacgtaactgctgagtagttcattcttactggttacagtgatgggtggatcagagtgtgttgtatgttagtgaaagtcatacttgtcccagaggctttttctcattctcagtggctttttcctttttgttttgtacaaatccttgcttttttgatgatggccaagatggactacctagcttcagctattaatctgttcccctgaagcttatgaatttagttttccatatgcaagttggtgctacactcagatttgtcataaaaagtcaatagtgaaatggatgttcaaaagacattgaattggatcctcgcttagttccaagcgcctacaaaggctagggaaaaccagtaaccatgcgataaaggaatagctcagcatagggtcagaaatgacactagccgctgacaacaaaagaatacttttccattttaacgcaaaagcaaaacaaaacacatgaaacctggagcatgttgtatgaatagtaaggcacaggaatcagtttttaaaaatgtactctgtaacccccctgcactttcagaaatgccagacgtgaaagctgaagatgaagtggattttagagcaagttcaatttctgaagaagtggctgtagggagcatagctgctacactgaagatgaagcaaggcccaatgacccaggcggtaagtggcatcagtaagtctataagggcacaaaatgtgtttatcctgttctgctgtgtcttatttatggctttgtcttttatttgagggtaagtgggcaaaatagtattttcccccttccctcttgtgctgttatataaatgtgtttatgttgctgcagctaagctttcataaatggtatataccatacagcaaagttttggaatgggctgttacatgttttcttatagattatgctgaaaaacattttccccttgagcacaaggctttaagatttgtcagtaagcttaaattgtcacaaaatctgagctatcacaaaaggggatctatagaccttttctttctttttttctttccttctttttctttttcttttttttttttgagatggagttttgctcttgtcacccaggctggagtgcagtggtgtgatttcagctcactgcaacctctgcttcctgggtgaaagcgattctcctgccttcgcctcctgcctaatttcagctgtgagtagctgaaattacaggcatgcgccaccatgactgactaatttttgtactttttgtggagatggggttttgccatgttggccaggctgttttcgaactggcctcaagtgatccacctgcctcagcctcccaaagtgctgggattacagatgtgagtcatggcactcggcctataaacccttcttaaacctgactcttctttctttatataaaaactgatagccaaaatgagatttttactttatagctcaatagtaactgtctaaattatgaagtatatcgttttcagcaatgaaaaaacaggttcaataggccagacgcggtggctcacacatgtaatcccagcactttgggaggctgaggtgggtggattacctgaggtcggaagttcaagatcagcccgaccaacatggtgaaaccctgtttttactaaaaatacaaaaaaattagccgggcgtggtggcaggtgcctgtaatcccagctacttggaaggctgaggcatgagaatcatttgaacctgggaggcggaggatgcagtgagccaagattgtgccatagcactgtagcctgggcgacagagcacgacaccttctcaaaaaaaaaaaaataagagaataaaaggttcaatcaacattttttttttgttttaagaatagtttgttttgggatatgattcacataccataaaatccacccaatcaaataaagtgcataggtcattggttttaaatagatttacagagttctgcaaccatcgccactaaggctctaatttcagaacattatcactctaagaagaaaccccagacccattagcagtgtgcctttccttcactcttccctcccccagctcattaatctacttttgctttctgtaaatccatagagagatttgctgtgagagtgtgaaagtggctgtagatagtacgtaaactgcccattccagaacttcatgtaaatggtataacacaatatgtgatcttttgtctctggcttctttcacttagcgtaatattttcaagtttcatccatgttgtggcattgatcagtattttatttctttttattgtcaaatactgttccgttgtatagatataccacatttttttgtggatttggattgtttccactttttggctactgtgaataatgctgttatgtacatttgtgtacaaaattatgtggacatgtttttatatacctagtggagttgctgggtcatatggtaatttccatttatttggcttcaaaaatatttttcttcaaggtcttgagattatttttctttgtttaaagctattaacttttattttattttattttttatttttttgagatgaagtcttactgtcacccaggctggagtacaatggcaggatcttggctcattgcaacctccacctcctgggttgaagcgattctcttgtctcagcctcccgagtagctgggattacagggactcgtcaccacgcccggctacttttttgtgtttttagtagagatggggttttgccatattggccaggctggtctcaaacttcttatttcaagtgatccacccgccttggcctcccaaagtgctggaagtacaggcgtgagcctgtgcacccagccagctattaacttttaaaacaaacttgttgagagaaacagtgccctatgctttagattccatggtggtcaaaaaaaaaaaattagaaagctgaaaatcaagttagtgaacttactcatgctgcccctttgaaagtccatgttccttgggctacacttgacattgcactgtttttactcttcagaggactaagtggtatgtttttttgaaatttcacggtaggtaaatggaacagactatcccagattgtttcaagagtatgaacagtgatgaacaaaccttgttgtattggagtactgtggtatgaaggtgctgactgttctaacccgcccttattacacataatattcatgactaatgcctgggtggctacttgtaaagcaggcattattcagacaaatgttgcttttacccctgtgagaagaaaagagaacacaccctgcatgggtacgtgtgtctttgtttccagaagccccttagaaagggaaggaaaaaactcacatccttgaattcaaatacctctgtttcttagtactccattttaatattgtagtgattagagtcattgaatccaggctggtacttggctctagaccctttgctttctgatgagggatatctctattctaatggtatcttgtctactataaagaagaaaacaaaacatgacttaaagaaaagaaaaggtctcctctctcagtccctttcctcttctccttttttctctagttttaagagttgagagagtgaatattcctctggttggtcagcatacctcaatttacagataaaagaatagacccttggagagtcacatgactagcttgaggccaaaggcagctggaagagtttgaggtttgatttctaatctgggacttacacaacagggcgattcctccttgactcaagaaacctgggctctgattggtaaagttgctataagaagcctgagaaccatgtaatttatctctagctgcgagatatcaatgccttatgctttgtgtttgcttccaccgtgtagagttggggaaagcatatgtcagtgggattttcagttcttgaggatttgcaggcctaaattcaggaagtttttgtgttcacagcattcttataatgatgtgaaatctgactacttaactcttctccgtggtgctctgacaaacttgccttatttgctgtgagttgaaaggataaaacagacacacactttaatttttcccatttaactcttcacatactatattcatataggttttcactggatggggaaagagagcagaggtcggcaaacattttgtaaaggacagattttgtaaatgctttgtgggacatatggtctcttaaaactagtaagctttgctgtgagtatgaaagtgtctgtagctagtatgtaaacaaaggagtgtcactgtgcttcaatacaactttattatggacactgaaatttgaatttcatgtgatggtcatgtgtcgtgaaatattattgttttgaattatgtttccagccattaaaaaaatgtaaaatctcagccgggcacagcggctcatgcctgtaattctgccactttgggaggctgaggcaggcggatcacttgaggtcaggagttcgtgaccagcctggctaacatggggaaaccttgtctccactaaaaaaaaaaaaaaaaatacaagagttagccagaaattgcttgacccgggaggttgcagtgagccgagatcgcaccactgcactccagcctgggcgacagagtaacactctgtcttgaaaaaaaaaaaaaaaaagcctactcttaattttttttcatgggctgtaaaaaagagttaatatcccactggcaatagcatgtgagcccctgcctaataaatacttgtgcaccagtggaagaaaagaaaaaagaagcaagcagatttcttaaattgttttgtggtgaaacctctggtttttaaactacaggttgggagtgggatcaagttctgtctttcctgaatagctttttgacagcctctctagggctcagtttccttgtctctaatcattctctagctttaaccttctagagtctgttttcatgctgaaaagggttagagtctatgattatatttgagggaggagtggcatttgtgtaatatttaacctgatctttctgccacataccccgtctatgtgtgtgccttgggaataggccagtcattgcttcattgaatcattgaatcatcctctccaaatgtaaaatagaacaaattcctgtatcttatgctttgctaccggcttcaaaaccagtagtatggtaaatttatggcagttttctaataaatgtaaataatccatttaaattcttatggaagttttgtaacattctctaaacgtgtaatggtcagagcataagaacctctgtcgagtggcactaccaaggatttaaagaaaaaagctacagctgagttcttgttttctttagtcctttagtctgctatctgtcatacaaactgaggagtaatttttcattccttaacctgtttgacacatgtattgtaaataaatccttactttaaaggtccagtgctgaaaatcatagttcatgaaggaattagacagtatctgcattcgtttacttatattctcagagaaaacacaggtatgtgttaaatgctgcagatttcttgatagtctttactgatatttctttattggggtgaaaatgttcacaatttttgaggcaaagttattactttacacatattgtggtttattcccattaatcattttatcattttattttagccaaagttttaatgcccattgcaatttaatattcatcattacctccacctgtatgctttactggtttgaaggtattcagattacctttcgttgtcatctttttttccttagtgagttaatatatatcaagtacttagatcagagcctggcacaaaataagtacagcttagtattattattagtttagtaacttcagattacaatatgctattcacttattttagtaactagtggaatatggtggttcagactcagttactgcttcttgaacatgttataaaagcttcaggaatagtttcttacattaatttgaaattgaaagacatggaacttgttttgcttctgagaccgttacaatttgaaagaaccttaaagattttctgaagtccagcacctttgctttataagagaagaaatggattcaggatagttaaatgacttaccttgtttcacagctagttaactgtcagctggactagaacccaatttctatgtgaataatttttcccattatactatttcctgaagaatcatctgagggtacacttgggaagtcccatccacttggtttaggatgggtttttgcgttttaaacaagcatccctgaatgatacttaatgcatgctaaaattctaaagccattgcattatactttcatgcttttggtaatagttggagaaactcctttagccattttaagatgtaagctgatatactttaagtctcatgttcttactataatctgtttagctgcaactaaataccactaagatgatgtttctccaaaatgcttgcttttggtgcagaaattaggaagattttttagacctgccttttatttcctaaagaatgatatgatattgagccagatgctggaggcaagcaggagatgacattgaatacttaagttcagaaaaagttcagaaaagagggccgtctgacaccattcgccttcatagtatgtcccagtactgcaaaccaatatcgtatgttgtagggatcttttctcttcaagatatggccaagttcattaggaaggaccttctctccctggggcatctgttcattgaagtatctcaataatagttccttttctgaatgctctttgcataagcttattagccgtatggaacagttaattctacaaaccagtatatattgtcagggctcctatggtcctaacagtcaaacactcaagaacaactatgttcaaggacaactgtaaaatcccatgtgttgagtattaggctactgggaaaatctactctttatttaacataccttcctcaatcaagaaagcatttaaaatcagaaccatgatctttttttttttttttttttttggcaattatacagccaaacatcaaattaactgaatttccattcttagttatttttacaacagtattcatgtttttttcttcaggactgtagtaagggcattgttggtcttagaatattgcctgttaatatcttcctgaactatgtccttttattatatttaatggaacactctgttttctttctgttgtctaaagggggcgaacttgtatttccatccctagtctaggaatttggttgaaagcttttgtattgtgtggctgttcacagacttcatgctcagctgccgtgggaaaatatgacagcctctaggctatttggtgactaatccaacaacttataatgctgatattcaaaatggcttgtacgtcccaccctgttatttaatagttgtcagtttttaaaaaggtcctttaaaaatgtttctgccatcatattcacatagttttgtggtgtgtgtgtcacctagggaaaggcaaattgcccactttctgagttgccagaaagtcttatctgcatacatttttggcatgtaagagaggcaggctctccttaaattatcccatataggtccaaagctagagctagcatcaaccacacaaaatttaattctcagtttttttcatgtagattttttggagactctctgtatctcctctgaaatggagagtttccaggaaattatcagcggctcctaatacaaatttttaatacaattgtggaaaagaagtacctcagagaaccccagaccataaagtcacaagtggcaaaactataaacttagtgtaaaactacccatagataatgtatgtaaaggtataatttaatgatctagttgtacatttttaagtgaccttaagcaagttatttaatttctctgatctgtgttttctcctttgtgtaatggttaatctctagtttcttccagctcttaatttttgaccagtgtgtgattatgaaatgattagaataatttaaaaaatactgtaatcccagcacttcgggaggctgaggcaggtggatcacatgaggccaggagttcgagaccagcctggccaacatggcaaaaccccatctctactaaaaatgcaaaaaaattagcagggcgtggtggtgcgcccctgtaatcccagctacttgggaggctgaggcatgagaattgcttgaacctgggaggtggaggttgcagtgagccaagattgcaccactgccctccagcctggaaggcagaatgagactctatctcaaaacaaaaacaaaaaaacaaaaaaacagaaaaccaaaaacaaaactgaggatatcttacatttggaccaaaaggacaatcatgagggattttttttttcttttttaaatttgagacagggtcttgctatgttgcagatcttgaactcctgggcacaagtgatcctcctgccttggcctcccaaggtgcaggattacaggtgtgagccaccatgtgggaatttttttttttttttttaaatcacacattctttaacccaatccttaactaatcacttttgtcttaaatgttttccaaggtgttttgttctgggatattaaaatcaattatattagaatctgcttttttctttcatagaactgctgaatcataggtcatatgtgcattttagaggggatgtgtgtctcatgccaccccctcttgagtgaaaataactgtatctgagtcttaccactctttctgtctactacttacactcatttctcttttgttcattcgtattatattgacagccaatgataatagctaagtataagggaaagattatggagcccagtgaattagggttttaacctagttttgccaactaccagctgaataattttgattcatttatttagaggctgtttcctcatttgtaaatttgggatattgatgcctgttacaaaggttgtttgtattaactagagttaggaaattctagcctataataggcattttaaatgcaatagatataattctaatctcattttaaagtaactcagaattattaggcccatcttaagacagtatgaatgagtgattttagataatgatttttaaatggtcttggaagaagctatcagttatatcaggccacagtggtactcatttaactttccatgtcactttatgtttactgcaagggtgtactaatttattcagtactcagttcaacaaatgttcattgaactctgtgctaggcctcagatatgctgaaatgaaagtagatgagtctctgcattcaaaggctcatattctagtaggaaaggcaattattaaaccagtaaatcagacatattctcaagtgttaaaatacaggtaaacatataggtgcttgtgaaaagataactttcagtgaaatggacgctaaattctcctttctaaggaagtttttaaagaatattatattatttttacactgtgggaatgaagatatatgcattatgtatcagaaatataggcttgggcgtagccattatttctaccagtaaatttggaagggctaccaataggtgatctcttagaaaaaactatgtattgcttgtagttctaagttctgtgttgcttactgatataaatatgacttagagctgcttgtttttgcctgtaaaagagaaagtttccatagtagaaaattaaaagagagatgtcatttgatctttgagaaaggcctaggtccacctcagggatctacctgggtacctacaatttaggcagttttagatattccatattaggttttgattgtggattttaacaagagtctagtgatatgtcgctagttgaccaccagaagagtaaatgtgtacactatttacggagttgtccactatatatggagttgtctactttatccagaaaaagtttcagggtcaccaatttcagatgtttctagtctcctaggctgctcaattttgtgatattagcctgtggctttaatttcattcatttattcatttagtaaacattaaatgattatttttccctggacaaattattgcatcaaatttggagggttttttttgtttttgtttttgttttgtagagatagggtctcactttgttgcccaggttggagtgcagtggcgtgatcatagctcactgcagcctcaacttcctgggctcaagtgatactcccacctcagcctccagaatagctgagaccacaggtgcgagccaccacacctagctaatttttaaatttttgtagagacacggtctccacaatgttgcccaggctggtctcaaactcctggactcagtgaccctcccacctcagcctcccaaagtgctgggaatacaggcatgagccactgcaccctgccaaataccagataatttttgaaagttaggtatcctttttgccctcagcatacctagaatctagttaaatttaaaaaagcaaacatatacagatataatcacaatacatgaatgcagtatatgagacatgttatcagataccattaatgtgctataggagatcagagagaggaatacttcttgaaaagtgcctgtctgaaacgtaatggtgtttccttggtgagacccatgttgtaccacaggtggtatcaatagtctattggcaagaacagggatagcttcagggagccattgatatgctttccagccttgtagttatttttttactttcacaatacgctcagcccttcgaagatcatagaattgcctaaggattgccagagacacatcagtttgcaaggtaactgatctggcagtaatccaggttaaaaaaagaaatttcattaggactgaaaaacataaaatttaccacagaatatgaaaaatggaagtattcagtagtatatgaaccatgtggaaattgaaacaagtagtatttctgtttaaatatttccattcagccattgaaagtgtgtgttctcccttcctgcctctttcatttcatacagtgatgtagacattttgcttccattctgaggacacccaaaaccctatcactgctgtggacctgagcaactgggacagtgtcttaagtgtacatatgaagtcttcaaagaaagttagttgatggtgaaaatgcctttcataaagttcagggcagagaatactcttatgagcacatttaaaatatctaagtttaaacctaactcagaagtcagagtaagccaaaatgtttattgtattgatcttctttttctgtagttggcatttgctcctgactgagtcattagtattcatatatatatttaagagttttgaaagcatagttgctgggtgtagtgactcacaactataatcctggcactttgggagatcgaagcaggtgtattgcttgagcctaggagttcgcaaccagcctgggcaaaaccctgtctctaccaaaactacaaaaattagccaggcgtggtggcatgctccttgggaggctgaggtgggaggatcatctgagcctggggaggtggaggctgcggtgacccatgattatgccactgcaccctagtctgggcaacagaatgagaccctgtctcaaaataaaataaaaaacctagtcactctggggttggaatttggggttatggaggtataaaaacgagtcagacttttcacatgtgatttcagtgtttgtactgaagatggttgcaaaagatttctctaacagtttgaactaattataataggaataattggggtaaattgtatagcttcacagttggcctttatggttaaatacgtatttgaaaggataaatttggcttggcgctttcatttatgtgagatacgtgtgtatgtgtatgtttcttttactgtgtagagtatgaagtaccttgggagtggcacatctgggaagtttttgctgaaccccttctctgaggcagaaaaaaaacatggtggagaggctaagtagttaaaaattatgaattattttattgcttggaatccccttgaagaaagatagattagtagaaaaacatacttgaactggagatgtcctgttcccttttgatttatgtaaaaacagcatgtgatcaaaaaatttgtaatggaaccatttagaggtcttttctatttatactccagattctataactatgggaatccaaaatcttccaaaaataattgttctcattatagaatattagtttagggaggaattttagtgagcatgaggcttgtgccctttaatttgcaagaaaggaactggagtccccaaagagctagcatgctcaaagggcctgccatcatttgtgatgcccaggagcctctccttgcccacctctgtcttagacatcacctgtcactgaagtaagctcctcagtgtcacatggtaagccagaggcacactggaaacctctccagtgtttctgctggagattcttaaataggaaattcttaaataggaccatctttactggtcagtgactttcctctactttatgaaatcctttaatccttactccccatacattaagaaaaattatgggaaggatacagctgaatgtgtacgcttgatccctttgttgtggttgatgagctgtgtgcatctgctgcactggtgactctgcagtacttccttttagcaaattgccttctgatacagatacttggaggcttgtggctgggccatgggcagatcacggtatagggtgatctgggtagactgaggattcccacttcctgttgccttctcctttcctgagcatggcatctttatttttgggtgtgcttgttgtgtgttaccttccttgaaatttagtgaaaattgttacctaccaacccagtaagcctgcatgaatcactgtgaaatccaggtttgtgtaattccagcgttttctgacagcagatgaatgatgtgaaaaatggaagagccttctgcttgtcatgttcttccttagggtaagatcctggtcgctctgggaaaagcagaattgtaagatcccctttccaatattctttatcttttggtttctatgaaaataataactcaaggaaaatgtcgtatgttcagttttatttttgacatcattaatttctttctttgtcattcttcctccttgttttgctaccaaaaatttgttgtgtttattttttcccttgaatcaaggggcctgaagacaatgggttggtttggactccccctgccatgctgggctagagaagaaccaaggggtaccacctcagccacccacaggcctcttgcaattgggcctaggcctggtccattctggagaggatgcatgatgagaagcatcagagcctgtgtagtgtgcagtctctactttgtgggcaacaggacattttctctaagaggctcaggaattttttctctcattccaccccgtgaaagccagaaactgtgggaagccacagactgacttgtcagcgggagaggcatggaaaaaacatatgtccatgcacgaatcccttactttaaacatttgtagcaaagattccaacggtaaattatgctgttggaacatagtcccttcttccaggagatgttactcttgtgcatttccaaagcaaaattgagcctttaatctgcaaatatgtactattttgtatgctgaacgttgtaatagaaaccagggatgccatggtgggtaaaataagacagatttcatccctcaagaagctctattgggagaaacaaagaaatgaaccaggagttgacacctgggtcgtgggaactcagagaaggaattttccattgtttaggcctatctacaccactgtcccttctactgttcccttctagtagcattgtaacatcaggcattaagtggaattctgctgaaatgtttcactcaaaggattttccctgttgacagcattgcttgccttaaaatagggggtcagacttttcattccagttccagaaagtgatgcgtgtatcatgattgttttgctatgaaacagttcctgtccctattaccctcgtagtcaacacaataggctatgttccttcccaggagtcattaggtttccctaatgggatgatggaaaggagggaaatagagctctggccctcttccttcattagtgctgaaatctggtgctgtatctgcttcacatcaagctcagtggattgtttttcccttgtctgagcctgctctttcctccttgagtgaggaaaaggatttaaatcctggctttcctgacatggaactttcctgcagtggctgttgcagctgaacgcattaaaaggagtacctgcaagctgtgagaagaaatattgtttgaagattagcatataatataatgtggacaagtgctcttaggtttgcttttaaatcgaaagactgtgttctgtaggatttgaaaaagaatagaatttgtcattggcacatcccacccgtcatagccccacaggtttctttgtagccactggagggtcttaagtgattctggcagtagtgaattcaggtgattgacatttgctcctgggtgtcagagttaccgtgtatctctacctactcactggttttggtctcatcttggggagctactgtgcttctagctgtcccagaaggggggaggtgggaagctcatcagtgcctaacaatgccaagttttctttgttttattcctaatgggaacttatactgccatttgtctgtttcttggcataactctttgggaaggaagaggggttaaataaaaacaaaataatgcataccttttatgaatattatctctgggctgggtgaggtggttcatgcctgtaatcctagcactttgggaggccaaggtgggaggattgcttgagcctaggcattcaagaccagcctaggcaacaaagtgagaccccatctctatttttaaaaaaattaagaaataatattatttctgaattagtcttgctgttttttaaaacttggagtcaccctattggttagataataccaaccatctattagcaaacaaacatcaagctgccctgaaatatgactgatgtggagtgttgccttgatccttcctcttttattaaggctggtttgtgggagcttggagcaggaagaagggaggtagcaaaaaggacagagaaggtgaaggagacctttaatgtgggggttggggaagcaaaaggataactaaacataagcctcttgacagcatctgtgaccgaccatgcaccaaagccatgatatggcaacagctgtgtaaaggcccaagatgtttaattcttttagcagttgttcctgtaacttcttgtggtgtatcaccccagcatagaatggggaagatgggaatagcttagatttaaaaaaaaaaaaaaaaaaaggctagcttactattcttcctctgaaaagcgttttatcacataaccaactagtttagtctaatggtggaagataatagcacaaatctaaataaattaaaagtacgaattgttaaatatttttaaaagcaggcttttacttttagatatacacaattacttggaggaaatttcaacagctgctgctaagtagaggcactgctgggccatttttaatgtagtagacaggactttaaatattgacatccattttcacaacacaaatgttcctttaggaaattctttttaataaacaaatagtaattaaaagatttaacaaatgcatgacattaattttaaatttaacaagatagccttttaaaggaatatattcccctacccagccccaaaaagcatttatgtcctgatgaccacaatgaataactgagctgaagaaacaacttgtctttgtcagggagataaaattcttctgccacgtttttaccttccattccttagcattgtgtctgtggctcttcctaatatcactttccccaggagtgggaagaccctcttacaattattggaacatttccactgtagaacctgtgacaagttaatctttttggaatggcagtcagatagctggaggtaaagccttacgtgccagatcttctactttgacacctttgctacactatatttctaaaatatccatgtacttggctgacttcttaaatgctgagcaaaatttatccttgatggctcagaattattgttatgagggtatctattactattatgtattaaaatgtacattaatgggcactaatccgagtaataattcaggaacttgcattaaaaagagttactcatgtcagtttaccatttgccctggtctttcaaaaatgcaatgagacttattcagccatatagtcccttaggaagtacctttcagttaacttcattagcacataggtcatcaaaagtcttttcctaaataattttatttgcccttcagaaaaccatctctgtttattgttcttgctgtaattactcttaattcaccagcatcattcataatgttatgaaattgtttagacctaatctcacatataactaaaggcattagctttcatatagtctgttaagttagaaagctctcacccaagattctatccttttcccccaaaataagaaaagctttttttctctgagacagtaaatttaacttatcacattaaactgccaatttagggaactcatactctcatcttctctcacctgaattctttgtgtgtgtgtgtgtgtgtgtgtgtgtgtgtgtgtgtgtgtttttcttccagctattcttgtattccttataacccatcagttctcaaactctttggtcttaagatctcttcacatttttaaaaattaagagccccaaagagcttttgtttatataggttatatctagaaatgtttactgtattagaagttaaaactgagaaatttaaaaaatgtttattaattcatttactacaataaactaatcattattaaaattatatttttataaagatattttttctacaaaaaattacttttctacaaaaaaatttagaggagtggtattgttttaatttctgacttaatataaaatatttggattcttacatctttcatgcattaagcctattgcaatatattgttttagttgaagtatataaagaaaattaagcaaatacaggtatatgcttagaaaagggagaactaccttaatagttttctcaaataattgtgatattctttgatactagatcagaattgacaaacagtaggttcttaaaagctactttcggtatgcaatctgaaatcgtatcattgaactttttgtactctgtctcactctgtcatccaggctggagtgcggtggcacaatctcggcccactgcaacctctaccacccaggttcaaggcattcttgtgcctcagcctcccaagtagctgagattacaggcgtgcgtcaccatgcccagctaatttttgtatttttaatagagatggggtttctccatgttggccaggctggtcttgaactcctgatctcaggtgatcctcccgcctcagcctcccagagtgctgtgattactgatgtgagccattgtgctgggtctggtctatctcatatatatatatttttttgaaacggagtcttgctctgtcacccaggctggagtgcagtggtgcagtcttggctcactgccacccccaccttctggattcaagtgattctcctcctgcctcagcctccccagtaactgggattacagatgtgcaccaccacacctggataatttttgtatttttagtagagacaggatttcaccatgttggccagcctggtcttgaactcctgacctagtgatccgcccgcctcagcttcccaaagtgctgggattacaggcgtgagccactgcacccagcctatcatactttcaatgaatcttttactcatgcataattttgtaaaatcctacattggtcatttggaaaatattgattcactgagtaatacaactcttccaaatgttgaatgtttcattctacaatatcagaaactcaaatttgttaatgttactactagtctcatcagaaatgtctttaagtatttgttaactggcaaactcatagtgacgactacaggctttccagaattttcattttcatttgaagtctgaattttatcaactataaatactgtcagttgtttcccttgagaagcaggttctaagaaaataaccccaagttctgaataaccattatttgtcagtcattcttttaagtaaagtgttgtttcctgaaaaaagcagtttagctcacaacataaaataactgtacaagtgatttttctcaagacaggcatcacatcacatacacagaagtattatgtgtttgcttcccattttgtcacacagaattttaaaaaggtgtgtactcagagtatggcagtgaagactataatgactcctgattcattctggcaccaatgccttggtttgtgctaaggcaccatcagtgcagatgtcaacacagtaaaaaggcaagtaacatcttaccattactatgaaaatagttttgatcacacagacaccctgaaaaggtctcctcaaggttttgcagaccgcactttgagaaccactttgtctagcccatgttgcagattcttgctcaaagtaaattaaatagctccttggtttttaaactttgtgatgtggcatacatggactttacagtctgtctctgaagattacttgtacagtcccatcagctatactttttcaccccacagtccagctgccagcctcgccagaatccccttattatttgaaatttattgttgtattcactcaatgtattctgtgcctgaaatgcatctctggagtcaacatgggtaccctttccttctttaaagcccttccctgatgtgcagtgttacctgtggtgtcctcttcgctctctcaggcctcctgttatactcttctccttccccacactggaacagacccagtggaattgcagtgtatctcatgtgcctcactaagtactgcactgggagctctgccgcctcctgccagtgactctgcttcagccatgttttcatgcacagtgacttgtcacatttctcacacatggcagacatttataatgtctgatgtgtgttgagtgtctcaaaagaaaaagggacacaggaagaacttcagcaaggttgatatctagttagttgacagttttttgttaagtattgcttcagcgagctctacataaggggatacagtatttacttcatttattattttctctccttcagggcactgacaaccttaaataggtcactttaaaaaaaataactatttcctatttacataataaatacatttgaagatttaagttttgtaagttgaggttgaaaagctgatttaatcactgtggcaggagttgcagctaaaaattaggtgaagaataggaaggtcctcattgataacccattaaaatgagtatttaggactgaaccaagagaggtgattcatctttctgtctgtatagaatttggataattgactcagtaatgaaatggaaccaatcaaaagctgctgctgctgctgctttttttttttttttaagttggagcctcgctctgttgctcaggctggagtgcaatgctgcaatctcggctcattgcaacctctgcctcccgggttcaagcaattctcctgcctcagcctcccaagtagctaggattacaggcacctgccaccactcccagctaatttttgtatttttagtagagatgaggtttcaccatgttggtcaggctgttcttgaactcctgacctcaggtgatccacccacctcggcctcccaaaatgctgggattacaggcatgaactgctgcacccagccttcaaagcttctttaggttcatcagaatgagagttagatgcatagagccattagaattcagacccaggaaaaccctacttatatgaaagaaagattaggaagatttgggaagttcttcttaacaataaaccatatgctaagctcttgaataccactgatgtttactgtaacatcttcatagggcagtcagaagagagatgttaataatctatagatggctagttggagggacaacttacatgtttcctgctcagtgctgcactaagagctcatgggtgcccctggtaataatttatgctcttaatccccatggattacctaatttcctagataaactattcccgacagtcagcgctttgcagggcttctgagccattaaacacacacatacatcccgttattttttgagaaattatcagaatgctttcatgaaacttcgtctcgaataatttaccattttgtggagaggatatttaaaagtttcactgggaacaattgtagaacattcatataaattccagagggagatatttgcacacttagaaagggtcttttgcagggacatggatggagctggaagccattatcctcagcaaactaacacaggaacagaaaaccaaacactgcatgttctcacttataagggggagctgaacaatgagaacatgtggatgcagggagggaaacaacacacactggggcctgttgtggggtgaggtgggaggtgggaaagcatcaggataaatagctgatgcattgctgggcttaatacctgggttgatggattgataggtgcagcaaacaaacatggcacatgtttacctatgtaacaaacctcccgagtcatgcacatgtagcccggaacttaaaataaaattgttttaaaaaggtactgggatataagcttataaataattgtgaacaaataatataaaaatcaatatgtatttagacatatctcaaggatggataattttatggaacccacccaaacttccatttatattttaaaaaagcattcagtcttcaagcttatcaagttgtgtactttaaatatacataactttttgtatttctgtcatgcctcaataaagtggattaaaatttttaaaacagcattaagggtagacagaatatcctccatttaatgataaatttctgatagatctcatgtatttataaggtctaactactagtaccatttgtttgtagtgggcagagtggatgccctttagtgcatatctgtgtgtcagatatttgtggtttattttacatttttaaataaaggagcttctgaatctagattttctgcactggtttgatctacttttttttttttttttttttttttttgttgagatgtagtcttgctctgtcacccaggctggagtgcagtggcatgatcttggctcactgcaacctccgcctctagggttcaaacaattctcctgcctcagcctcctgagttgttgggattacaagtacccaccaccacgcccagctgatttttgtatttttagtagagaaggggtttcaccatgttggccaggctagtcttgaacacctgacctcaggtggtccgcccacctcagcctcccaaagtgctgggattacaggcatgagccacagtgcccagcctaggtttgatttacccttgagcataggttcctttacctgaaagatccttttcagatatgcatatttatttacacagaagccatttgttgaatgctaagaaatccaaagaaacaggagatgtcttgttccacgagacttgtacaacaggcccctacttaactgtgataattgatggatgagtgctaacacagttctaatggagtcagaggcaagataggccagttttttgactgaggtgtttggtggaggcatcatgggggtgactacagttgaagagatcttaaagacttttccggttttgcctagactgggaagaacatcatggcagggtcaaggacatggaggcagccaggtgtaaaataatctgagaacagtaagttgacttgtgtgactgaagtagaagaatcttgcaaggaaaggtgagagaaaaggccagagaagtggtcatggtgcaaggcttctttcccaggatcacctctcagagctagatgctctttaccccaatgggtcacactagtatttcagccttctgggtggggattgtttcggggacattttaagttcaatccaaattaggcacttggggattggccaggaaaaatctataaatatctgtcgtttcttctttccctttgcctcagatgaagaggcttttttctttttttctttttttttttttgagacttaactcttccatctgtgttcctagttctatcttggcttttaaagaagtacttctttgtaaaacagcttcagatacttagtagttcctttattcttagtttttgaggtagctccctaccttctccagttatcagataatcagaagacttcacttttccctctgctttcctttgtcatggtacaaaatagatccagaggggatatggtagtctgattgaaaggaaaagtgttttgttctttccattctgacttgagtcagaatttaccatagttacttggttttattttatatgcacccttgtaggctgacttaaatacctccttttaaaaaataagacaaaaatgtaacatacattaattcatttattgctcacacctttttttttaaccatttgcctttatttttatccccattttgtaggtgagaaactgaggaacagaaaggttttaaaacttgcgtaaggcagcctagctccagagttcatgcttttaaccacgatgctagcttaatagagtcactaagctactcatttgtcccttcatttcctttgatgtttcctgtatgagacatctctgctagtatgtatttaagtaaaggagcattctccactctttaaacatatttttgtgataacccttccaaagcaaatgttcacagtgtaatctaaggtaaacagttacattgtactttcttaaaaatttccagaacattaaaatatgtgttctagttaagtaaaattctcaaaatacaagctccagataatagtctctgaatgaacagaagcaagtttattgctttgaatatgagtgaatgccaaaattaacctggcagtagtgttgacaaataggctttttcatgaagaacttctttcttttcccctttgctttgtttttttggacaattgataaaaagagcaagttgtacctctgcattttttggagcgcatgactgtacaatggtgtatatttgcctggagggatgagggaagtcttccatgggaagctgagtcattttttggcttgtctgactgtgtgactgtgctagagctattctttttttgaagagaaaaataagaagtcaagtaatttcctaaagtaatacatttttattttatgtgggattcatattttccttgggttgtggttattttgagcaggagtttttgtgtctggccaggagtattcttctaatacagaaactacttcagacaaaattattttctctccttgtttaataactaaatttggtcagccattggaagtcttagggttgtgattgtggtggtaaacgaagacattattagttattcatctcaccttggatgtatcataccatttttggcactctggagaaatttaagaaatggctgttgcctttaaggcaattattatttgcttagaatcagaccaacatgcagtagcaatgaacaacacagggcaggacaccatagagtcagcaaggcagagtctaagccccatagtggttcaaaggagagcgttttaaggagggttagagtaggcagagagagctgaattgggaaagtagaattaaaggatggactttgactaaggtggataggcgagagagggaattccagaaaccatgattgttctgagagccgggggccttgaagtaggaagaaccatattctgattgtggaaccttgatacacaattaggctttatcttgaagaacaatagaaaatgagattggttaagggtcatggagtagtctgaaatccagacaagggagattagactggatgaagctaaagacttttgtactgcctttctgaatgacagcctaagtcatatcacttctttgttcaaacatcttcactggctccctattgcccctgaatagagtcttaaactctttagcataacacatacacttttttcatttttaattgacacatagttgtacgtatttatggagtacagtgtgatattttggtacatgtatacaatgtgtaatgatcaaattaggataattagcatatctgtcacctcaaacgttaattatttcttaatgatgaaaacattcaaaatcctctcttcccgctagtttgaaatatacaatatattattgctaactatagtcacccttcggtgtgatggaatactacatttgttcctcttatgactctttacccattgaccaacctctccccattctcttctccccatccttgtcccagcctctagtaaccactgttgtactctttatttctgtgaaatcaacttatttagattccacattatcagtgagatcttatggtggttgtctttctgtgcttggtttatttcatttaacgtagtgtcctctaggctcatccatcttgccataaataacaggatttcattattttttacagctgaataatattctgttgtgtatatgtaccacattttctttatccattcatctgtcgatggacacttaacttggttctgtaccttggctattgcaaacagtatactaaacatgagagtgaatactgatttcctgtcctttggatatatacccagtagtgggattcctagatcatacggtggttttcttcttgcatcatctgtttgtataacctatgctgttaatgcttttcctacctgatgtcatagcagtcccttgcatgaatctgatgcatgtaaccagacattgtgctattcctctgtcatacctggcattcattaacatctttaccttcactcacactcttcatatgcaacacccacctcctctcttccattttctctgtttccttccgtttattttaaaacagcatcttttctttcttatcacttcagccagagatcctcttccttttgctgaaattctgcttttcatctgtactacctacccaagctgtcttgtgtttgtgtttcatacagttgctcctgctgtattttctttgaggactcaaaaatgttttatgtatttgtatatctctcataacaccttacagggcaactcacctaaaacagacacttaaatatttgctgaatgggtaaagaaatttggctaatattcattagtttgctactaattgaccgtggcatgctgatgacaacgagatcccattacagaattatggtcagtaaatgtcagcattgtttccttttacctcattgcctttgttttttatggaatgaagtttgttcttatttccatagatgatcatatggaaaaggagtttctcacttgttgcctcttcccttctttttccatttcctttccaaaacacttgtccaccctgcctctctccttcagctatatgaaacctttgttcatattcctgaccaagacagcagtacgtgtattcaagtgttctattttggtttctatggcaggatctctttgacacaatcaaaagtatacaaaaggatagtcgtgatgcatggaactcacttcttggtaatggtccctttttctctgtcagtgttttgttttcttcttaaagttcttaacaatctaaattatttattgtcaggttagtaatcttatagcaaccattatataaggattcacttaaggcattttctctaaaggaaaaaaatgtcttaagagaaaactctgaagagttagtatacagatagagcttaagggccgggcgtggtggctcaggcctgtaatcccagcacttcgggaggccgaggtgggtggatcacctgaggtcaggagatcaagaccagcctggctaacatggtgaaactcccccgtctctactaaaaataaaaaaattagccgggcgtggtggcaggcgcttgtaatcccagctacttgggaggctgaggcaggagaatcactagaacccgggaggcagaggttgcagtgagtcgacatcgcgccactgcgctccagcctgggcaacaagagcgaaactccacccccccactcccctcccccaaaaaaccttaagttttcccctgtgaaatagtagaatatttaaatccagttttcatcagtctacaactacgccagaactaccctcaccaagatctatgaaatatttgcctagcaaaatccggatcttgtatttgcatgacgtttttacagcatttcgcactgtttactatcctttctttgaaatactttctccatttagtttccttgatgccacttctgtgtgttaattcccaaatctgaatgcccaacctcagccattcccctgagttccagtcacacactttcaactgcctaccatggctctgctcagatatctctgagataccatgtctcagattcactgtgtctaaaagtgaattcatcatctgatctctcccctgccacctacttctgctgcattccgccctttacctagttgttcaggacagaaacctagtccatcgtcacacttcttttacttctgctcccaccccaatgcccaatatcctgttaatgttaaatatttttggactctcggtttcttttcttgagctctgctttcagcagctgagttcacactgccatcatttctcacctgacttctctaacagctttctgactcatctgtctctaagcttgctcccttctgtcttttgagcgtattccagaaaaatatatttttgaaatacagatgcgatcctgcctttcccttgctaacaactcttcgattgcttttcctattgtagcgacaatacacttgtgaacacaagtaacatgttcagctggggctggcctcatcctttgtctctgtgctctttcttccctctgggccttatgcagtcttctgcctgaacgtagacacaggtcagtctctctagctttccttgcctgcctccctacagcaccatccacacatatacaccctttgcctggttaattcctattaagtcttccatcaagtctcagattagtaatatactgtaagggccagtctcaaacatgattgtaattatttaatatccattttgttcactgccgtatcctcgatgccaagcgtacatgtttaataaatagttgcctaatgattaaactttactgaaaagcttattgaagatttagggcagtgacatggagttgtactatacagtcccaataatgtcacagattttccatgtgaaatttcctggttgttgttgaaattgttagttactctatttgccatgtttagtgttcttggccctcaggttttaaaagttctaatgtatcttaaaaacatgttaggaaaatttgacaatacatgaaacatttattatgctttgaataggtgcagtttattatgtgtaaattatactttagtaaacctgtttaaaaattacctcataataaatacttttcaagatctagattaccatctgaaatagattttttttactggtggttttgtctgaatcacatacgcattttgcacttgtatatataccaactatttgggtgggaaaaatagcataaggttgtgaattcatttgaattgactatttgatggtatagttatcatgtttaagtagatcaagcgtggtggctcacacctgtaaatcccagcagtttgggaggccgaggcgggtggatcatttgaggtcaggagttcaagaccagccaggtcaacatggtgaaacaccgtctctactaaaaatacaagaattagctgggtagtagtgacacgtgcctataatccccagatactcaggaggctgaggcaggagaatcacttgagcctgggaggcgaaggttgtggtgagccaagattgtaccactgcactccagtctgggcaacagagtgagaccctgtctcacaaaaaaaaaagaaaaaaagaaagaaaaagtaaatgtggagagaacatattcttcttaccttaatgccttaaaagggatgctattatttatagtaattttactcaaaaatttgcacttacgggcttcatgaaattggtaagatttctacatgtgagaagaagttcttgtgtcattgtactattatgaagtagcttttgtttttgtttttgtcagtgctggactgtcttatgttcttgtggtcatgctaaaaagaaatgttgttagaagattcaaaactatgagtaaatatggcttatagttttatcaaatacaacagtctttaggatctggttttaaatagacaacataaatggttatcaaacagtacactgcatgagtagtgtctcatttcccttttggatagcattatttgataggttgaataggagaatgccatacatttagtatgtattaatttcaggaagaagttttattaattattctgtattgtatagaagatggaggtatgggactcagaattcagttggctttgtagctgatagaccagcattttacttaatcttaggagtgctggggccgggtgcggtggctcacgcctgtaatcccagcactttgggagtccaaggcgggtggatcacgaggtcaggagatcgagaccatcctggctaacacggtgaaaccccgtctctactaaaaatgtagaaaattagctgggcgtggtggcgggcgcctgtagtcccagctactcaggaggctgaggcaggagaatggcatgaaccccggaggcggagcttgcagtgagccgagatctcaccactgcactccagcctgggcaacagagccagactccgtctaaaaaaaaaaaaatatatatatatatatatatattaggagtgctgattgatggacagatgtcctaccaggggaggcttttagtgatttaattctgggttccatcattagccttgctcttcagatttatgaatgatacagagtttggagaaacagctgttacttcagtgatggaatttaggttcactatactctcttaaggctaaaatgataactttaaaacaaatgagaatttatttgagagaatatatctatacagaaagctataaagtaggttttaaaacaaaatcacaagattatagtttaaaggagacctgatactgtaagtcacactgaaagaaaatatatgggaagtaagtttatttcacaataaacttattcttctagcggtgtaatatgtgtgtcaagaaaaccaatttgatcttagttatcccagtgtgcaccatgtcagaggattttgtttggggcatccacatcacaagaagtacactaactagagagcactcaggtattctgttgtctgaggagccgttgtgggaatcatgattcgaaagagaagcctgaagagggtggtgaagcacgacggccatctttaaatatctgaaatgctgccaaaagaaataatgaatgtttgctccaaagagaaaagccagatcagtgtatctgttcattttcaggaagacttgggtagcaatatccagagatcttttagtctgtatgtttggtttgttcattctatttttgtaagatattactatagagagaaacttttaaaaagtggaatgtcaaatattgaaatgttggcagagaagttgagtccgtttaatgtaaaattaagaatcacttggcatttttattttttaaaaaacatctttttctgtcctttagcatttatgtaaaatcaaatgtagggatattgattatgagtaatgaatcccaagttttctttcctcaaatactaacttttctctgttatagtttcatttcttgggggatttatcaagtggcaaaattagatgtagtggaaagactgatttacacaactgagtttaaagcaaatctgttttattagctgtgtgatgttatataactgacttaaattctaagtgctacttttcctcatctgtaaaatagacagtaaaatttcaccttacaggtttttatgaggaatcaatgaaattgtacctgtggaagcacctggcaaacaggaggtattcagtaaatgttgtggttaataaatcttgctccagaagacttgtcctcaagattaaactatcctgtcactttttcccaactgaaattttgattctgccatctccctttcttccttcctccctccttttatttcacaaagctgttggtaattttagtagaatttaacatttgtgtgtatgatccatgagaccttgttcctgtaaagagcacaagtttacgaagatacttttttcttatattgttccatattagtttgttgttattttaattgttgctattattgtcagttagctgctgccagttaaattgtcttaagttttcttcttgcaaagatagtaaagggttaaggaaaggagctgttggctactgcttgctactaatttgaaaagaaatggtggttatagccttctaggtctctccttctcctttacccttttactgtcttgtaatcttcaaatctgtatgttagtgaatgctaggagggaacagtagacctgcttctcctggagccatagtacaaggaaagcctaattggagacgatcctttgcagccattgtaaagtattttcttctttcacctctcaaatattcatttgtcttatttgaagcagtctattatctaagcagacaggagttgctcaagtggaggctaaatgttttatctgtattctaatacattttaccaccaacatatgtgtaactctggatggatcactatatttaagtttagattaatgaaaattgttgactgtggtaaacttttccttccttcccatttcatgtgaagaacaaaggtagaaagtgtcattatgcaggaataatgttttctgcaagttttaagagaatgtctcaattcctttttctttctcctctgaaactaccgtatcccatgaactatatggcatgtgataacttcctagtctcagactggcagtatataatattagagcaagaaggatcttcagatatgacctagcgttgaatctctaatttttccattctggaaatcttggtccagagggtcaaactagtatctcccaagttgctcagtgagataatggcacacctaggaagacaaagaacccttgattttcacttagtaccttgtgttctctgcagagagtaaaattgatcattgatgagtcattaaccagtgtccattcacatgctgctactttatgttcactttggggtttcaggaaaaaatacatagtagcagaagatgagccctacccctatccccacacccccacaaaaatattcactggcctttggtgttctgtttgggtcttcagcatcccccactaggtggtgtcctaattcagaaactttgctgtgagactccagatgggcttctgccctaactggaactaaagcagccacagtgttgacccataagaatgcttaaacaatttggtaaggtgctagatcttgtagttaagtaaatcaaatgaaaatttaattcatgaacacaaatgctatagctaaattaagatgtataaaatatttttatatttcattttctggaatctttaataattgcatgttggccctgtggcatgagacagattaaaagcactggttgtttttaaagaatctgggaccatttgtgtggatagagggcaggatggaggctgcagaaagaaaggaaagacaattaatactgtaagtaactactgttaagtagtatggctgtaaataataaaatattttactacaggttccccaaattaaaagaaaagggaaataaactcagaacctcctttaaatttgtaactctcagctctggtttagatatgaaatgattggttgctgtatttcaaaatcctggcagaattactgttcaatggttccagatgtttttgataaaaacttggaattgtcacatcaactgcaaaagcacaagactgcagattctgtcttctgttggggagtgctgagcagatccagaggggaaagcaacacagactcttttttccacccagagcatttgtttcccacccagggtatttgtcctccaacaaggaacagaatatgtaaggaattgtcctttaatatgcagaaagagcaggaaatctagctttccagcctgtggcacaaagccagaagttagaaataaaaaggttagtctttatgtctcaaacagtaatctaggctctttcagaaaattatattattttgaaacaagtttctctctcctaaaaacttcctgaagacagacaccttgttacctatttattttgcttgcctccactagaagtcacaaaatatctgttacattgttataaattatctgcatgtaagtcactggacagggatagggtagaaaagcttttttgttgttgttgttgtttttgttttttgttttttgaggcggagtcttgctctgttgccaggctcgagtgcagtggcgcgatcttggctcactgcaacctccgcctccgaggttcaaacgattctcctgcctcagcctcctgaatagttgggactacaggcatgtgccaacatgcctggctaatttttgtatttttagtagagatgggggtttcgccatgttggccacgatctggatctcttgacctcatgatctgcttgccttggcctcccaaagtgttgggattacaggcgtgagccaccgcgcccagccggtaggagggttttaatggtgattaaaccatctctgatccctagagagacagatgcctgggaaccttggaagcaggaatcatttgattctaattaaaacagaagggagtggcagtgaggaacaaaccatattgaggacagaggggaggcagctctgtgttcaaaaaaagaagaagggcgagttctacattctagcttggtgaaagcttttacagaaaagataataaagtatcagtttatctatacattcaagcctaaaggctctttctgtctgtgccctagaccacatagtttggaagtatttgtaaatctctggtcaagttcccatgcttttgataagcctgagcaagaattttatttacaacttttaaatctctgtcaaatcgtcttgtttctactgttttgtagcctcatttgtaatgaaaagcaacatctgtttcactgcacatgttggtaccactacagagccaaggctcacttggggcacgagaaggggaggggttgtccgccttcattcctcggatgaaccagtgaggaatagggagataaaaccttatggcttttatttcagaataaagcctgtatgtagctggggtgtattaatagaaagttgaggaagacgtttacagtcttcttagcagggtttgctgtatttccctcctttaagctggtcagcaacttgaatatctggcctgaggacacagcaactcatctataccctttttctatatccgttttttagctcctgaaaaaccttttcaccaactttgtttgcaatgtcaacagaaatgtaggtgttaaatctctcctctccccttctgttgtggtatttgagccactgctttcacagcctagctaaggactactctggacaactcaaggaaaatgtcagcagctcctagaaagagaaatccttttttttttttaatccctttttcttttgtttcttcactcctttctgctttttgcttccctcagttcctcatccttttccctcccaaatcattcatgatccaagtaagagaatgtctcaggtgagagaatgcattctgaagtaagtctgtccctgagaatgttagatagagtggggggctagaagggtctggaatagtaagaaaacaggcaaatgaagtagcagacccacaattcaagacccagttagtgtgcatagaaacactgaagaagtcccagccaggcagctatacttagtcgcaacaaatattaacatacacagaactcctttgttccactccttttctttttcattttctttaaatcaactccatcatcccttctccctccccaaaaataaagcttaactcttgataatttttaaactttatcagacacatttatagccacgtctcgatcctagagacataactgcaatatttggctgacatttttctcgtgttaaatcattgctttgcatttggcagggaggtatagtgtatgctttgggtagtttcaattttctgtacctcacgacaagtccattgtacacgcttgtggtgtttagtataacaccccccttcctttattagcatactactctgacatcaaagaactgagctgcatcttgcaatgcctgacagagcctttttcataggggtgggaggaggaggaggaggaagaagaagcgggttggaaaaggaagccttgtttttctcttcgtctcggtagatgaatcatgttcccacaactgcaattgggttttcaaacctccaaggctgcgggtgcggagctgaaagggcaagcagtgacgttcttgagagagaaggaaaaagggaggaggaggctggctagggagggaaggagggagggagggagtacagcaggagtggtcttttatttttttcccttttactctgctgtccttagagattttcaacttaaatcaaaaccaagccctactgcctggtgagcaagagagattccaaagactttactttgaaaagcatctcccagcttctacttttttttaaggaaaagtagattttctttgtctttgtttttgttttaagcaagaacagaatctaatgacttttttcatgccatcgctttgaaatagcgtcgtcttcctttctttctctccctcttcctggcaaagtatatactggatttttattgccttcttgggtttttttccctacgtgtatcggccgttatgcttagccagtttattctttatttttttactggagtcattgccagtgatggaaacggtgtttgcttctctttcagtcaagatctgcacaaagtatagcattaggtggtatttattgtttatattatgagttctacattcatctttccagcactctgaagttatcagcaagttctcagtcagttcaaggcattggattctgcttgatttctttttaattcattgtttttgacccctttgagagttttaatagagaggagtctggaaggcagagatctccaccacctaaccgtgagaaatttggaactaaggacttgcactggtccccaagttaacagtggatatacttcctgcattttctctgttctttcttgcatttgggcaaaatgtatgaacggcacaagaggcgctacagcctctgtgacatctccaaggtggacaggactgtggacgtggtattgctgaaggtaaggggggctgcacctcatgcattctgaagctctgcaggctgttttagcgctttgaacccggtagccatgtccctggccctcctgtattgggagaaaggccgagaaatctgtgcacagtggaggatgaggggtgaatgtaagcctcttaaaggaatatctgaacaggaagcaataggtgcttggtaatcagcattggaccacttactgttgaaatgtaattttactttcattaaaatggattcttatgcttgggagaacctcatactgttgaaaatcacagagagagaaattcaccttccaagttgctctgtttgtccttctgtctctgtcacccctccgcccccagactccacccccatctgcctggtctctttctctgtcagtctctctgcctctgtcttttaagtatttctgtcttttgtctgagtcttttctgtttttctgctactgtctcgttcaattctttaggggaaggataggcaacatttatttcttttggaaggatttccaataaacctatctattaaggtggcagagctgaccttttggcttggtttgactgcttttcagaggtagcttctgactttgttgatagctgtatttgtttgtgttctccgcattagtgatgtttggtgtctaagcaggatgagggcggagactctgaatagctaattgctcacagaaggcatccttgaatctaaaattagtaagaactcctccagccggtaagatgagagtctgggaatgttggacagctcaaagagcactttttggaaatttagcaattttctggcaaaggcaggggaaattggaagtcaaccaagcatttcatagatgacagaaagaacctcagtaactgaacttgtgagggtgtatgtggaggtgagggtcattttaagcaaagtggaaatatattgccttggtcaaggaaatagtggacctattttattgatttatcaattcagtttattacttgggtcttttcgatttttttctttggtcaagtgaggctaaggaatgggctcagaaggctagacacaaaaaccaatgaaatgccatgttgggcagggcactaggtagaggcgttgtgatttgtggtagagtgttgtcattgtctctccataatcactgtcaggtggttgacttgctgggcctcggctgccagcagttggtaacttggtgttttgaaattgttccaagatattattcattttggtttctcagaaatgtgattttctctgtgagatcacggtgatgttttaaaatttttgtcctcatataatgtatttaggagaatctcatttttaggatctttatgtccatgataccctatgattttgcctgcgggtggggagaaggataaaaagaaaatctgagtatcacaagaaatattgaacatttaaaataatgctaaaatatataatactttatactctaggtgggcatggaaagcccttgtgaatggagctaaatcagtacaggcttattggcctcagagttgctgttttatagttttaatgaagcacttccatatacgttacttaatttgagacttgccaggcagttactttttaccccatattcatatgaagagcccgagggttttctcgagcatggtaaggggtatgaagaatttgagtgacaagaatgtggttttttgtttttttgttttccccacaaacctacagctaataaaggtgtttgtctttgtgtatttgtactatcctgcccaataaataataaaagattttcagtggagaaaacttcacttctcagaaaatagtcattagtaaataaacactaggagtcctgaaaacaccctgtttccagtttgaaataagatggggacgtttggtgttagtttctttgctttggagatggagaagaccacatctttgagaactataaactcaaagaaacctaagtacctatcccatgcgagccacgggttacagtctttatcccattattgcttaaaggtagacaataaatagagaaataaataagtacaaactgttataattgatttgaaagaaatgagtagggtgctgtgtagggaataatgggcagaactatttcagatagaatggtctttagacagaagatcttttcgaggtgcagacatttaaaaagctgatctccagaggatggaaagacactagctatgctaaggaagagctctctagaaagaatgaacagtgaatacagggccctgaggaaggaaggaatggacagggccattgtggtggatgggagcaccttgagtggaaagtggggtagcaggatgagaaggccggagccagaggtgggacctggaagagcagggccttaacagctatggggaggatgccttacctctcagtgtacgtgttgaaaagattattctggtagtaatcggttagcctgccgttatgatagcacaggcaggataagaggattttgtggtctgaagtgggaagaagtgaatggatatgagacacaggcatatagtgtttacattcctactctttgtctcattttacgtacaggaaaacagattggtgtagttaataactttcccagtgtctcacatctcatatgtaattgataatagagtgcagtcccaggttggactgttttcaaagtccatgtttttcctgctattctagacctcttttttgagtcgataaattcctcttattacatgaatatgtatattagcttttattgatataagcgtatgtgttctttttctatcttagacttttgttctcttctttctcagtgcaggaattccttctacaatacttaggataggtacaccatgtcatataagttcattttgtcccatgatttttagcaaagttttctcacaattctaaaaaaccatttggtagtgttctccaattatttctacaaaattatttctaatttcagtattttctatcagtgttttaaaaactatagttgggtgcctgtgccacataaattctcaagccgtcatgtgcactttctccacttttatctgtggaaatttgcttttttgtactaaggagtttgtcatttttatctgttcattaatattatctaaacactcaaaacaacgtttgttggttaaatgaatttatctttgtaagtatggattcataagcatcatgttatataaattgtgtttaacagatgaggtgaaatatggcagtaattacagagtttaaattgtgagcctgtcactttggtattccacatttaacaactccaatccctcccattgacatcctaataattcactgtagattagcttcagcattctcattctgtgttatatacccacgctttatttggctgcttctgcattctgccctgcttcctttgttagttctgcatagtttcacggtagcttttctgtatcaagaccttcttgtaagatttccctgaggctgggtacgctagtgtcatcctcacatcagctcttctgtcccatcatcaacccccaatgcctctgaaatattacctctattctgaactttttctaagtaataaaacctaagttgatagtattccttggtcacccacctgtctgttctccagcgtaacatacacatacccattcctgttcctctgtatatgacattcccccagttctccttttcttgatgcatgcacttctgactcttacagtatgtggttggtaactatgaatcatatgctaaaaatgggatatgaaagaattgtaattgttggcatgggccctttggtaccaatatgcccattttcctcagcatccttcaaaaagctagtgttgacctcggaagttggtaactgatgggagctttcacctaactgagttcagtagccaactttagctcatggtgagcattactagaggacagcaggtatcagaaactgactgtaaaattagtgtaccaaaaggaagcaggtcagaatcaaggattaactgctgatttgcactgcttttagcctgggccattgctgttttactaattttataactttgggtacctggaaaaatactgcctgttaatagtaatgtgattcttcttgttactgatgatttatagagagtattttataggcagtaattcagaacattaattagctgaatggttaaaagatttgcaactgtgttttgtttacattgaatgaaaatatttacagagcaggacgattcccccccgactcacgacacttgggcaggccacacgagctcattggctaaggctgaggaggaatagtctgtctctaattatggtgtcattttgcagagaaacacacattccctaaaagtttgcttactgtaagagatgtccgcattgcaacaaaacaaaagacataaggaggctctggattgaagacaaccacatatatagccactcagatactgtccaattccctgaaaagactttgactcaagtgttggcttctatgtccggatggtgggtttttgcttccttttgttcagccttgtagctcaggcaggatctcctgagacagttgcagaggaagtaaatatggttagtggctgggaaggctgggtgtaaccatgagctgtattattaggatgttcagatacgaacagtaacagaaacactgccagaaacaaagacaattccctctccactgaaaatatgtacagctctatttctgactgatgggaacacattgtgggtgtggtttagggataatcacaaggggtccataggcttcatgtcagaaatttcagagtaacctggataggtctggcatttcttctgaggtaacttccattatcccatatttcatgtgcaccataattcaccagaagtttggatgttgaatacctgcggtgtccatgaactggttgtcatggagataatatggacaaaggaaaaccaatgactatgttttgtagctaaagtgtcataaatgtgattagagccaaaatgtatgttttggtgacttgtctctctaaaagatgtagatgtttaatggtaaaatctctgttttccacatttccagctacttgcttctctacatcacccattcactttcctacccatttagtcagttgccagtcctatactttgttcacagctgaagattccaaaagggtaaatctgaatagaaagatacataatcatcttcatttttctctttaaactcaaattatttgcattgccaacactgatgattttttcctatcccgtctcctaattctgctgatgatcagaatcttttgccaagcctagtctcagaactgactgagaagagtgttgatagtataaggatccaatttatctgttagcgtgaaaacctcagtctttgaatcacgtttggaaaagagactaacatgagaacaggatccctttaatgaaaaaaatgtctggtggcttttgatttcctgcagtgtatgtttcagatgtggccaggcacagtggctcacatcacgcctgtaaccccagcactttgggagattgagacaagaggatcacttgaggccaggagttcaagaccagcctgagcatcctagcaagacccccatcgcttaaaaaacgaagtttcagatgtctttccatgtatgtactcagggcctggcattgtatctggcctgtaggaagcactctgacagtgtttcaaatggagccacatagtgtggcgtttaagttgccttggttgtttgagtgagaaagaaatagtggagttgttgatgaatagaaccaagactagaacaaatgtatctgccacatcaatgattctgaaatagggcagaaggaggggggagatgttttgtaatcaactttacatctcttaagcagcttactttatagtaagcacaatattcttcacacatgaatatgatacgcttggtggtattgctgtttcacaggatgtggttgaaaatgctgatacatgttttgacattctttccacacacagtacatatggagcttgtcctctggttaatgacattgaccatgattggtagtgtctggcccagattactggctctgactctaactgtgtgggctgcctgactacttttctctaaacaagcttgcatatctctaactgctgctcattcatttcttaattgtgataaaaggtacataccataaattttaaccatttttaggtatatagttcagtggcattaagtacattcacattgttatataaccatcccaccagctgtctctccagaactttttcatattcccaaactggaattctttacctgttaaaacactaacttcccattctctttgcttgctagtttggcaactaccgttctattttctgtctctatgaatttgactgctctaggtactaagtggagtcatacaacatttgtccttttgtgactgtcttatttcacttagcataatatcttcaaggttcatccatattatagcatgtgtcagaatttcctttctaaggcaaactaatattcaattgtaagtatataccatattttgtttacccattcatccatcaattgacattgggctgttgcccccatttggctgttgcaaataatgctgttatgagcattggtatacaaatatctgtttgagttcctgcttgcagttctttgcatgtatacccagaagtggaattgctggatcataaggtaattgtatgtttaatttttttttttttgagaaactgtcatactgttttccgcagtgcctgcaccattttacattcccaccagcaatgaacaagaattccaatttcaacacatcctcgccaacacttattttctatctttttttgtttaaatgatggctgtcctgttggatatgaagtgttatttcattgtggttttgatttgcatttccctaatgcacacttacttttgtcctgtttgtgtttgtaagaagccagcaagtatgagctttccaaaccaccccatctgcgaataggtattatttactatgaatgccacctttagtgtgtcttttctttttgcaagctctgcctttgctctcctgcttgctcttttcgtctgttatctcaagaacaaatgaagctagcgccagcctttctctcaagcttccgaaaccttgtgtaaccatttgcaggacatattgttatttcaaactcaacatgggcaaatggagtacatcatcttcttccctctagatttcctatttctgttcattgtggatctttgacctgtttttctctcttacttctgtgaattttgccctttgtactagctctctgatgtataccttttatgtgcttcccagtccaggtatacactacctctagactagactagttcaggctcatcctaattggcttttgtgtctcagatactgtgtgtttccttcctccctactctcccattgtatctgtacacatctagagttattggccaagtatagtactgatctttttactacctttcttatatgattgacagggtccacccttgttagagaacaaagcctagattcattgtagctgtatctcctgttgttcttccttgctcagtttacatttctggatactgttgggctttttgtgttcctgaaaaacatcaaaagcaaaggtctttagcctgggttatgaggttatgcaaagaaccgccgattgtgacgtagtgtgcacgttcctggtgagggttccatggcttcctgcagattcttgaaggagtctgtgacgtgaaaggctatgaagtccagctctggagtgtcctaactgctttgctcatgcttttttcgtatagctagaattccctgccttaccatctttctcttgcaagcatattgtccgcttttaaagcctacctcatataccaacgcttttgttgagcttttcccagattcttgagcaggaattattttcatgctggggactttcttttgtggattttagctatttgtgtacctattgtattacacaaattaatcagtgtttccaaacttataggccatggtttgtggagctgtctcactgaatctgataatccgtagactcataaggatgtatgtatatatctatcatcttgggatgtcaagccttcgtaacccaaggcattttgtgttaaaattatacttataaaccgtggtagctactatgccaattgtaatcagaatcatctttttcaccttcttgtctattgctgtaccttaacctggtttcttgcctaaagtgagcactccataagtgctgctggctagttgtgtggatgagtgtcagtgtgtagctgacagcaagatagtgttaagaagccgccttctgctagatttcccaatcctggtgcagaagccccgaattatcggaaatgttactgttcttcagtatgggttttacttttaaatgtttacgaatgaagcctaattcagaagagagaacctgcccgaaagtgtgcatcatctcagatctgcttgagcttcttgtgttcttagagacagtgagcctcctcaggacatcattgttaattaactgctggtgattaaaaccacaggattctagtaattgacagagccaacaacaaacaaacagcagtttttttttcagttacagcattttgatatttaaaaaaattggtatccagtttcatattttacttgtgtcatttcagtaatgccttattttctaaatatttttgtctaaatcaacaatgactgttttccaataaatctttcttgaagatgtgaaatacactttgccaaacttattcaatttaatactaaaaaattgtaaacaattattattgaattctaagacaaatataagaataagaagagatggcacagtggctcgcggctgcaatcctaatgctttgggaagccgaggtgggaggattgcttgaggcttggagttcaagaccagcctaagcaacattgtgagacccctgcctctccaaaaaaatttttaaaaaacaactgggcatggtggcacatgcctgtagtcctagctacccaggaggctgagacaggaagattgcttgagcccaggagtttgaggctgcagtgaggtatgattgcaccactgtactccagcctggggtgacagcttcttcttctgaaaaggaaggaagtgagggaaggagggaaaatgaaaggagaaagaagaaaaagggaaaagaacaagaagagactcttgagggggaaatttgtggtggactggaagtgaggaaaccttgggtcctctgttttgaaatatttattactttcatcaaattactttgcctcctttggcctcaggttttttatgggtctagtaaagggaagcagggctgtaatcctcagggagtctctccacttttttcttcagaatcactgaggataatgaattcaaagattattcattaggcatccaccatgaaccatgcacttactactcattggggagatccgttaaatagatgcgattttgttctctggaagcttatggtcttttgagcagataaagctataaatacaatatagttcatctacatgtatgctctccacaaatcaccaagcctcactgagtgtgttttcttcctctctaaaatggcaacatgccttctcaggggtatgtaaaaaggtcaaatctatgggatggtactttaaagtatcatgaatctagaaatataatgagttcctttacagcctttttttttttttttttttttttttttttttttgagacagtgtctggctgtgtcacccaggctggagtgcagcagtgctgtcttggctcactgaaacctccacctcccgggctcaagccagcctcccacctcagcctcctgagtagctgggattacaggcgcccacaaccatgtccagctaatttttgtattttttgtggagacagggtttttccatgttgcccaggctggtcttgaactcctgagctcacagttgccaaattcagtaacttctttttgttttgtatctgctttgacttctctgcagcagcttctgtgaagctctaatctcccgagttctctggctcttagacactggtgtgtgccatctctgacttctctattctctgttttttaacacatacacacacacacacacacacacacacacacacacacacacacatcatgaactaagatggaaaattgtaacacacacacacacacacacacacacacacacaaacacaatgaactaagatggaaaattgtaattccggcccagtgtctctgtatatataacatttgtgacccaaccagaaatatacgtagcacgaaaatactctatgcaatgtggtgttccattcactgtcattcccatctctattaattacagcatgcattgtccaagtgaacacacatttcattgtctactatgcaagatgctatggtaggcttattgaccgacctaacattttcacatctcacatgtaagctgtgagttctttgaggacaagctattttactacttctgcttttaaggcttggttggtacagtgtttattatatagaagatacttaacacagtttttaaaaaatagaaggatagaaacatcccagcatggcgagccttacatcttcacacaatcttccttttctagaaagtaacaatagattttaaaatagatttttccattaaaaaaaagaaactcaggatgagcacccatgtcacacctactgtggtagctacaataagaaagataacaaaaataggtgttgacaagaatgtagaaaaattgttgaatggtacagccactttggaaaacagtctgacatctccttaaagtattaaacataaagttaccatgtatgtaacccagcagttccagtcctaggcgtatgcccaggagaattgaaaacatgtccacacaaaaactctgaatgttcatagcagcatcattcgtcacagtcagaaagtgaaaaaaaaaacaaccacccagatttccatcaactgatgcatatagataagtaaaatgtggatatatccatacagtagaatattatttggaaataaaagaagtaaagtactgttacatgcttcaacatgggtgaacctcaaaaacattttgctaagtgaaagaacccagcatgaaagaccaaataatgtgtgactctatttgtatgaaatgtcctgagtaagcaaatttgtagagatagaaatacattcgtggctctctaggcactaggggacaggggatgggggtgaggcatgactactaatggatatagggtttctttttgtcaagataaaaatgtttaaaattacatagtggtgatggttacacaactctatgaatatactagtactattgaattatatacgttaaatgggccagttttctagtatgtgaattacatctcaataaggatgttaaaatgcaaaataacacacacacactttctctctctctctctctctcacacacacacacacacacacacacacacacacacacacacacacacacactaaatgcaatgtggtgatttggatgggatcctggaacagaaagagaacactaatgggaaaacaagtgaaatccaaataaagtccggagtttacttaatagtaatgtaccagtgttggtttcttagtattgacaactgtgttatggttatgtaagatgttaacgttggagaaaccagtgaggaagggagtggggataaacgggaactttctgtgctgtctttgcaaactaaagttatttctactttttatgtatactattttttgtatcagcctgaagttgttacaaaataagtttatcaagataaattttttaaaaataaaagaaatatataaccattgaagaaaatttgggaaactacaggaaagttaaaaggaatataagttgtctctttgtggtcgttcagacatatccacccaattgaaaatagattaggagattgcaccacagaagtgtaacatgtcaagagatttttggctgccactgtgtgtaaaatttttaatactatataatatatactaattgttaatgtggtggatcggaaattgttccgtacttgcaagctggcaagttaacttacatcctgacacagtttcatgggtgctggctgaagtcatggcattctagggtcagagacaggtaaatgtattactcattgcatagccagcagcatcagcatcaccttctcgttggttctccttgcttcctaagccctatgcaggcaacacgaaggggtccaggttgatgctgtgtcacagctgagaaatctaaacctgaagaaatctgaatttttatacagtggacagtaagcctgtgtgacctttgcccttgactgagacattatctttataatactggacagaaacaaacctgccctttgcttcggaaggaaacagtatttttatcttctaagggtgtttgatatacaaacagtcttgaaaagatagtctagaataaaaggaccatcagggcttttgctgataaaacctgcagaaatgcaagagggacatggagaattgttttccaacatgattatgttctcatcactgttattatgttctcatcactgttactcagaaattagcatatttacttaaagatatgtaactttaattttgttctagtagtatgtgtttattgtatataattttgtaaaatatgaaactcactttatgtaacacatgtacctaaaatgacaggaaaagtatagagagtcttagttgcttgcatattcaaggcaaataatgttcactttactcattggctgtggaatgacatgtggtattgagaaggtaatgaaaagtattctaagaaataaaatttttttttttttgaggcggaatcttgctctgtcgctaggctggagtgctgtggcgtgatcttggctcactgcaacctctgactccatggttcaagcgattctcctgtctcagcctcccaagtagctgggactacaggcatgtgccaccacgcccagataatttttgtattttttcagtagagacagggtttcactatgttggccaggatgatctcgaactcctaaccttgtgatccgcctgcctcggcctcccaaagtgctgggattacaggcatgtgccaccgcgcccggcagaaatagaattttaatagggttttctaaactgttggccccttgttgaaggtcaaggtaagagacagtaatatggtaattcgtagtagttcatttccacattctttacttatcactaaagaatcatctgagctcttttatttctgtaaactaaacttgttgctgtattcatgcagcctcttcttattacaggaataataggggcggggggggagtaattttttcccttccagcttaaaagtgtagttttgtattgcagtacagtggttctattagcagagaatcttatttcacagtaagtaaaatttggctcattgcaaatgaaatgccatttgaaattaagagaaaattctctgaatgactttttttttcttttttttttttttttttttttttttgagacggagtctctctttgtcacccaggctggagtgcagtggcacaatctcggcttactgcaagctgagcctcccgggttcacgccattctcctgcctcagcctcccgagtagctgggactacaggcgcccgccaccacgcctggctaatgtttttgtatttttagtagagacggggtttcactgtgttagccaggatggtctcgatctcctgacctcgtgatctgcccacctcggcctcccaaagtgctgggattacaggtatgagccactgcacccggccttttttttttaaaaaggaaaatgtgttgtttcaattctttgaaagatgtggatagggtgttggtaaagttacaaaatttgtggttacttccttattgtgtataccttaaagtacctttcagaaaggatatttttaaatatgtgtaatcccagggcacctgctgaagattcagttccattcaggattacttttaaatttttggcatcattttgtaacacaccaggaactgaaaccttgatggcccctgattcttgctgtttttgctctctgtaatagtaaaatagctgaacagagcaaatgataaagtgttttgtttcatgtggttctagtttgcctggttatttgcaagcagtttaattcctttcattcattttattgtcagttataatttgacaaaatgtctctagctttctgccttatgccacttagcatatacagtaaaactgttgatctttgtcagcagaagagtttaagattctcactaaagtgatcagaaatatattttagaggttattgaataaaatcaaggcttctgtctttgagcatacaaatattcacaactacttagtagtttgtttagatatttctgctcatattatttagaattacatctaagtatgtcagttttaatgattaaagggttataatgttaaggtgtgtgggaattgtgaagactaaaatttattttatattttatacttctgtttttgagaatgtatttgttttcagctttattctggtataaatttccatacaacaaaattaaccaatataagtttatagtttggtgagccttgacaaatatttaaattgtgtaatcactaccgcatcataataggaacacttctgtcagctcagaagttctgttctgtctccctgtagtcagtcttctccttcattctctgctgatcactaatgttttcttgctactgtaggcttgccttttctagatattgcatggatagaaccatacaatacatagtcttttgagtctggcttttttttttttttaacttaccgtaatactcttgagattcatccatgttgtttgtatcagcagttcatttcttctttctatgaatctataacattgtatggatatattataatttgcttatccatttaccatttgatggcaatctggactgtttctagtttggagctctcatgaattaaagcgctttaaaaattccagtgcaagtctttgtgtgacagtaggttttgattcttcttcggtaaatgaatggaatgctatgttgtatgtaagtatatgtttgacattatgaaaaactgctaaactgctttcccaaaatggctgtactattttgctttctttcagcaacagtactgtgttctagttgctccacatctttgccaacatttggtattatcagtctcaaattttgactcttgtaatggatgtctgctgctatgtccttgtgattttaatttacattttcctgtggattaatgatgttgggtatcttttttttgcttatctgcctttcgtatatctttttaaataaaatgtttattcaaatcttttacccatttaaaaaatcatgttgctttgttactgcattgtaagagtttcttttatttttaaatattccgggtaggagttcttagcagataattgttttataaatattttccttcagtttttagtttacctttttgttttcctaacagtggcttttgaggagtaaaagtttttaaggttgacatagatttatccttttttttcatgttttaaaaaatgtactatttaagaaatctttgtgtaaccgaagttcccataaaagtgtttccctctgtcttctttaggagttttatagttttaggttgaacatttagatatataaagtattctgagttcatttttataggtggtaaggtttggggtaagattttagatcttggggagttgtatttgtttacatattagtatccagtcgttatagcatcatttgttcataagactatttgttcctcattaaaatatcttggcatctttgtcaggaatcaatgggccatatctgtgaaggtctgtttgtggattctctcttctctgccattgatctatatgtctgctgtttaatatcaccccggtttggttagtgcagcttttatagtatgtcttgaaatcatgtagtgatcaatttgaggacaattaacaactgtattgagtcttctgatctcatggaatctctgtatttatttaagtctgcattaatttttctcaacaatgttttataaaggtttcagagtatgagtcttactcatattttcttaaaattatccctaattattttatatttattgaggcttttgtaaatggtattgcttttacttttaatttcaatttctaattgctcattgctagtatgttgactttgtgtctggcaaccttgcttttattaatacattatttattccagtatttttatagattccttaggattttctacataggcagtcacgccatttgtgaataaaccaagttttacttcttcctttccaatggtatgcgttttctttctttttctgctttactgcactggataggacctccagaatattgttgaataaaagtgatgagaatggacatctttggttactgatctcagaatgaaagcatttagtctttcaccaataaatataatgttaaccgtaggttttttatagatgcctttgtcaggttgagtaatttcctttctgttcctagtgttctgagagtttttatcatgaatagatgttgaattttgctgattttttttttttcctttgaggcagattcttgctttgttgtccaggctggtgttcagtggcacaatcacggctcgctgcaacctctgcctcctgggttcaagtgattctcatgcctcaggctccctagtagctgggattacagagacccaccaccacacctggctgatttttgtattttcagtagagatgtggtttcaccatgttggccaggctgatcttgaactcctgacctgaagtgatctgcctgccttggcttcccaaagtgctgggattacaggcatgagccgccgctcccggccccaaattcttttcatctaatgatgatcattagttcgtgagttttttggtcttttaataaactggtttttcaagtgctaaaccaaccttaaattcctgggatggacccatttgctcatgatatatattgctggattccattaacctaaaattttgttaaggttttttgcatctgtattcctgaggaatattgatctatagttttcttatatctgtctggttttgatttcagagtaatgctaggctcataaaatgagctgcattgtaaatacttttcttctgttttctgtaagagcttgtgtagagttgacatttctttcttaaatgtttggtagcattcaccactgaagtcatctaggcctgaagttttccttgtaataaagttttaaactatggactcaattgctttaatagaataaggctatttagattatctatgttttcttgagtgaattttggtagtttgcatagtgtcatggaatgctatttcatccaacttgatgaatttattgcagtaatgttcgtaatatttctttattttttcaatatctataggatctgtaatggtgtcactctgtaattcctgattcctgtcatttgtcgcttttcttttttgattagcctcgccagagttgtattgatattattgacccttttaaggaaccagcttttggtttcattgattttattgttcttctgtattctattttattgatttttgttctttattttctttatcctgcttgctttgggttaatttcctcctctttttctagtttcataaggtagaagtttagatcactgatttgaaaccttatgttctaatataggcatgtaatgttacaaatattgctgttagcactgctttagttatatccacacatttttatatgtggtgttttaatttttattcaatttaaaatattttcttctttttcttaatatttctactttccctgggttatttagaagttttttttttttttttttttaatctctgtcacccaggctggagtgcagtggcgcgatcttcactcactgcaagctttgcctcccgggttcatgccgttctgcctcagcctcctgaccctgagtagctgcgactgcaggcgcctgccaccatgcctggctaatttttttgtattttttttttagtagagacaggatttcaccgtgttagccaggatggtctccatctcctgaccttgtgatccgcccgcctcagcctcctaaagtgctgggattacaggcgtgccacgcccagcctatttagaagtttttaaaatttttttcaaatatttgagtttttccccagtatcttttgttttggatttctgatttaatactgttgtgatcacagagcatactttttattattttaattctcttatatttaagacttgttttgtgctacagtatatgtttgttttatttgaggtttgttttatgtgatacaatatgaacatttgttttatttgaggtttgttttatgtgatagaatatgaacattccaagtgcacttgagaatgtttcttatgctattattgggtggagtgttctatattgtgttagctcagattggttgaggtttttcaagttttctctatcttgctgattttgtttgtgtttatcaattaagagaggagtattgaaatcttcagtggtaattttaaaaatttaaaattcaatcaaagagaattataatattaagagggttgggaggtgtaaaggcaatatttaaattttttttaatttgtggggaagggggaagtatttgctttttagaataacacagacttggcattccagcaccagtcctgctgtttattacttcagcaacccctctgagcctgttttttttttttgagatggcgtcttgctccgcccaggctggagtgcagtggcgcgatctctgctcactgcaacatctgcctcccgggtttaagcaattcttgtgcctcagcctcctgagtagctgggattacaggcgtgcaccaccaccatgcctgggtaaattttgtattttagtagagatggggttttgccacatttgccagacttgtcttgaactcctggcctcaagcagtcctcccacctcagcctcccaaagtgttgggattactggcatgagccacaccaaatatgtattttaatatttagtcaatttcatttgttaacttttttaattttacccttggcctacactatggccttcatcttcgtgtatcttttcttattgcttttgtatgcctaatttttattgacaacctctaaagatccttgagtatagattgctgtggtaatattgtgaaaaaaaaatttttttcccttgacataagtttgctcaccctgtattaaagaaaaagataggaatgttggtcagttgacataattttggcacctgtaaaattatctcacattacttcaatgtctgaaactctgtgttttctttttctttcagataaaccgagaaaactggtgtacaatagagccatgccctgatgcagcatctcttctggcttccaagcagagcccaggtaagctgagattatccattcattttctggagctgcagccccactctggcagatcgttttatttggagatctgcccttccttagcatgttatacagtaaatcagaggaagggatgtatgtgatctgggtttgtaggcattttgtcttacagttgaagatgaacacatgtaattaccgaattttgttttggtagcaacagacatcataggtggctttatgattcattcatttgtgaaggcatctgtgctgtgcatatacatatgacataggatttttaatctggtaaaagtataaatatactgttaaccaaacctgaggttctcaattttgaatgcacattggaattatctggctgaacaagctttaaaaatatactgatgcctgggtcctacctccagatattctgatttaattgggtggggtgtggcctagatatcaaaatctttataagctcctttgattaccctgctgtgtacccaaggttgagaaccattacactttggacacatggtcaggaattaagtctttccttaagtacctttgagttattcctaacaacacttgagggtacgatgctcttaagaccttgcttgttaatgacacagcacatagcttgtgattagttaggattcccaacttttaaaccaggtccagcctctaactctgtgtgatgtaaagtatgttccctaatgtctgtgtgctccgttgtctccctcccatctgtaaagtgttagtagcctgtctcattttgagggtgtagtacagatgacatgatgagtaatccctgtgcctgttctacgactgctaagtgaatactagtaatttgcattctgagtttttttagtctgttttacccagcaagcctctgtttgccttcccaatttttactgcccagctttaaaaattacctagtcttcatttgcaggtctttttagaaatagtttacatgtagataccctccagtagtattaaatttaaaaacaaatggttttgaatcctctaactccagagcagtttcctactgattgtcaactctctaactttactacaaaggaaatattgaaaacaaatatgagaagtgtttttctctatttttgtctcattttttgagagtagttaaggatattatgctatagttgtgttcagggtccaagttttacaagattggccctgttcacagatttagctgacacttcccccatgtagcctcctagaaccttctacttaaacgtgtaccacttactactgtgttttgggtccttaaactgtttggggctttttctaaaagtgtaattaaaaccacccaagagtgagactttctgccaagtaaaggttaaatgaggttggtcacagtttgaatattcataggaaggaaagatctccacacatcatagtttaatttctatatttagagaaataatttttgaacccctggatgttttccccaggacacaattttgaattctgtagacctactgtacaccctaaccccaagcataagcaatttagtctttttagagtaattattgtaaaatctcgatttaacagaattgcagatcagaattatgctactgagcttcagacctgagattttgattttaggcatagtgtttttgtgaatcccaggtactttgttttgcaggtttctgtattttactttatacacacttcctcaagagagcaatagcattagaccaaataagatattgtcttttggccgggcgaggtggctcacgcctgtaatcccaacacttggggaggccgaggcgggcagatcacgagatcaggagttcaagaccagcctggccagtatggtgaaactcccatctctactaaaaatacaaaaattagccgggtgtggtggcacgcctctgtagtcccagatactcgggagactgaggcagaagaatcacttgaacctgggaggcggaggttgcagtgagccaagatcatgccactgcactccagcctgggcgacggagcaagactccatctcaaataaataaataaataaataaataaataaataaataaataaataaataaataaataaataacggagtctcgctctgtcgcccaggctggaatgcagtggcacaatctcggctcactgcaagctccgcctcccaggttcacaccattctcctgcctcagccttctgagtagctgggactacaggtgcctgccaccacacccggctaatttttttgtattttcagtagagatggggtttcaccatattagccaggatggtctcaatctcctgaccttgtgatccatccccctcatccttccaaagtgcttacaaagggattacaggcatgagccaccgtgcctggccaagatactgtcttttaaaatcactttgtatactcttcaataatggataaattacaagatagaattatgattagtgtgacataacagagcccaccggatttcagcagtgtgttttcctgcccttccccaacaacagtttgttggcatatatgttgttttaaacctaaatgactagataacaccttttaaaaagtttgtattatgttagcttctgaaaagctaatagctcagtacacaaaaattacagacagatttacatatgggtcataaaatgggactggccctacctgtgtccacctttaaggtactgtcatctggatacttactgaatcatacattaaaggttaatgaagccttaacttcattagacacatatatcacacacctgctatgtgctggaaaccagagttctggttactgtatgtataaattattcctgtcactatgactcctttagggaagtactaatcatctcttgtcactgttatggaaatggcaactgagaggggtgaaattacttcttgcctggaatttttcttctattaagtagtcagacctagatttaagcctgatcagtctaactaaaaaaccagagctctttactcttgtttacacttagatatgccgctcccctttattcagtaggaaggggacaaataggaagaaagaaaagattttattaattttgaaaacttaccaattcatgtgacacagggtgtggattagctctgcctttagggattccccccacctccccccgccccatggcgttagggggttataatggtttacggtccctctctctccatcttagcccttctttctgtacttttccctctttccctcctcaacagtcagctttatctcacagagcagactctcgtcccaaacttggtttgttatcccttgtggtgctggcttgaatttattttctgggtgaggtattcctcccagggctgaatctggatcttccccatgaattttccattcgaatatcgtgagctagtttgttttccagtctggaatttggacgtggtctgttagagggccagctggacagcgagcagctcagcgtagttgctgtgacagccctttcttttcttggccagcccccatatttttccctcaaccatggaaaggcatttttttattttttcaagcagggaaaggagaaggaatagatcacacccaccaactcctcctaggttactacatactctaggaaacgtgaaaaaaaaaaaacctccagaatacccatagtttccagtctgttaaaggcagggctgttcccattgaactaacacactccaaaatagtttgaaccaagactgaaacagactaaggtgattttttttttaaatgaaagattttcagattcatccatgagccctctctcacttcctatggcattttttttttttgtaattctttgttgaaattgtcttctaatatgttcatttctgctacaagacagtaaactgcttcccccccaacactaaacatttctttttatttggttactccccagtatttagccagatgcttaactagtagaaaaagtaattttattggcaggggatttatgacctataccaatgcaatgcaatgcagccttgacccttgctctaagctaccagcgcaaataattcagtgattatcactaattacttaactgttaattagaagaactatttcttcccactttcaacacacagagacaacataattaccatccaggcataaaatctaataatcaaaggagacgttggaagttatgtagtccaaccctcacttccctctctgtgcagataccttttctgtaatatcttgacatagtcattctgtgttccaaaacccttctggtaaagtgatagtcattactttataggccacccaacctattgctaagaagccccgttttagtgaagctctgtagctcacactcactggtctttgcccctggaacagtacagagggaatctgtgacagtctttaggcacattttcttcaagctcctcggcaagctgtatgtatctcagacggtttgactgtcgtgaccccattactacgtacacatttttgtttatcagtgttctacttgagatgttatttaggaacaagtacagtcccgagggtgtggtctggatggcacatagcgacaggactgtccccgttttggatgcccgtgtactatttactaatagagactaaaactattagtgtttctttggttttgtcatcaccttgtactgtcagttccttttgaatttgcttcccccaaaacctccaagtagagttctctttaactcctagatagccaggtttcttgccctgtccctcatcatttagtgtcacctacaaatttgataaagcatgcctacctggttgtccaaataacacattaacttgcttacaaaaacagagatgcatgacttttatcttctttttttttttttttggaaatgaagttgctctctgtcacctaggctggagtgcaatggcgtgatcttggctcactgggctcactgcagtctccgcttcccgggttcaagcgattcttctgcctcagcctcccaagtagctgggattacaggcacctgccaccatgcctggctaattttttgtatttttagtagagacggggtttcaccatgttgaccaggctgttctcgaactctggccgcaggtgatccgcctgcctcagcctcccaaagtgctgggattacaggcttgagccaccatgcccggccatgacttttatccttaaaacttcttagggccaggcccagtggctcacacctgtaatcccagcactttgggaggctgaggcaggtggatcacatggtcaggagatggagatcatcctggctaacacggtgaaacctcatctctactaaaaatacaaaaaaaaaaaaaaaaaaaaaaattagccaggcatggtggcacgtgcctgtagtcccagctactcaagaggctgaagcaggagaatcgcttgaacccaggaggcggaagttgcaaaaacttattgaaggaagctcatatccactcagtaatggacttgggttcttggtttcaccatccacaaatctctttaaccgtgttggtacccagtcacatgtcacttttgtttacaaagttaatagcctgggcaacatgccaaaaccccatctttacaaaaaataaactggacttggtggcgtgtgcctgcattctcagctacttgggaggctaaggtgtgaggattgcttgagcccaggaggtggaggttgaagtgagctgagatcatgtcaccgtagtacagcctgagcaacagaacgagaacttgtctcaaaataaacaacacaaaacagaaaagcaaagttaataagagagaataccttgcttatttcaagctactaagtttttaggcttcctcaatgtacaaaggtagtatttctgtcacagacccctccctctagcttgccagggtccctgttctagttattgaaccgaaaacattctaaatgataaatttttccactttggcatattatgcccccaatttaagagctatttatggtaagaaaagttaaattatatttctgttattactcagtagaacctataagtttaaaacaaaccccatcacatagttgctagtaaaagactttggattttgaagacaaaagaaaaaaaatgccctcactaccatgaggaaagcattaccattcaggtatctaaatagaagtagaatatgcttctaaatcatccttttatctttctgtacctaatataaacgtggcagatgcatgattgtcctgtaggagctatttcaacctagaattggagtagcagagctactaatttgactgtgtccttttatagcttcttaattttgaaaaaaagaaataaggagggaaggaagagaaaagagtgagagagagatttaaaagactggttgctggggtgaaaaggaagtggttctttttgttttttggtttttttgttttttttttttcaatattggtgaataaattctctttttcagaatgtgagaacttcctggatgttggactgggcagagagtgtacctcaaaacaaggtgtacttaaaagagaatctgggagtgattctgacctctttcactcacccagtgatgacatggacagcatcatcttcccaaaggtactgtgtggaccttcctttcatttttgtcacacggcttttgtgttcctatttgggcttcccaaactcttttccaactttttccccctcttgtgctctcctgtttccctaaatatgtaactcctgctagtaagttgtgatccagctagccttgtagggcctcactcactctgagaggcatgtaaatgttctttggagaaggaagcgccagattaccagggtttagaaaaaggcactgggctgggcatggtggctcacgcctgtaatcccaacactttgggaggctgaggtgggcggaccccttgaggtcaggagttcgagaccagcctggccaacatggtgaaaccccatctctactaaaaatataaaaattagctggacgtgctcacttgaacccaggaggtggaggttgcagtgagtcaagttcgcgccactaaactctagcctgggtggcagagcgagactctgtctccaaaaacaaaaaaaagggaaagaaaaaagcattggccaaagttatttaatgtgaaattgtggccagttaaatacagattttgaagctcacttgggagtcagaagaaatggaagttcctttagaattaattaagtcagatgacagtgaacacttctcagtgggcagcaaggaccgcagctcagactatatgatgtcatatttataaaccagctgtagagtcatttctggttaatgtgtttaggcctgaagcttcctgctgagtgtggtcatatcactcatcctcatctagcctgcctaattggaactttctagatctctgcaatagagcccttccacatgaatcagctcacatttgcatataattggaggctgcctaagggaggtggggaatgggggtagtttgctttcttttgcttatatttgtttctagtggcagcaagttctgttttgctcacctgagaagaatagagggctttccccacagcagagatggcaaatgctactcaattatatgccacaagtggttttcttaatggtaaggaggtgaagaggcggaaacactgttgcatctaccaacacggttccttctagttttataatgagctcggagaagtggtgagagcagttgtgttagtgggtgattaggttgtccaagatggtgaatgatgctgtgtagaagttacaagaataggccgggtgtggtggctcatgcatgtaatcccagcactttgggaggccaaggcgggtagatcacttgaggtcaggagttcgagaccagcctggaaatggtgaaaacccgtctctactaaaaatacaaaaaaattagctgggcatggtggcgcgtgcctgtaacctcagctactctggaggctgaagcaggagaattgcttgaacccaggaggtgaaggctgaagtgagctgagatcacaccactgcactgcagcctgggcaacaggagtgaaactccatctcaaaagtaaaaataaaataaaatagaagttacaagaaaagagacctaaagatttgggaatcaggagcatatcagtgcctctgtgaatgtaccctgtgtgccttcctttcatttttggccttccctgacttttttttttttgaactcattgtcttcccaaggtctttggaaagacttatttaatatgatgcaaacttaaggatttctatcattgtcactcatagtgacttgacaaaaaattctatgaagtaaaaactccacatttaggaccgggcgcaatggctcacgcctgtaatcccagtactttgggaggctgaggcgggctgatcatgaggtcaggagatcgagaccatcctggctaacacggtgaaaccccatctctactaaaaatagtggtggcgggcacctgtagtcccagctactcgggaggctgaggcaggagaatggcgtgaacccgggaggcggagcttgcagtgagccgagattgtgccactgcactccagcctgggcgacagagcgagactccatctcaaaaaaacaaaaaacaaaacaaaaaaaactccacatttagaagatctgcctttctctttacttaggaaaagagaaatcaatagttttatgttattttattttttttttaataatatcagaatttaggtaatttccactgcgactttcgaggttttaattgtaaggaattctgttccccgcaaggggaataccattctgaagatatgtgtcgctaaaaacatactgagataaacagattagatagtatctctaagttccagctttaaaatgggatcattgataatcattgaaactaggtcatggatatacagagatttgttaaacatttatatatgtttgaaaattttaacgtaaaaagttttttaaaaatggaagtgtctttgttaagaaatacttccttgcaacctcctaggtgcatgacagcttgtgcctggatgttaccatctctgcagactcagagttacttctggtcacttaattgaatggttttcttagctaaggagaattagaattttctatatttcgccgtcttattttcccagaaccatttacaaaattgctcatataaatggcctgtgctagatttggaagattttttttttcaagaatattagacatataatttttaaaagttgaaggaggccaggcgtggtggatcttagcattttgggaggctaaggcaggaggatcacttgagtcaaggagtttgagatcagcctgggccaatataatgggaccttgtctctacaaaaaataccaaaattagccagacatggtggtgcacacctgtggtcccagctattcaggaggctgaggtgggaagatcacttaagtgtaggaggttaacgctgcagtgagccgtgatggcaccactgcactccagcctgggcgacagagcaagaccctgtctcaaaaataaataaataaataacacctacattttatactagactgcttagggaaaaccagaaatggtagcttcactttcacctcctcatgcatgcttgagaatgtctgcatggcctgagaagagatggggaggatttttctcttagtgtttttgctgtaccaaagtagcctgtgaccaggagaggctttgcaataaatgtttgctctagcattaataaaaccaagggctgacttacaaaaaggagagagactaatattgacaggatacttactgtacagtaggtactgaactaaatttttaaaatatttgatctcaatttgtctgcccagcaaccctgacaagtgggtggttttatgctcttgaggaaatagaggcactgataggtaaagaaatgtatccagaattacttagtgggtgagcagccaacttgaggtttgcatctaggcctgactctaaaatctgttcattttttattttactctcaacctccccaaacctgctctaatagccagtgattaaataaaagcgtggcactggcagataggccatcagctgcttccttaaaagtcttcctcagtggtcacccccagagtgtgctatgcaaaatatcagaatgtcttgcagtttgttcccaggttctaaccctcttctccatctctaaaaaataatctgtaggcgagacattgcaacatctttttctgtgaaccatgagtggtacatgaggtcacttcctgcagccatttgtgtctctggcctcacagaggtctttaacagcccgtaacgtttgtcgtgaccttttcaccttaaccctgtctttccattcagtatgcctcctggtaaatgactctttagtgagtgttatgagcttcacgtttattctcatgaatatgtgtgggttcctaaggtctttaatcaatagcataaaatttagattttatttttaaagtgaaaagaaatcctaggattctttttggcactagctaagagagaaagtacgattataaaatatacatgatctaggccactctactatccaaaaggataattaaagtctacaggaaatattaatagttgctgcctgtcttcccaaagagaggtaaatcaaggtccttccatgttatttttcttccccaggttagcagatgtatctacaattgatttaaaaaaatcagaatgacttatataagatacaaaacctaaagggaacatccttctttcatgtgttgtagtttttctcaggtccttgatccccaagccaaaaaattacttaaaaaaaaacaataaacctttttgagataaaaataaatgtaagccaggcatgctggttcacacttgtaatcccaacacttcgggaggctgaagtgggaggactgcttgagtccaggagattgacaccagcctgggcaacatagtgagaacctgtctccagtaaaaaatttaaaaattagccaggcatggtggcacacgtctgtagtcccagctacttgggaggcagaggcgagaggatcacttgagccttgaagttcaaggctgcaatgagctgtgattgtgcaactgcactccagcctgggcaacagagggagatgctgtcttaaaaataaataaaagtaaatgtatttacagaatcctaattaagaaaatgacaattgcggctgggcgtggtggctcatgcctttgagaggccgaggcaggcggatcactggaggtcaggagttcgagaccagcctggccaacatggtgaaaccccatctctattaaaaatacaaaaattagctgggcgtggtggcaggcgcctgtaatcccagctactcaggaggctgaggcaggagaatcattcgaacctgggaggtggaggttgcagtgagctgagattgtgccaccatactccagcctgggcaacagagtgagactccatctcaaaaaaaaaaaaaaaaaaaaaaaaaaaaaaaaaaacaacaaaaactgcaattgcctgtgcacaagtgctgaaattattaaaaacttaaaactgtgaaccagtggtaatgcttgtaatcaggtacttttcttaaaatattgaacataaatggattaaatggttggcatgtgttaggtgtttaaaatgtgagccattattttccaaggcacatagtagagtgccttgtgtatcattacaaataataataataaatgtttgggaataaatggagattaaaggactagtattttggcaatattaagcatgatttcttcaagtatagtaataagatataaagtatgcagcagttttgtaattttatgtttataatgtttatacctctgtatatacttacgtatccatacctgtataatgtaactctggctaagaaagccaatcaggcatttttcccaacattttattaagaatatattgaggcatatagaaaatttggagaattgtacagtgaacacccgtatacccactacttagatcctacaattaacttttaattgtatttgctctattatgtaactatatatctgtccatccttctgtccacccagtttgcctgaattctttgaggcaagttacaaatatcgatatacttcacctctgaacacttagaattcagtatttgtttataggttggttgggtttttcggtgaagtttacatacagtgaaatgtacaatcttgagggtaccagtcagtgactttttaaaaaaaaatttaatgactgcttcacgaatgtgtgcatcatccttgcacagaggccatgctaatcgtctgtgcattgttccgattttagtgtatgtgctactgaagtgagcacccatcagtgacttttgatagaagccttcattcacgtttgtacgcagcctgcagcagggtacagactataagcatcactttggagttgcctcatgtctcttctcagtcggtctccattcacaccctctcaaggcaacagctgtcttaactgttttcccaccgcagattagttttctgtttcagaacttcgtataaatggaatctaaataatatcatttctcttgagaaatacctaggattcgaattcttagattatatggtaggtataggtttagtttgctaagaaacggatcttttcccaagcggttgtaccattttacattttcaccagtgatgttttgttttcctttttcaagtaataaccaccaattcatagtaagagctgcatactgcagtaaaaataatgagtataagaatattattctgtgtgaactttattcttaccagatatgcaagactgtagaaatcatgtagtttcagtgagatcagagttaaaagcacatattaggaagaaaggctttgtgttgagaatatattctagacagatctctttgtttttaaaatgtgtataaacaggccaccaaagattttcccaccttattttaatgactctcaaaagggtagatggttgttttataaacttcagattcgttaagtgccagagagatagcaggcctttttttcaaggcaaaatccttccaagattggatgccagagtgaagaagcacctatataactgtctgtgagttgtttccaaactgagaagagctaacttgtaagaaggctatatggtaaattaataaatggaaactttaactcaaaatttttgtttgccttgaagtcttttttgtgtgttttagaacaggcttgttatacattttgctttattggtgttcattctgtttgtcccttggtattattttgagaattagacatttaggcagctaagcgtgagtatattagcttcctagggctgctgtaacaaattactggaagctgggcggctgaaaacaacaggaacttacttggtcccagttctggaggctggagatcctaatcaccgtgtcagtggggctgctttccttctgtaggctctgagagaaaatggcctctcttctagtctctggtgcttgttcagtccttggtgttccttgggttgtagacactgcactccaatctctcctctgccttcacgtggtattctctcctgtgtgtctttttgtgtctcttctcctcttgcagggacaccatttgtgttgggatctggggacattttggatccaccctactccagtataacctcatcttaactaattacatctgcaaagaccctctttccaaataagctcacattctgagaaggacctgtatctgaggaggacattattcaacccagtacagtgagaaagccgagatattcacgagaccatttacattgtccttgtccatggaaagttgccccgtgaataggacccctttaggaaacccctgagtccctcactcagaaagcatagtcagttatttcattttaaaataatacctaccacaatttagaatttactcagtgaaccatagttttattttacagagtgacccagtgaagggacttttctgatactgactttgatatcttgttcttacagggttttttaaaaagatgattgagataccagaatagggcaatttgagttgaaatcagcctgggttcaaatcttgattctgctgctcatgcctgcgtccgttggaaaatctggacctcagtttgacctgtccagtgatccccttgcatcttttctctcattcccatacattacttaaaaaacaatctaggaaactggattccacggaactggaaaaagaaagccttcttattagcttatgagatcaagcccaaaaggtaggaagggtgcttttagaaggtagtgtgcttttgaactattacatcaaacctttaaaaagagtctccttatagtatagagatatagagcttgttttctattccaaagctgaaagattttcataatttttttctctttcttgaagaaccataatttttttttacccttaattaaaacattgagtagactaatttggaaaatattgtgaaaaagggaaaaagaattacaaaatgcccttccctgttccctgcccccatcccgtaagagtgcaaaatagctattaagacagtgtccacatcttaagagtatgatcaaacatctcttagacacttcttttggccttttgggtaccatgaagctcatctttccctcacccatcaaattctgtgttctggtatctccttccctcgctccctctcaggttcaagagattttccttcctcagcctccccagtagctgggattacaggcatgagccactgcgcccagccactggtatgtttcaacaagtagaaaatgtcaggctactagaacagagttacacagaacctgttaggcactagaggttagccaggaaagagcatcatcactttatcaaagacctcattgccaggactgattatttaatgtatgatttggcctcataatactcagccagttctcagtgaaatgagaaaaatgtatagctttcttccatttagatatttgtaacaggtacttatgcatttgtggcaaactttaggtggggtcataagctattccacatttttcagaaggccactaaaaacaaccacagacttccttttggaatattaatttcagcatattattattgtagccaagcagactgttttgttttcagttaaagcttataaaaaataattaaacctaacacatgataaattttgttttcatatacaaaaaacccagagacagatggattcccttcattgcagttggtgatatttactgaaagaactaacataaatttgatatttttcctcttgaagaaaaaaatgggctggtcacggtggctcaaacctgtaatcccagcactttgggaagccaaggcaagaggatcccaggagttgaagaccatcctgggcaacatggtgaaaccctgtgtctaaaagaaatacacacaaaaaattagctcagcatgctggcacatgcttgtagttccagccactcgggaggctgaggtgggaggatcacttgggcccaggaggtcaaggctgcagtgagccataatttcaccactgcaccccagcctgggtgacagagtgagaccctgtctcaaattggaaaaaaaagaaaagaaagaaaaaatgatgtacttctagtgtagtacctctagtaagaggataaaaagaggatagacctaggccaggcgcagtggctcacgcctgtaatcccaccattttgggaggctgaggtgggtcgatcatttgaagttaggcgttacagaccagcctggccagcatggtgaaaccctgtctgtactaaaaatacaaaaattagccaggcgtagtggtgcatgcctgtaatcccagctacttgggaggccgaggcaggataatctcttgaatccaggaggcggaggttgtggtgagctaagatggagccactgtactccagcctgggcgacagagtgagactgtctcaaaaacaaacaaaaaaaagaggatagatctagactgtttctcttctagagtccaggggggatttgaatccaattgtgatcatcctattaaaaaaacaagtctctgaggccaattatgatcttacctgcctggaatccactgagaagccattggcttgatctagaataactgaggctatctgattggccctgctggcttcaaccatatgtgctttctctccattacagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggaggtgagatgggaggcggtttgtttagtgtctcagtgtctgcttgcttttgagaagcttctgatttgtattattgttggtaaaagaatttaggagaccccatagtatagaagaaagaatataggctttggaatcaggaaaatctgtgttcagaccccagctccaaaatttactatgtagatgaccttgggcaagtcacctgacccctctaagctttaatattctcatctgtaaaataccttcattattatttttaataatacaatgaaatgtgattgtcatataatgagtgtttagtaaatgggaatgtttattcttaccacattaatgaaacttatgaatgagaaaatattggaggcagtagtttcatgtcaactttgaattaagaaacaaacatgaagtcttacagtcttaacacatcaaagtctttcagagtattttctgagaattaaaaccatctgtttctaatacagaaagttttgataaagtctaaattatcattgtttaaccctcaagaggatataagactcattacattcattttacattcattacataccattaaattgttgggattttcccatgtgggaacttgtattaagtgtgacccagtatcagtccttcaatttggaagcaggctatatgaaggtatgtcgaatttgacttcttttttttttcctgagatggagtctcgctctgtcacccaggctggagtgcagcggcgcaatctcggctccctgcaagctctgcctcccgggttcactccattctcctgcctcagtctcccaagtagctgggactacaggcgcccgccaccacgcctggctaattttttttgtatttttagtagagacagggtttcactgtgttagccaggatggtctcgatctcctgaccttgtgatccacccgcctcggcctcccaaagtgctgggatcacaggcgtgagccagcgcgcctggcctgaatttgacttctgactgctggctggctagacaaatgtaagcagatggttttagctttaaagaatgagtatggtagtgcctactatatttacaagagtgtgcttattccaaagctactttgctaataagtaaaacagataagggatgaggctgacagttgttttaaaacaattgatgtaatctcatgagcccaggagtttgagaccagcctatgcaacataggagaccccatctctacaaaaaagaaaacagccgcgcatggtagtacatgcctgtggtcccagctactcgagaggatgagatgggaggattgcttcagcccagaagttcgaggctgcagtgagccatgatcataccactgcactccagtctgggcaacagtgagaccctgtctcaaaataataataataatagtagtaataataataattgatgtaaacagctcagcaatagcaattatttgctcaaatttctcaacctcctgataatattatggctgtgtaatcacattcattcacttatttattcagccaacatatattgaacactcactatgtgccagactctgctctaggttctggagataggtaaacaagacaaagtccctgcctgcatggagctcacagtaataccttcttacactttcctaatttgctaatcttttcagactctctttataacacatttctgatataatttttcagtcctctccatgagtcgagtggtattatccccatgtttgcagatgagaagactggtgcaggtagtttgcatcatttatccaaggtctctggtctcttagtcaaatgccgtttctataattccatattattctatggtggcatgtaggatgctaaccttaaaaataagcagcatgctttttctgctagcttgtttttatatacgtttgagaccctagattttataaaaagtaatttcccagttttgctcgtggtgtactctttttttttttttttttttaagcattcagagcaacagaaaatgtaagagcatggtgaatgatccctacagccagagcttgaagcaaatgtaacttttttggcaggacagtcttatcttaaatgataacagcatcaaggaatgagggtttattttctatacaatccccttttctttataatccactatgggttcctttgtcacaactttgattttagagctacatgtgactgtgtctgtcatgtagctcagatgaggaaattgaagctcagaataaatgatttgcccaaaattacatggtgatctcagttcagttctagactgaactgagactagaactctacttcttttcatcctgcataatgtcatgggatctcctgtttgaatttactgctagggcttacctaggaccactgtcctaatacctctgaagataatggaatgagagtgaggttttaattagtttggctaattgttatggtattacctgcatgtagtataacctgaattttaaagtgttaagaaaaacccctttaaagctttgagtagtaatttttttctgattctttaataatttaataaactttgtaacttttgccatctgattaactccttggagcaaggggaggagcaaagtagccctccacagaaactgtcaggcccttttggtcctgatgtttttctcattccacattccttcattctcttgcctgtgccatttctctttgagcagtgtctctctccccagtgtggtgtctgtatgtttcatgcatttgtatcccattttgtttcacctgcaacactgacctcttcaccattcattttcagttcaatgcgagttcttggggatgttgtcaggagacctcccattcataggagaaggtacagagttcattaacttgatggactaaccatgtcacctctgagcatatactaacaagcatctcattctgcttaatccatgattggatcatctacttttaagtaatgtcccatctaattcaggcaaataaaatataggtacttattaattgctagtgtccattttatatgaaatggtttctttaatttgaagttttatgctattttatcttttttaaaaattatttttaatttttttaaatcttgtgcttattgttgttcagatgactgtgagaatagggtctcacctagctttctctaggagagttcgaagaattgtctatgtcgtgcctatttaatggaccctggggagtactttttttttcttttccacaaaagaaaaaccaggaatgtgtgtgtgcttgtgcacaggccctaaagtattgtcaacacattgtttaataatgtaatgaaagactttattactaggccacctggcattttccattccattgtggatatagtcatttcttaaagcaagtcagaggcataagttcattccttggcctttgaattccttaattagtatttgtcaggtaatattttgaagctaaaaataaacgatttataagctgagaagtaatttctagtcagattgctaatttgcttcaaattttccgttggattttctttagaagtcattagtgaccttccattgtttagaaaaatatttagaaatccaaaaattagggttatattactgttagtttctcaggaggcatttgtaaagaagtatttttaactattagctgaacctgtttgttggcaagtgggcaaatagtgatctttcctactttgtctttttcaagtggatgctttctttaattccagattttaggcaagaaattgagctgaaattcagatattctcatgaatttcagataatcatgattcctatgaaattgttcttccagaaaataagttgttaaataagttttaaccccatctctactaaataagtttttcagtagaaggttctttggagatacgtttgtctgggtctttattaaagctcttcaatatgagcttattaaaaacatgcacttgatgacaaggtgggagacgacagattgctggatgcagtctgagttagtgtatacatggagtgtcatcaacaactccagccagtttcatccctagtgaaacttatttttgtaggaagaacgtaatgtataatttaaaattttataaaattgaaacattacaacaggtattataaggcaggaggagggacatttgttgttttttaatctagaactttacaaatctcaaagccaaagaactactaaatattatccctactaattgaggaattgaggaaatgacgatgctttccaaaatactcttaattatgaaaggagttttctgttaccagaaagggcagacgttgtagaccatctgcagcttccttcctggtaccttagaaaagctgttatatcttggccgagcacggtggctcacgcctgtaatcccagcactttgggaggctgagccagatggattgcgtgagcccgggaatttgagacctgcctgggaaacatggtgaaacctcatctctactaaaaacacaaaaattagctaggtgtggtggcatgcacctgtaatcccagctactcaggaggctgaggcaggagaattgcttgaacctgggaggcagaggttgcagtgagctgagatggtgccactgcactccagcctgggtgacagagtgaatctaagtctcaaaaaaaaaaaaaaaaaaaaaaaaaaagcttttatgtctgtcttcctatctccctattgtttttcactctcttcgtgttaaatctcctcacagtcttccacatcattgtcatatcctggaagtaaaggaacatttaaatctgtagaaggagattatttttaagaatgatggtttggcagtgtatgttcagttactgatttgccacattctgtttctaaaaaagaagttggatatttaggtaaaaatatgcctatttattaactggcgatttaaaatttaagttaataatgtcaaagaatggacttctgagtcttatctgtgtttgtaaaatatatatcttctcctcacacaagtaaattatgtcagtgtcatcccacttaccagaccagcgaagtgtctccactatatttttactttctgcttctgcacttgtaagctttataccactaatttaatctgatttaaaatgttttatactatttagttttaaatgatatggtaaagattttttaaaagagccataggggtagctcttacatcctcccacccattttccttgtctcctttctccagccaaaaaccccacttgacaacaaaacaaagttattagatgtgtccagtataggtgtttttggtgccaggccttcccatctgcaagattctggagggagccgagtggttttattgagccgagtgtttttattgtccacaagctctgcttttatctcttctcagaaaacaaaaacacatcacctagaactttatggcccaggtagcagggtatttttttaatgatagcttttgttaataaaaatcccaacatttccatgcagtttcctttatagaacacacaatattttgaattgattattgttttagctagtggtgtttacttagcatttccaaccccagattttctgtccttgctacttgataatggacaccgctactgggatattcaaggaagtagatgatcagatggattttttttatcttgtaggaaaaatggaaacaaacttgaaattaaaaagatacatttctaactcagtgccatagaattccttttttttaaatttttattatcagccaggtgcggtggctcaagcctataatcccagcactttgggaggctgaggcgggtggatcacttgaggtcaggagtttgagaccagcctgaccaacatggtgaaagcccatctctactaaaaaaaatacaaaattagctgggtgtggtggtgcacacctgtaatcccagctactcgggaggctgaggcaggagaatcgcttgaacctgggagacagaggttgcggtgagccaggatcgcaccattactctctagcctgggcaacaagagtgaaactccgtcttggggggtagttttcattatcattaaaacataagcaaatatataatcagtgttatatgctttatctttaacgtaacagcctagtgagtagggtttgaagatggatgccagtgttgactaagtatcttatcatgcagaatctattaatgtctggtttggttggatccgtaatggaaacacatgaaaaaaaaaaaaaaaaaccggatgactccatgagcccaccagagcacagtttgtcactgtctcttttaaaaagtctaggattagagatactatggtaagggtgatgtgggagtatgcgatgtactgagagattgtacccagtggtggagtttgaaatacctctcatgtctgaagagcaagccataggtagttgccacagttcactagaaggaatttttgggtttcaggttgaactggtgatactgtaaagaacccacagtctttttccacaatgctgtctagacaagaagaaaatatttttaagtttctatgattttttattatagcctttttaaaaattgtcagtgttacattcctaaattttttgttgatcgcataaatccgtctgtctctaactatgcccttcgtttttaaacctaataaccccattcctgtttcctcttttctccctgcatttctgtttctgtctttgatgtcatccccagtatgagctggtgcccctctggtgtgcagtactctgctggcctgagtgctgactttaattacagaaggtatgatattgttatgtgtcccgccaccaaatggggaaccataaaatacgccatcagggcttttggcttggagctggcttctgtgtggctgggatgcatatgggcagcctgctttgtctgtgagcacagcatttcattgcctttgctatgggtgtcactaactcagctgaagggatgcagcctaagagtcgggtgatgcatcctgtatgtctcaaatggccatagatttgatgttttctgcacagatttatctctctctgttttggtttgtcttgattttcagatcctaaaaattcttggaacccgaagaaaacaatcaaagaaccaaggcagctaataagatgcactgatttctattatgcttctaaatccaccattctgtgtagattccaaattcagagactcctcatcgtttcatattcttctctcaactgaacagccagatttaattactaaaacattttcagaattaagttttgcagtaagcatagatctggttttcttaggcttttcaagtaatttcttcttcacttagcccctcctcttatccctggtattgaaagtgagttttacaggccaggcatggtggctcacacctgtaatcccagtactttgggaggctgcggtgggcggatcacctgaggtcaggcattggagaccagcctgaaaaacgtggtgaaaccccatctctactaaaaatacaaaaattggccagacacggtagcaggtgcctgtaatcccagctacctgggaggctaaggcaggagaaccacttgaatccgggagatggaggtagcagtgagccaaggtcgtgccactgcactccagcctgggcaacagagggaggctctgtctcaaaaaaaaaaaaaaataggaaaagaaagaaaatgaggtttacagagtcatttacttgtagttagtcatgatttctattatattgaagaaaaacatatccattgtttagtttacctactagagaaaatagagttatatggcttcagttcgttaagttatttacaaaaccaaaataaataaataaataatttaaaaaagcaaatacaagtcctggactggtaggtatgaacttaattggagcaattttctgtacagttttccttgagtggaggtaactaagtagcttcagtataccttcagattgaattccagctcattgttagcggagaacatggtcagctacagctatgtttcgagatcttggttattttaaagaagtttccgctgcagttgtaacagatgtgaattactctagttagcaacccaaggaggttaaatcgctaacctgtctctgtagccttctgcttactgaaaatgcttttcattctgcaaaccacagaatctgtcttggaggaatcctctttaaaatgccaaatcctgactgcctttgttccctttaccaatatccaggcaaaaaattacaactctttctactcttagaccaggttgcttttcagcatttgttcattaaggtgttatatgtgcctgttgcaactaacaattctcgagaagtctgtcagcagttgtttggccaggtgtgcatagatggtaacactcatgagtaacacttgggttttcttgggtgaaagcatacctgtaaaattataaaggtcaacttgaatgtaaaattataaaggtccacttaatggacataagggcaagttacccagtttgccttctgaaagttacttaagctcgtattttctctgtgacatttaattacttggcattagtagagttagattcacaaagattaattagatcaaggaaaaaacacatatataaaatatcagataactatggtctgtccatatagtgtgtagaaaaaaatctgagaagtgatcttaggtggttcaacatttggataaatttaatgcggtaagaaaatctaagtgcagtattctttctcagtattccaagatctgtgggggaaaggtaggtagtattctttgtgccatgcccttttagacagttttgctagctgacatagaaataatacacaaacaagggagatatacccaaagggattttgtgtcctcctttgtttttgagacccagaaatagaatgaattaacttttgtgccctatgttcagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcaggtaagtcttaaatatgtctaatttggaaaaaatatatttcacaaaatatgaacatagaaggcaaggcttctggtagtataaggctagtagctatgattacttacccattatatgatatacttaatctagcactaaaccaagtgtttagcacctaattaaaaagggccaggcatggtggctcatgcctataatcccagtgctttgggaggttgaggcaggaggatcaattgagcccaggagttcaagaccagcctgggcaacatagcaagaccccccatctctacaaaaaatttaaaaattagctggacatggtggtttgtgcttgtagttccagctactcgggaggctgaggtaggaggattacttgagaccaggagtttaaggctgcattgagttgtgattgcaccactgcactccagcctgggtgacagagcaagactctgtctccaaaaagaaaaaagaaaaaataaagactacgttaatctgcatagatttaaatattccatcaaggcacactttttaaaattaggaaagtatccaggatattaaattgagtttttccttcttatctgagaccatcttttaccctctcaatagtaaactgaatcttgaaatacgctacatatcgttattaattttcccaattctctaaaacatatcccaagtttctcctttgtaggaaaaaaattaaaaacaaaactttcttactacaccttccaggaaatgtcagttgattctctctccttcccatccctaccagaattctttttttaaaaaattattatttttacactttaagttctagggtacatgtgcacaacgtgcaggtttgttacataggtatacatgtgccgtgttggtttgctgcacccattaactcgtcatttacattaggtatttctcctaatgctatccctcccccagccccctaccacacaacaggccccggtgtgtgatgttccccgccccgtgtccaagtgttctcattgttcagttcccacctatgagtgagaacatgcggtgtttggttttctgtccttagcgatagtttactcagaatgatggtttccagcttcatccatctccctgcaaaggacatgaactcatccttttttatggctacatagtattccatggtgtatatgtgccacattttcttaatccagtctatcatggacatttgggttggttccaagtctttgctattgttaacaatgccataataaacatacatgtgcatgtgtctttatagtagcttgatttataatcctttgggtatatacccagtaatgggatcgttgggtcaaatggtatttctagttctagatccttgaggaatcgccacactgtcttccacaatggttgaactagttcacagtcccgccaacagtgtaaaagcgttcctatctctccatatcctctccagcatctgttgtttgctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatcctttacccactttttgatggagttttttttttcttgtaaatttttttaagttctttgtagattctggatattagccctttgtcagaggggtagattgcaaaaattttctgccttctgtaggtcgcctgttcactctgatgcctaccagaattcttaagagagcatctatgctccctgccttctctttttaaaattttatttatttatttacttatttagagacagggtctcactctgtcgcccatactggagtgcagtggtgccatcacaggtcactgcagcttcaacttccccagttcaagtgatccttctgcctcagtctcccaaagtgctggcattacaggtgtgagccactgtgcctggcctttgccttctctttatcaccatctaatcatctcttaatttctgctgctaccagtctcttgaaactcctgtcttgaaggtcatggatttccatgtcagccaaatcaaagtgacttcttagttctcatcttctggatgtcctcattatcacttaccacttttgacaatcccttggggagcttttgagttgagaattcaaattatttgcttttatatcattgtacctcactgcaagtcttttctcttcctcttgggtcagaagactgattaatttacgaaagcattctgggatgcatcttatttcctccaaatgaaacacttacaatttaaaaaaaaactgtttttgaatagatgactggagtttgaggcaagaatctaatgatacatttctaattaaacaaaaacattgacaacctcttccttgatttgctgagtaggactttgtgtagaagtttaaatttttattgcatcctactatgaagcactaacatgaccaaatataaacttgacactgaaggattatcttagtaattattgtaacacttatgcttgtgtgagaccagacaaataaagagatttaggcataatgaaaatcagttgaagagtgaattttgccccttttaaaaatttttctacttgttctgatacttcagaaggagttagaaaaaataagaatatgaagaatatgcttgttgaagcaagtgatttagatttactcagcctaatggtaacagagaaaggaagaaaaaaataggaacaattcttggatggctactgagcacagctttgctaagggtaaataaacagtgaaaaaatctttaaaataaattgcatttcaaatttatagaatcctttggaaatcatttacaagatgaggtaaaataccaaaattgtggatttgtaaacagaatcataggccaagactgacatatcccttcagatttagctccagctcatttaaatgacttgcctaaggccgtgtaagtggctattagctgaacagtattaaactcaagagttcctggctattaatttctctgcttttttccaggtttttggagtaggtgagttttcaaggaggaaataagaatgatttaattttcttaatattatttatgtgataccttttctaagatggatatttccgggaatttgacagataaccctgcattttagtaagacgttactactactgatgtgtttctaaaatggactgtctttctgaagtggactttctgattcagtctttctagataaagttgttgttttagtgccttgctatgcttagccttcctggaatctctacttacccatagtttttatcttgtatggaacctcagagtaggcatttgagctgcttgtttcactctgatctagacgagttgcctgtagccaacttcctgttaaaagtctctgcctttcactgaggtcattttttagacctcacagttgtatttgaaacatagcaactgtttgcctcagctgccatggttacacatgaaacaagctctaaataatcagaagtctggcctaagtgagtcaagttcatgctagtaacggatttttcactgcttccctttcaatatgtgagtcataaggaggcagatttcattctgtgaagggaaaggattaatgataaagtcagttaacaattggaatgggctcttatcaccagaagtgtgctagtggacactagatgactgtctttcagggatgttgtaccaggaacttctgcaggtggttggattacatggtctcaaagctgctgtgaatttactgagagagttaaattatcaaatttcagttacctttacgttcatgtagaatcactatcatcttagaagaggatagggaagagatttaggcttctttccagatacactgttgttttgtttgtgatcttaagacactttacttgaatctcaatttccaattatttaaaatcagaggccaggcctggtggttcacacctataatcccagcactttgggaggctgagatgggtggatcatttgagcccagggatttaagaccagcctggccaacatggtgaaaccctgtctctaccaaaaatacaaaaaattagctgggcgtggtggtgcacccctgtaatcccagctactcaggaggctgaggcgggagaatcgcttgaacctgggaggcagaggttgcaatgagccgagatcatgccactgcactccagcctgggcgacacagtgagactctgtctcaaaaataaaaataggctgggtgcggtgactcacgcctgtaatcccaacactttgggaggccgaggcaggcggatcacaaggtcaggagttcgagacctgcctgaccaacatggtgataccccatctctactaaaaatacaaaatttagctgcgcgtggtggcgcgcacctgtaatcccagctactcaggagtctgaggcaggagaattgttggaacctggaggcagaggttgcagtaagtaaaccaagattatgcctctgcacatcagctgggtgacagagtgagactctgtctaaaaaaaaataataataaataaagtaaaatcagaatactattactgatattctactatatctgtatgaagaaatatttagattttcaaagaacaagtattgtatgtagtttgatatttccagtgaaattatttttaagtgattatgcatccagcagatatttattaagtacttactaagtttgaaacattgttagatgctatgagggatacagaaccactgtaaagaatggatactctaatgatccccattttacagatgagaaaactaagcctcagaaaagctaagtaacttctctgaaactgagcagctgttaagtagcaggagcagactttaacctaagtctgtctgaccacaaggcctgtgctctcacccgcttcttcactgccttattttactatgtgggtctaattataaggttttatgcttatctagaaatatgagagtatatgcttacaacgtgttcttcacttttttacttcacagatatgtcacagatctaagcagcagggatttaattactgtacatcagccatttcctctccattgacaaaatccatctcattaatgacaatcagccatcctggattggacagtgagtatactactttttaaaaaaattaaatatattaaatcttaaccactcttcctattatttttctcactttaaggccccataacattacctgccaaaatttgcttactacttctttgagtgaatggctcagcacttaaacagaaaaggtggcatagagtttatcttgagatcttcttccttttacctaaaaatatccctaatacattaagtttattgtatttgtgggcatgaatctgacacactttttaaaatttttttattttgaaataattttagacttgaaaaatagttacaaataatattcactggggaaaaaattgcaaaaatagtacaaagtattcccatgtattcttcacgtccagtcctcaaatgttagaatacttgtttcgccagcctctctccctctctttatcactcccctaaagattttttctgaaacacttgagagaataagttatatccataactctcctttacctctaatttagtgtatatttcctaaaaacaaagatattgtcttatattaccatagtatatgggtaccatatactggccttctctggctactgagtgctagcattagtatataagagtaccttatactcttatatactgtggtagtactgtattacagtagtctaattatccaaatcaggaaattaatatcgataaaattgtgttatctagtatgtacaccttattcagatttcaaattttctcacttatttctgggtccaagattcaatctaagaatatacattgaattaagttgtcatatctctttagtccactttaatctaaaaagttcctcagttgatctctgtcttccataaacttgtcagtggagaaacctcgcacagtaactgacctgagcttttcaacaatgtcaagctcaagaaggacaaagcaagactgagacagagatttagttcagtgagggccagtaggattgcatctgaaaggggttagtggacctgtatgcggattcagatcaactggtgttggaagttatgtagagatgtcatggcatccataagcgcagggccttgtgatgctcaaaaacatacttggattggatcagtgttgtttgtcacaaaaaaggcaacttgttctttgagaagcctcattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtagtccagctgcttcagaggctgaggcaagaggatcatgagcccaggaggtcaaggctgcagtgagctgtgatggcaccactgcatcccagcctgggtgatagagtgagacactgcctcaaaaaaaaaaaaaaaaaaaaaaaaagagagagagagaaagacataatgggtgattctgttaacttttttcttgttttcatgtgattaatatttcaaatacaaatctagcgtatttgacaaaaggtgtctaacggagacttattttcaaagatatgtcccccagaactgtgacagaaatagcttttcctgtttttgcttgtttggatttttttttttttttaatttggctttgagttagatgtttggcttgtatagaatggaaagtacaattgaatagtttgcagtgaatttgataagccagaatgctagcactcagtagccagagaaggccaggaaggcactctaagtgagacatttcagctcagcgtcccctccttccgtgaccagcaagtgtcgtgacatagtggatattgtacttctacagcaacagataactagtaccaacagaatgtgtcccatagagagacctttttcctatattttgtgacatgctttctttccttgtggatgaaacacttcattatttttccttcacaaaacacggtgctttttgactgtgttttcagttgctatccaaacactataaataatacagctaactccccaaagcgctattctagaggttctgacacatagagcttttcttcccgttgctgagaatttttctgctcaactcacctagggaacctgattgcagtagtagactgctgtcaaaagtggagcttcaagcaagagtttattcctttcatccaaatgtaataccctcattctgatttgtagtgtacgtttcatgcaggctggaatgatagctagccccacgtaccttcctaatagcatatgctgcaacagaaggacccatcaaccttaatgtcactatttctccttagttcctcctatatacaattaaaatagtttcccacctgtatttgttattctacactagaaacataatacatcattttggaaatgttaaaattctgactaaagagaagactaaaacttgtgttaaagtgtgtgtggtatgccttaagcatcgggataactgatacttcataatttgctccaggctcaagtgttcaattccaagtcacttaaatactcagcatgattcatctatggtcatagtctccctaactgaaatagtgtcataaataaaatcctcagtgatttttaaagcctaaaatgtttggtacactcaaaatattttaactgatattttaagcacacttagtagctgtattactttgagcttgttactgaaactctctgcatcaattcaactgttaaatggggatgataatgtgatgtggcttaaatctgacttcatttgaagtccatagcatattttctgtcatataatgagcacatgctgtcattgtggagtgtgattgttcacaataaccagaacagtgccagggtccatttttctctgcccagagcttaagcaaggttaaacattgctcaccattgctaggacattgtcccttgttgtcttgcacttggctgtttattatgagtgtgcttgtttaggaacagaatgttttctaaactcatcctaatctcactgctttccagcttttacctgtgctctttttccttctaaagaaattattagtttcctcaaccacagtttatcacagctgtcagtaaaacttgagcatttctggaaatgtatttccactgagctgttgtccagaatgtcttttgttgggtcatttgctagattagaaaaacagacaaacttgtagcattatttctaagctgggatctgttttttaaaaaatctactgatgtaaaggaaaatactgaatagagagggtgactaaaatatttctgtatcactttctggggtggagagtaggcaagcagtagcttctttaggaaccacagaggacgggaaaagctgcagtgtctcctgtcttggacttcctgtcttgattcgaagggtgggatatgatgagcgtgacttgccggcaattttttagggggtcgcagtagcacaggtgctggctgtgtcatgaggcttggtgcctgggaggactgccctgagagaaacttctccatggaatgtgttcacagcatttctcctccttgcatcagagaaagattgtgtggagcctttttctcccactgtgctgggaaacatagatggtttcttgatagaacttaaaaataaattttattttcacatgtatagaattcagttattacagatgatccctttctttctttcttttttttttttttttttttttttttggggagacagaacagaatcttgctctgttgttgcccaggctggagtgcagtggcacgatcttggctcactgcaagctctgcctcccgggttcatgccattctcctgcctcaacctcccgagtagctgggactacaggtgcccgccaccacacccggctaattttttttttgcatgtttttagtagagatggggttttaccatgttagccagaatggtctcgatctcctgacctcatgatctgcccacctcggcctcccaaagtgctgggattacaggcgtgagccaccgtgcccgacccagatgatccctttctatggctgtatttttaaccttttcattgctcccacccagaagatgcttcaaataatagagaatctgcttgattgcatccctggaaacacattagtggtgataatgttgaaaggggaattggacccgttagacgttttaacttcatatgcttcttaatgagatttcattttccccttcattttgcatggtttgttacaggttgagcatccctaatttgaaagtctgaaatttctcaaaatctgaaacgttcgagcaccaacatgatgccacaagtggaaaattccacatataaggccttaacaaaattatgtaacatattatataaaattaccttagagctatgtgtataagctgtatatgaaacaaatgaatttcatgttcagatgtggttcccttccccaagatgtctcatcatatatatgcaaatattccaaaattcaaaatctgaaatacttctgaccccaagcatttcagaaggaatactctgtgtgtatcacaaagaagggcactttcccttggggttgtttttacacctttgcttatggcatgtgagtttgccaagtttcttaagcatgttgtgatgggagtagtagcttgtagttgtatggcatgcattagactatgacagctaaggccatcttgagagctgaactgtggcagttacatatctgtaccagatctttaaaaaggtaaaggatctgtgtgaccaaagatcaaggtgggcctctggaaagttaggcatcagtgctattgaggatattttatctctgttttctggatttcttctctaactatgatgggaatttactgaaatatgtatgtgtgtgtgtgtgtgtatatatatatgaatatatgtgaatatatatatatattcttagcacagttctgtttggaaaagataacattgacaaatacatcagaacaaaaatgtaatcagacttctttttgacatttttattaaattgtaagactggaaaacatgcatgttcattaaatgcatatataaatataaactttaattcaattaccttgtaaaattgaattgctctgttaccagaacatttcctttatatcatatatatgttggaaatttccatatgtcagggatactctagacactcatcacgtaagatttttccttatgatccatgattttgtgacacatgaaggagatgttcttagattctgagtaataggggcagcttattttcattttctaaatctgtttgacatttggaggcacatcagaacacacattacagtagtatcttacttttgcacaagactctgcctgagaaactagtgtgtatttgtaccaacatttctttgatctgttacttggagtagctgcaacagcaaatagtgatgtcacttagcatttatctggggtatggagtggctttcataataggtaggtacagggctttttctctcatttcatttaggacattgagattccagaaagtctgataaagggaagttcatttattaatgtgtctatccagtaaatatttgagtacctactcttttccgtacaccaggctagaccatggtaggaggggggtgaactcacaggtagggttcctttcctcaccacatttacagatgagagcaagtgaatctaatagaaaatggtaaatgcagcaacttaaacatctgatgttataggactgacagacctaaggggtcagaaggctgactaaggaaaagtaatattaaagtttggaccagaaggaaactgggaattagctgggtgaattagtatgtggaaagcaagactgaggaatttgggcctcttgcctgagggaattggaatcatttacattgattaagttggtcgaataatgattagaacacttcaggctgaccatagtgagaatgtattgggaggagagattggatcagtagaaggctttttttttttgagaaggagtctcactccatcgcccgggctggaatgtagtggcgctatctcggctcactgcaacctctgcctcccgggttcaagcacttctcctgcctcagcctcctgagtagctgggattacaggtgcccaccactatgcccagctaattttttgtatttttagtggagacggggtttcaccgtgttggccaggctagtctcaaactcctgacctcatgatttgcccacctcggcctcccaaagtgctgggattacaggcgtgagccaccacgcccagccagtagaaggcttttgcaggattcaagttacagtagtagacaatgtcctaaaccaaggcagagagcagtggcaataggggaggaatagaggttgagctggaagacaaagtgaagaagcctgagtgaagtgtgatataaggattcaggaatggtgcccaggtttccattttgattaatgagttagatgttggtaccactcactaaatgaaggaacacaggaggaggaacaggtctgcaggaaaagataagttcacttacctgcttttggagctttagctgcctgtggaacatccacccacaggtgagcagggagaggaatgagcctagatctaaacagagatccggcttccagattagaaagatgtgagtcaccagtgtgttgtatgcagatcgttgttaagaggtggagtgaattaggagatttggggtgagggagaagagagccagatataaaatcctgaggaacatcactactagatgtttttagtatacttttaaggaagagaaccccaggtatgaattgtgatcattcttattttcataatctaacaggtatgtatttattagccaaattttttagaaactgcattagaattctgtatattcagaaatggagatgagaatgtaaacaaattattacatcattcacctagacagcatttcccggaaccgcataggccattgacattatgctgtttccccatgtgctgaaggccctggcataatccgagcatgctctaatgtcttctgtgaacctccttctcagctcagcagcagatgcggccagcaaggcggatctccatcagcatctctccgctcctccttaagtctaaaactctcttttctcttggctcttcttattcgagtgatgaggaggaggagttgcatagtaagtaagcaactttggtgtccagtgactgttcttgaaggtctgaccagctcagaaaatgctgtaggcttggtactaagaaattgtatgggggcttttagcctcttgcatgccatcctttgtaagtcatttgtctttatgcttgcctttgagaattggtttggatagaacatttttttgtcttctgtatagtactaacgctgagctactggcctcctgattccagggcacaagataatctttctagcacacagataccctcaaaggtgtagggggtgtgttcccatcccattgtgtactctttctaataatactgtatgctaatttcacaaaactttttatttgacaatgtaaattttattttccttgttgtgttgttctgtctcatgggacagatatctagatgttcatctgtggtgtttaaaagctattgttacactttttttcttctccttttcagaccatttctttaaaaatacctttcctttaagattagaccccatgaattagagggagggagttatatacgttttgtgagtgtgtgttgtgttttttttttttttttgagatggagatggagtctcactctgtcgcccaggctggagtgcagtggcgcgatcttgcctcccaggttcacgccattcttctgcctcagcctcccgggtagcctcctgggtagctgggactacaggcgtccgccaccacgcccagctaattttttttgtatttttagtagagacggggtttcaccatgttatccagcatgatctcgatctcttgacctcatgatccgcctgcctcggcctcccaaagtactgggattacaggcatgagccacagcgcccagccggagttatatacgtatttatctcctactttctctctccttttgaacttttatttttacttctttggataagctgtaggcttcagatgaatacattcttacttgataatgccttgtataaaaactttacaaggtatcaattttagtaaacttggaaaagaaagaaattcccccttcatgaaaattacagtcttcaattgtgcaagatttctagaatattccaggattgcttttaatggagaaaccacttataatagaaagttaaataaaattgtttttatataactagtattatgagtctgagacaattaccatacccatatgattaggcaccctaattccctaccacttgctgattctaagtttcagcaatattaagtgtttctcaagctggcattttcacactattcttaaagggaagtgccttatgcacaataagacagtttagttaatttggttttaaatggtggccttattaaggatttggtatatttttcactaataaaagatgtttgaaaaatagacacagaataagatgatcccagttgtaatagaaggaaggttgtgaaaatccactctaactttgggtattcagaaattttcaaagctgtttcatttcagagtatttgtaataggctgggtgcagtggctcacacctctaatcccagcactttgggaggccgaggcgggcggatcacttgaggtcaggagtttgagaccagcctggccaacatgacgaaaccatgtctctactaaaacaaacaaacaaacaaattagctgggcatagtgatgggcacctgtagtcgcagttacttgggaggctgaggcaggagaatcacttgaacctgggaggcagatgttgcagtgagccgagatcatgccactacactctagcctgagtgacagagtgagatcacttcatctcaaaaacaaaattaaaaaaaaaaaatcaaagtatttgtaatataccgggaagtagccaggtcagcatggcaaataaaccaaggtcccagtcaggcacagtggctcatgcctgtaatcccagcacttttgggagactgaggtgggcggatcacgaggtcgggagttcaagaccagtctggccaacatagtgaaaccccatctctaccaaaaatacaaaaaaattagccgggtgtggttgcgggctcctgtaatcccagctattcaggaggctgaggtaggagaattgcttgaacccaggaggcggaggttgcagtggccaagatcatgccattgcactccagcccaggcgacagtgtgagactccatctcaaaaaaaaaacaacaacaaaaaaccaaggtcctgctaatacagaattatgatcctataacagcactggtcattcagttaatccgacacaatggaaccctaaaaatacggaagcttgcagaaactttttgaatcaagtatcttctcaaaatgtgttccttaaattcaaaactactagtaagaattatgtgtgggcagggagaaccaaaagaagggaggggttggttcatggccaaatattagtaaatttaggaaactctgggttaagcaggtttaaaatgctaacgttgtgttacgttgtggattttcaaggcagtgttcaatatactgtttctcccaaatgtattaactagaaaaccacaatatgtgcagcactgtatacaacatttcatgaaactggtgttccacggaacacactctgaaaaatatcaactgtgtccatccagtagttccaccctgaagttcctggctgtagtataaatctgcaggttatttcatgccttgaaagataatctagttgaaatatattatttacccacaataatactttgcaggctaactttaatgacaagtttcgtttcgtttcatttattttgtccataattttgtcatggaagtagcattggttgttttctacccttaggtgctctgaaaacttgatgatactttaggaatttcagaggcattggtggattaattactgtgttcagaaccacatctaaaaggtcatcataacttaactaaaatttttagcagtggaaaagttgaaaatattataggagtcatagattctcctagtactcaatcacatatgtgttcagtctttaatttattccacacatatctgctggaagcttatgattggccctgctttgtgttggttggtatttttctgcattatgaattttatttttatttagttcatattactagggtggtaacttactaggtaattgcttaaatgtatagtagaatccaggcaagcttagaaaatttaatgctgctcctatcactgaagtttccttgggcagaaaaggttttaaaaccactgatttaaactatcctcttgattttttttttaagtacactaatgcatcataagattaaaatgctgatattttacacctagattatgcagaacctggggatggatcccagatattcttatgctgctaatctttccctcttacctggctgttgttaccatgtgttgtaagtgaaatgaacagaagaagaaccctaaactgggaaaaaggaaaaaaatacggaaggcaatcttttgaagacttagaatttgttttaaggtttcttatgtattattcctacctgttggcaatttaaatttagccaggtgcaatggctcacccctgtaatcccagcactttgggaagcggagacaggaggattgcctgagcccaggggttcaagaccagcctgggcaacatggcgagtccctgtttctaaaaaaaatttgtaacaataatagataaaaataataactacagttttggatttctgttcagaatctggaacagtttgagagttgaagagtttcaaatgcgggtaatctgggagtttttttgtttgtttttgtttttgagatggaatctcgctctgttacccaggctggagtgcagtggcgcaatctcggctcactgcaacctcgacctcctgggttcaagcaattctcctgcctcagcctcccgagtagctgggactacaggcatgcgccaccacgcctggccaatttgtgtatttttagtagagaaggggtttcaccatgttggtcagcctggtcttaaactcctgacctcaagtgatctgcctgcctctgcctcccaaagtgttgggattacaggcatgagccaccgcgcctggcccaaatgctggtagtctggtagtagaacatcttcaaatctctatcagattaaagttttgcttacagtaatctcagagatccttgaaaccaacctcaaggaaaaaggaaggtgttttgtctaaatcgttaaaatagtgttacagagtaacctttgtttccctggaatatacatggaaatagttctataactgatgtcctgaaaattgaaaatcatttatcactgtgactgaggtcttgctctcatctaagtcttcagtaactcaatctttattaacatgtggtagataaaaataataatattccttctattttttcttcatattgccctatctgacatagtcttagaattttaatgacctgcggcagtttatggtccagtggttgtggaaggaagaagtacgcatctgcctcattcatttttatctctattagcctggaaaggactttgccatctgttttatctccctcatttcacagatgaggaaatgaaatccaaaggtctcatcccaaattagtgacagggcgaagacttgataagccagctctgatgctctttcctgtttgctaatctatttctagcaattctcatgaaaatattagagatgagctagatcttatagaaacatataaaagcagtattaacggataaaatatgacatttaatttcctattctatattcttcctatgatgtcatctcagaaggatggtttgtgcaaactgaagattgataagaactggaattaaacatgcttcatatgtgtttaagcattagaaaaagttatttggagtctttttagttacttgaatcctggattaaacttattttcttcatgagaaattcactacctacttctggttctaatttgagggtttcaagtttaatttttccttctttcaaacctttagaaggaggaggtaccatgtgctgactttcacacgctgtttttgctttagctgtgtcattgtgaatttataaatattctacccggcatcagtgttaaattttttggttctaactttttttctgccttgttttctagattcacggcccttccacagtaccttccacaataccagtgctaatctgactgagaggtactataaatttgttactcctttttccagaaataaaatgaagaaaatttaaaatctcttaggccatttaattacgtaaactaagttaattgagcttattgggttcttctttgagtgataaacttggaataatgattaaaagtggttttgtcatgaaggctataccttaaagttaatgtcttcagtagttttattaattatactgtcctcatgataaaaattggttgtatttattgatgtgagggtacactattatttgactttatgaacttgtgcaccctttgcttatgggatttttaattcctaaatctaacagtctaaacaacattttgtttcatattagtgtctgtgtgtgtgtgcaatttataatagtcttagctattttaagctttaaagctgttttcttctgtatacatgtaaatgatacatagctctgtcgaagtaaacgaattgattcttttttttttcttttgagacagagtttcgctcttgttgcccaggctggagtgcaatggcgcgatcttggctcactgcaacctctgcctcccaggttcaagccattctcctgcctcagcctcctgagtggctgggatgacaggcatgcgccaccatgcccagctaattttgtatttttagtagggatggggtttctccatgttggtcaggcaggtctcaaactcccgacctcaggtgatccatctgcctcagcttcccaaagtgctgggattacaggcgtgaaattgattctttacttgacagcaagcaaaagatttctgttctgactcattatttttatttaggttttcatgcttatgagatagaatattctacttgaagtttaattggggttcctatggctgccctgcagttttttctgagttgccttctttttcacagaggcatcagttatgattctgatttagaacccttgcaatgaatgcttctctttgcactgcttttatagcttattctttctcctttctacagcagtggttttcataccatttcccccttatcttaaaaacagactgctgtattttgtaaacaatgcatatataaataaactgactgttgacaggaccccttgtggtgctgcttctgcctgccacctgccctctcacagaggccctagaggcaatcactgctgttctgtgggaaatgtctaaaatattttagaacacctaagcaaagtagtataaatggatgccttttctatataacggattgtttatttgaatgcccagctgctcttttgtttgtttgtttgttttgagacagagtcccactgtgtcacccaggctggagtgcactggcacaaacaatctcggctcactgcaccctccacctcccgggttcaagcgattttcctgcctcagcttcccgggtagctgggactacaggcgcgtgccaccacacctggctaatttttgtattttttagtagagacggggtttcaccatgttggcgaggctggtcttgaactcctgacctcgtgatccgcccacctcggcctcccaaagtgctgggattacaggtgtgagcaccgcacctgccccaaatgcccagcatttaagaaaatcaaccattgcaaattacctaagttagaacatgcccatcttggatggacttagattttatgtaggtttcttgaacaggtagatcactgaatctacataaaactcctaaaattgatctttcaacactgtgcctcaattctgtctgctcctcagtaagttccctcctaaaattgaacctagctgcatggaccagtccacagtcctgattgtcccgtgtgccaaaggctagaaaaaagttgtgatctctaccgttaaggaacttggatatgtggtcagtcataagattccttggtttgcaactcctattaacaagtaccctgtcattctgctacatatatgggtttcctttcaagcacccatttgttacaaaggagtttgtagattgaatgctattgtagatgaatagattccatataaaataattactgaataattgacaggctctttttaacatgaggtcactgaaaatccataattaaaacattaaaaatgggccaggcggtagctcacgcctgtaatccaagcactttgggaggctgaggtgggaggattgtgtgaagccaggagttcaaaatcagcctgggcaacatagcaagaccccatctctacaaaaaaatttgaaaaatagccaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacagaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttggctttagagggaaggattatcccacagaagattacaagaacttttaagactaatatgatttcttagatctatttctaattaggagcatttggaatatattctcttagtgattaagagattaaataaatgtttaaaccgtgtgtgtgtgtgtgtgtgtgtgtgtgtctgtgtgtgtgtgtgtgtaaggctccactgtatcacccaggctggagcacagtggcgtgaccatagctcactgcagtcttgaactgccaggcttaagcagtttcctgcctcgcaccgtagcctcccgagtagccagggctacagtcatgttgtgccatcgtgctgagctatgtttaaatttgtttgtaaagatgaagtcttgctgttgtgtctaggccggtctaatgccttacctcaaacactcttctcgctgcaggcttccgaagccctgggtgtgatccaccgtgcccagcctaaagtaacattttttatctaattatttttcacatgctcattatggaaatcttcaaaatctaaaagtaaaagaatgaaaatctcctggaataaccccgcttagagataactacacttaatgttttggtttatatatttctaatcttttttaaaaatgtattttcaaaagaaagggagaaaagaagttcactttcttatactgattcccagtgctaaaccaaaactgattccatttcaagtccgtggggaaaaacttttcgcctctcacaccctgttcatctacccacaacaccctctaacaaaataaagacataagtaaataaaaatttgaaatcagttaaggaactcttgcaaggaatcactgtgtgtgtgtgtgtgtgtgtatgtgtgtgtgtgcacgtgcatgcatgtgtgtgtgtgtgtggtatatacatgtacatacagatatatacacacgtagatacatgcatatttagaagtaagggaataaacaaacattgaattcaagaatattgtcataaaagggcattgcctcctccctcacaaaacaaggtgcactaagcttctcaagccctcacttcagtgggctgatggaaatatagccaaagtattttaccatgttttgtaagatctcttggtttagcaaatacattcaaagaaatttttccaccaaacgtgccacaagaattgtgttttcatttctcctgtgcaagtacagaatggagagaaagtaggcaatcagggagagatgcaaagagtctagcaaattatttctagcataatcacacatttaacttcagactcagccttgttttataattccaaaaaaaaaaaaaatgaaggtcaaagaatactgctttaccagtattctacgtatttacatattggcagccaggcttaaaatagagccttaccttttttacttaccactgccggcttggatactagttggtatcaacaaaagaaaatccccttggacagagcaatataaattagccaagtattattaaatgctttgtatagtcttagcattccactaggtgttaacaggcacctaagagaactaaagctcatagtcctgaccttgaaaaactttatgatctagtttggatgaattcaaaatgttttcattgttttttattttgctttaaaactactgaatcttgtcttcaaacaagcttttcgtggaagaccaataaataagtggagattccccctttctagccatctccccaatgtcatggagttttaggacagagcagtgaatgtaccactcatctcatggataaggtaaaacatacacatgataggaaaaaaaacaacgtaagatggaatttagaaactggaccctgacctttaaaaaagtctcagccctcagcctagcctccttattttacaaactgaggcacagagatgtatgcttcatgtcacacaacctcacacaacctcacacaacctcctgttatctgacttccaggaagtagtactcatcattttgtgtttaaacaaaatgttactatacagcgtaatttttttcttttaacttttttaatctgaaaggactggagtttgctaggaggagatgagcagaaaggacaggagaaaacatattttgtgttagaccgaaatctgtgatcactggtagaaacttttagtatcagttgacctcttgtctctgatcatctcctttgtcaaaatgacaacacttttttgcaattgagattggttcctctttcagacttggcttcaagatttgatctcttggggtcgtgctgtctttagcagtggaaactcaaaaaattacaaatttgtaaccctgaattgtagtccatttcccattaccaagtgtttagagtgccctagtggcaactgtaagtcaccttttatagtgaggtgttactagctcacttttaaataaaattggaacagcttggcttttgtcaatgtagcaaaagatgattttttaaaaggtgggggtggggcacagtggtacacacctgtaatctcagtactttgaggctgagatgagaagatcacttgagaccaggagttcaaggtcagcctgggcagtatagtgagacctcatctctacaaaaaaattgtaaaattagctgggcgtagtggcacacacctgtagtcctagctactcaggaggctgaggcaagaggatcacttgagccgaggagttcaaggctgcagtacgctgtgtgcactccagcctgggcaatggagcaagaccctgtctcttaaaaaaaaaaaaaaaaaagagagagagaggaaagaaataggggaaatagtaaagcagtatattttgtgttaaataccctcactctgctatgtatctgcatagcattttaccatgcagaagtactgtattttctaaatggtaacataaaaattaatgaatattaaattttcttaacatagtgatgctaactctaatcttgttcttaactattgaataatgttacttctccataatgttaacaaattgaaagtgctactatggatattgacactgatttttctgtgaaaatgataaattttcagtttttaaaaattattttttaaatagatgctgtgagagaccgtctgatccaattgttttattaatctaccatacaataaaactagacctacatcttttaaaggaaaaatttaagcatctaccgaatataatattaaaatgccacctgtaactcttagagaagtgtctaaggattatttgaaaatgtctgctttccttttgcatgatatatatatctttatgaaaataggttatagtgattaacctagatatattccattcagttgtataattgtgatgataaacagttcttaaacatgtccaaagaagccaaaagccagtaggcagtaaactgttcacattcctaggagggtaacatattttgtctggatcactgggttttgtatataaacttaagaaattgagtccttgatcctatgtccttttgagaattatcaccgactggcataagtgattagattagataaatatattgaatgtgtttgtggaagatgagaggggatgctaaacaggaagtatagcaggaagactggcagtttctgcttttgtcttagtatctttgagagatagtgctgtttcctgctaagtaattttgcgtgttacagagtatttaaacactcatatgcatggtgttcgagttcacaaagggagtgtggaatgaccctcttcaaaccatcctatcacactggttttcttttttctaaaccacagttacttttgcaccaacctaatactaagctttcctctttgtagacaaacaagaggtggttagaaatgttttagacaaatctatttgatttgaagtaggtatttttgagtgcacaggttaaattcctgcacagctgcaagtatactacatgactttgtaacaggacattcagttacagctcctaggtcctgtggtctgtataaaaaagagctgtacccataggcctttcagaagtgcctcctagagtagtgtttacaaagacttaattttaaatgtaattctcattccttctttgattaaagatctgtaacatgacagttgtttgatcatatcatgttttcacagttgtccagagtgttctttttattgtaattacatgtataaaggggtatttttggaaaagtgaagaatcacctttgatagtgtcctagtgcagttgttacctgcatctatccctgttaaataccgttagcctgtttctccagcacacagctaaagcattttgccagttgttaaacatggaaaagtcaaacttcagaaaataactagtcaccactttacaccaggcaacttcactgaaaagttttcttatgaaactcactgcattttacaaaatgaggagtctattttaaaataggtaagatgtgttccttaacttcccgtgtaaaaacttggcctcaaaccttgctagagttcttatattgctgcttaagcactgtccacacacactgtttttggggggagtgaggtctcgtttcatttcctgtatcctttgtaacaagggttgttggctttagcagcagcattcaaacagttaagactgtcttaaggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttatttattcaggtttgaagagcattgcaaggcttgagaggataagctggttgccataaaaagattttttaaacgattgaagtataatttaactttcctgagcaaaaaaatcagatgcttttccatttaacattttatgcatggaaaaacctttagcaaaatttagttaaaagaaagaaattatttgaaaaaacccaaatttagttgttgattattactaaagttttatgtactttagtgattaccaattttcactcagaacagcttcctgttttgtaaagtgaaggagtttttctcccttcctctctcattattttttatagttcaaaagtgtagtaatttggctcttagatgttcattatatgtatttgattaacaaaagacttcacatgaatcatagatctagcaattatttaccatttcattacagtggttgggttctgaacagaaagtcagaagacctgggttcccattttgactgtgctgatcatctgttgtgtgaccttttgcaagtcaaccaacctctccagtccctggcagcatagtgcagtgtatgagagctgagctttacagtcagccagatctgaatcttaatttcagcttgagcagttattggcgtgtggcctcaaatgcattattaaacatctctaagcttcaatctcttcagatgtaaaatggagataatacctagtattatcattgggttgttgtgagaaaatacatgtaaattgcttactacagtgcttagcacgtagtaactgttcagatttttagctgttatttattatctttatcctctacgttgtaaaatgggaagcataatgctcaccctgcccacttcagagttattgagtcagacgaaatgatgtatgtagaagacattgattcaaaatgttaaggcatttagtagttgtcatgatcactgacttgggacacccattttcctggaatttttttaggacataacaatggtattgacaataggtaaaacctcttaccttgtgaatggtaggtctttgtagtccagttggtttgaaaggaaattatttcattgatactgataagccagccaagtactctgccaaacagtgcttctaaaggaccttttatggagagcatggttatatccccatggtcctggcctcctaaggatggtgtccacctgaaatgtccctgactgctttagatatttcattaaggacccaccactcatcagtagttcttcaagttttcagtgtttgaattcctttccgttcctcttcatgactgtgtaagctttgacaacagcctctcttagattgaggcttgatgtcatatgagtcctctgctttcagtctgtctctagaacatttctgacattcctgcagtattcttaaggtgacatggccaacttaatctggcacttagagctcctgactctcagcccagtgcccccactgttcacccagtctcatgtctcatttgctggtgtcccctgtgctttgtacctagcccggttttggcctgctcagtaagtagaagcacctgggcagtggctgggcacacaggaagcacaagatgagtatcagtttctgttgccactctgacaagtgagggaagaccacaggaaagaaaggagcttcacaaaagaggtcagagagcacggcgtaggaagcttatctttccaacctagggacactgcctgcttttcctgccttcctgcacccctaggtactcagggtagaggagtgagctactaagccttgggacttcctttccctggaaccccatttttttaaaggaagtgaccctgttggtatctagcttgaggaacaacaaaggtggtttttgagaaaaattattaacaaggctccttcctgtcatccgtgcattctcctatcctccctgccctgcaccgttgtcctttagccactccccaatttcttctatcttccctgctcacatcaaaacttcctttcccttactgcaagcaatacctttctgtgttggcttaggagaataatgagctaatgaaactcatttccagtaaattatgagtaattaataatattgctaagcattattgtgtattcactgtgtgccaggcactgtgcaaaatgctttagaaatgtattatctcacctaattgtcatatgttttaaaaaacatatgagatgggtacttttgtgattactcccatttgacaaatgagaaaactaaggctcagagaaataatttacctagggtcacgctattactgagtagtagtagtggtggtggtggtgatggtggtggtggtggtggtggcagtagtggtagtagtggtagtagtacctgaatctgaaccgaggtctggtaccatcgtccgtattcttaaccactgtacggttttccagcctccccttcttatcagtctcctcttgccggtttgaaaattagggcaaagttaatatttacaaaccttaaaattctaattagcagaaactgaaaatgtatatgtggggcatatttaatatttctaactagagtaaaggaggagactttatacatactccgtcacttagggatatgcaattgatgtgagaaagagaggagcctcggtaatttttcatgccacccaggcatctttttttccctcaggctgatcccagaattgctgccacccttttttctgccctctgcctaaagctggccctaaacccatgactctcttcctgtgtggactgtgctgtagcttgctgaggaagggctgtactgaggtgtcagaagcctccttgcagtgctggtccttgggtattgtgtctgttggtagaagtaaccaatgaataagccactgccagaactgttccgcctgcccagttttcgtgtgaattttctaatgtagcttgcgtgccaacgccttaatttaaaaaaacaaaacaaaacactttgcccagaactttgtttctcactcctttccaaaatagtcaccagctgttgttaaccacatgccatctgggtgcccaggtaaggagaaagccctccagtgttcaattaactgtggattattttcttttcttcggcaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaagtaagagacatgcttcttcctctcgtaagatggaactctcttggctcaagaaagctcatttcttgtttcctgtccccactcattatctgttcctcatttatgtggagaagtaaccctttttatatctttctttagacatgataaaagaaagaaattctagatgtataacatacagcctatatttttttcagacagccccaatttcaaatacagtcaagttaagatggttcagcctagctttttaactttacagtggttcaaaagcaatacacgttcagtagaaactgtactttgagtgctggtacactcatttcgtttttcacatttagtgcagtattcaataaattacatgagatagtcaacactttatcataaaactggctttgtgctagataattttggccaactatagtctaatgtaagtgttttgagcatgtttaagataggccaggctaaactatgatgtccagaaggttaggtgtatttaaatgcatttttgacttaatagtattttcaatttaccatgggtttatgtggatgtagcctcattgaaaggatgaggagcatctgcactctgttctatgatctctaaaccactgcacgttttaaaagtctgtgtcagcatcaaaattatccataaccccaaaccctaaagctactcagtggtcttctgttagatcatatgtgctcatttttattctattactttggtatatgcttcagccattaccaacattaagccatagtgacggccaagggagagcacctccgtgctcagggacattctgtgctgacctgctgaaagccaagtctgctaactgagcattgttcctggttttgataagacactctcaggcaggagttgcttaactttttctgtacaagaccagataaaaagtatcttaggcatcgtgacccacatggtctctgtcacaattcttgaactctgcagttgcagtgcaaaagcagccgtaagcaatacataaaccaatgagtgtgattccaataaaacttcacttatggatactgaaatttgaatttcataaaatttttgttatgtaatagttttttgatttttaaaaactatttaaaatgtaaaaattattcttagctcatgggctatacaaaaataggcttcaagccacatttagcccacagaccataatttgcacgtttttgctgtaaggcagtgcatctcaaaattttgtcagtgcacagatcaaaagtagtatttgtagagcataccagggtaaatcaaggaggctgcttctggtcagaggtgacagtctggagttccagccagtccagggccagtccagtcacccggaaggctgaggtaattaacatgatactatatctataaccaattcagatgttatagtgacgaattcagatgtcaaggagcaactctcagaccatgatgtcctgaaatcttgttttcagtcatttatgttggatatcccaagtaatttcttactaaaaatagttaacttactgaaatctgattttttttctttttttttttgagacagggtctcactagttgcccaggctaagtcttgacctcctgacatcaagtgatcttctggctcagccagcctcctgagtagctggtattaggcatgcaccactgtgcctggtagaaatttgaaatgtttaaaagtgtatttgggccaggcgtggtggctcacgactataatcatagcactttgggaggccgaggtgagcggatcacctgaagtcagaaattcgaaaccagcctggccaacatggcgaaaccccgtctctactaaaaatacaaagttagctgggctttgtgacacgtgcctgtaacctcaactactcgggaggctgaggcaggagaattgcttgaacttgggaaggggaggttgcagtgagctgagatcgtgccattgcactccagcctgggcaacagagtgagactccatctcaaaaaaacacacacaaaaaaacgtgtatttggacagattggaagttacttctgtgatgattttcactcactttcttgcttggaagaggaggagtggagttacagctagcacacagcctgtctaatctgtgctacagttcctgtgactttttgatatgactgactttatgacacacattcatgtaaaatgatttttattggatgttacacccccaaagtagtcagcaacactatttgttttactgtcctattttttcaaaagtaaccaaaaaccatgagagctctcacccgaatcctcatgcatccctgtgggcagagatcacacacattaatgtcatccttcatttgtgacttaccagaccattgagagccactaccacataataataatttcatgtaacctctaggaaacaagagactgtcactgttcagtattcctccagtgtttattttggaacccaggttctaataggactcttctgggacaccagtcggaggtctatagtttagttttttagccattggacacagttagcttcttagtactggaataacctggttgcctagagcagtaatcaccaagcattttatagcatgttcacctattattaaaacatttttagcatactcacataggatacatacataacataaaaattacatacaagtcctactgtgccatactttccaagagctcattctaaaaataagtctcagaattgccattttcttgttttctggttagttattagtatgattagtattgtctttgattcatgacttctttgaaggaatttgtgtaactctcatcattttcatttgattttagtggaaaccaggtaatataatccataagcccactttattggatacctgtatgtttccattcatcacaacatgctgaaagtaaacaaatgtggattatgcatgcccagcccatctcctgagtgaagaataccccgctcccttaagaaacctctagtgtcacatataaagtgaggctgcctaacataaagactgagcgaggcacccacttatcaattagacattaactcaatttttcttctacgttaaggagtcattttaaataagagctgtaaaatcttcctcctgtgttccaagggattgttttttacatccctccttgcagtgtgccagttcttcttttggagagcactgatctcagaaaaacgggaagaggctgtatttcttgattggcagtatgaaattaatattcagggaacttcatcagtaaagcagactagatacctgccttctgctataaaatataaaatgctaaataaaatctattttttaaaaaattaatacatagctgaacctgccaaatagaaaattcctgagggaactcagagcagtaaagagcatgccccctcatttggggtcaagatatgcggcctcagggtatgtagtgggagctgggactgagacccctgtataagaaatgctgttttaagactaacatccatgatgaagggccttggaaaattctacccagtggccttcagaagcagaaaggaaccttacagtctccccaggtccctgagtgagaattgatgaatctggagtccaagtttacaccgtctgtatgtgctagaacttcaggctaagaaactttcacaagaggttacatgaaattccagtttaggaatgacagatccttgagggacccagcctgtagcagatgtagaactgctccattgggttaggttgacaaatcagtatacccaaggctacggcaggaggaataaaatcctatgaagccgagctcatgataaaagatacatagatgccacataaggaagtaaaccaccatgaggaagaattaggggatgtacaagcaagagatgttgaaaatcactaaaaggggccgggcgcagtggctcacgcctgtaatcccagcactttgggaggctgaggtgggtggatcacaaggtcaggagttcaagaccagcctgaccaacatggtgaaaccccgtctctactaaaaatacaaaaattagccaggcttggtggcgtgcgcctgtaatcccagctattcagtaggctgaggcaggagaatctcttgaacccgggaggcggaggttgcagtgagctgaggtcgcgccactgcactccagtctgggtgacatagcgagactccatctcaaaaaaagaaagaaaattactaaaaggatgaaacgaatagaatctataatggaagaaaaagacgtaacaactaatgggtagatttaaaaacaactgagtaaaatttaaagcatggaaatagtcattgaaaggtattcatggattttttcaaatatttcagcatattgtcctgatttataattgtttataaaggaataagatggcttctactctgttgtctgcattagtaaggggagagcttcagtctagaaagtcttaatgacttcacactggatttgttttttacatttaatcataaataattgtacccttaagtccttgatcttatatgaagtcaatcaacaaagttcatttgactgaattctgcaagctactgtgtttgatatgtgattcatacaaaagcagtttgtcaacaaatatttattgaatatcaatatgagtcaggcacccacagtggcttaaaaaaaggaattctaaaatgatccttcgtacttatttattgtgaacttgtttatattctggaaaaattgaaagcaatttaaatatccatccataaaatatagtatattttgtatagtatatagatggataggctgataataaagagagaatataagggccaggcacggtgcctcatgcctgtaatcccagcactttaggaggctgaggctggcggatcacttgaggtcaggagttggaaaccagctggccaatgcggtgaaaccccatctctactaaaatacaaaagttagtcgggcatggtggcagtgcctgtaatcccagctacttgggaggctgaggcaggagaattgcttgaacttgggagacagaggttgcagtgagccgagattgagccactacactccagtctgggtgacagagcaagactctgtctccaaaaaaaaaaaaaaaaaggagagagagaatataggacagatcagaggttgccaaactttttctgcaaaggaaccaatggtatgttaggctttgcagcccatcaggtctttgtcatgactactggactctgtccttgtagcacaaaagcaaccatagacgatggatgtgactgtgttccaataaaaatttatttacaggcctggcacggtggctcatgcctgtaatcccagcactttgggaggcctaggcaggtagatcacttgaggtcaggagtttgagaccagcctggccaacatggtgaaaccccgtctctactaaaaatacagaaatcagctgggcatggtggtgcacgcctgtaatcccagctacttgggaggctgaggcaggagaatcactcgaacccaggaggcagaggttgcagtgagccgagatcgagcccctgcactccagcctgggaaacagagcgagaccttgtctcaaaaaaaaaaaaaaaaaaaaaaaaaaatttacaaatacaggctgtgggcctaattcagcccaaggaccatagtgtgccaagccctgggagagatttgcaggtgcagacagagctctccaagacattttgatgagttggaaagtcagtaaatagaacaatatatacagcatgatcctagtttatggaaaacaaacagtttatataaatttacaaaaatatgccagggatggtggctcacagctgtaatccctgcactttgggaggctgagacgggcagaacacctgaggtcaggagttcaagaccaggctgggcaacatggtgaaaccccatctctactaaaaaacaaaaaattagctgggcgtggtggtgcatgcctgtaatcccagctactcaggaggctgaggcaggagaatcacttgaacccaggaggcagaggttgcagtgagccaagatcacaccaccgcactttagcgtgcgcaacaagagtgaaactctatctcaaaaaaaaaaaaaattctttttacaaaaatatctgaaaggctatacaccaaactgttaacaatctgaagaaagagaaataaggagaaaaggagttgaagaggactctttattttattcttttagattgtttgaatttttagagaatgtacttacatattatttgtatgtctaaaaacaaaatgtaaatattggaccactgatagtttcaaaggtttttctagttatttatcagctgatctctgatgaaggcacaaaataagttggtatttgatttgagaatttaatggacaaagcagaattactaccagaacagagtaagcttataagccttgaggagagttgttctaccactgttattgatagcaccagcttgaatcagaagtagtatagttgatctaccaactctcagttctggattgtgatgtgaaacattatcaggagatttaaggttgaaagttatagacagtctttttgaagacccaaagaatcttgtgctatagaggacaatagatttaagaaccgttggcttatggttataatgagtggctgtacctttccatgactagctccagataattttgcaattttaagttcaggctaaaagaagttgtctaatatatgccagtgtatatttagccttgtattgccattgacttgtgtatatacattatttctaggttacaaatagttgaaatttgccctctttggctatattaagtctttgtctacattagactatcactcagaattaaacctgtaactggcatataataaatttatcagatagcagaaatattcagttaatgtaggagaatgcacaggcatcctaagcccatttttgctttcttgatatgtcttcctgttaaacatgatagaaattctcttttactggactccctggatgatgaagcacacatagctaggacaccacaagttattagactccttatgctatcagtgtcgtatgtgctagaaccgcctctggagagcaagatctgggttacctcttggagacttccattgcccaacgatgccagaggtacccgtggagaatcacttgtgtagggtttggtattgactggggaaaactgtaggaaaggtttgagggtctgagattctcagccacacttctgtgtagtaattagtttaatggatagggcggtagctttcaggatgtcaggtgtttggaagctccacagatttctgaatttgtgtatatttaaaactacataaaaacgtaccttcttaaaggtataattcccaaattttaacatcaacatatcagctttagctatcagcctacctattcatttgtatttttccttccatctctaattaattgaagattatactgtgattgcaaggcaagccattaaaaaaaaactgctaatattggttatttatctacatgaagaacgttaagatgttctctgtgtcatgtactcaaaattaaataaagaaattagaggttgtggtaggtaagtgaattgcgaatgtcatgcacctctgacctcacgtttttagttcatcacagctgcttcattgttctcattaactttgaaagtaaatattaaaattgcaactcaaaataaatctgtactgttttacatatctgaacacagtatattaatatttcatataagactttttagagtttttctagtattttggaaaaccagtgaaatagtggattggctactggttctgtgctaatagtgtttataagtggaatgggactttttttaatatgaagtcacccaaggaatttgctttttctggaggcacgttatttcatgaagtccagtgtgttatcactagactaaagtcttttctgtttgggaagtctgtcggtggggacaggggtcataataacctttgctagttgttctttgatttttggtaatggcttgatctaatcaaatatcagagattatcttagttctacctgctcagcaaaaaccaggaaaaagagttaacatatttgaggggttttttttgttttttgtttgtttgagacggcgtctcactctgtcacctaggctggagtacagtggcgcaatctcggctcactgcaacctcctcctcccaggttcaagcgattcttctgcctcagtctcccaagtagctgggactacaggaacacgccaccacacctggctaatttttttttgtatttttattagagttggggtttcaccatattggccaggctggtcttgaactcctgactcaggtgatccaccctcctcaggctcccaaagtgttgggattacaggcgtgagccaccatgcctggctatatttgaggtttaaactgaaaagtatcagacagcaaaaaggaatagtttaagttgggcttgactgttaccctaatatgcactaagtttcaaaaatacattctttaatttgcataccaccctactccagaagtaatgtagaaatagtctcaacatctggtgatagcattaaggtttatgtaagacagtctgcagcctgcctcttataaaaagaagggggtaggccaggcacggtggctcacgcctgtaatcccagcactttaggagggcaaggcaggtggatcacgagatcaggcgttcaagaccagcctgaccaacatggtgaaaccccgtctctactaaaaatacaaaaaattagctgggcatgatggtgggcgcttgtaatccccagctacttgggaggctgaggcaggagaactgctcgaacccgggaggcggaggttacagtcagccaaagatcgcgccattgcacttcagcctgggtgacagagcaagactcacacacacacacacacacacacacacacacaaaaggagtgaaaaggattgaaagcaacaaaatagtatgtagtcatcttctcaaaggaaccaaagtaatgggctgattatcttcagcttcctgaagaagctgaatgtttgtatgtaggaagtcccatgtgttatcttggcaggaagtagaaaatatgagtaatttggggacgcagaatctttcgtcacttccctccatcgcgtctcatgtccaggatcttcccaggagtcgtaggaaatgtagcatccatgcagttagtcgtttacctcctaggaaacctttgtgctcttaggagacagtggcttcccattgtggttaagtgtaaccctgtttggctgacccctggatagagcttcataccctcagcactgcatagtcacctttgacttgtggttagaaagatcagccatatagtccatcatgatgatatgttatgatggtttatacaagaaactgggactttttatctcagccaaaacgctactcttgctttaggattaggtgactttaacagggttaatagaggaatgtcttttcaactcttatttctctattatgtaaagctgtccttgaatagtcagctgttctttccagctgccacaaataatttgttctttgaaaagcttagtgacttagtggggtctttcagaataaggaatttgttatgttcaggttttggggtcttgccagtggttctgttttgcttgctttaaacagatgtaaaatgatactgagattattgctgatttattttctgttgtgctagcagcatttcagtacttttgtggtaggttgtttcttttacataaaaaataaacaagtaaaccagctgcaatctaagtaggaaacataagaatttagaatgtgtgtgatggttagattttacttctgatttcatcagaaaagttgccctctagacagttttctggcatttatagttcattgcttatatgagagaataaaatacatatagttgattaaaggaaggaagtttattacttagggaaaaggaaggtaaaaaaagaccctaagcaataaaggcaattcttttttaagcagaatactttcattttatttcatttttgtttaccagtgttgttacgaaaactgctgctggggctacttcagctgagatgatttggctcttttttgtggctttcttcttgttctgtacatcagcactgtggttattacaccagctaccaagaacatctcacatgccttttgcatataagcactcttagtccagatagggcgatgtctcaaatcccccaaagattttatttattggccaggtgccgtggctcacgcctgtgatcccagcactttggaaggctgaggcgggtggatcacctgaggttaggagtttgagaccagcctggccaacatggcgaaataccatctccactaaaaatacaaaaaattagtcaggcgtagtggcatggaccggtaatcccagctactcaggaggctgagacagcagaatcacctgaacccaggaggcagaggttgcagtgagccaagatcgtaccactgcactccagcttgggtgacagagcaagactccatctcaaaaaaaaaaaatatatatatatatatatacacacacatatatttaataatttttttttgagagacagggtctctgttaaagattttaaacaagaagtttaaagttgcagaaagaattttgtagcatgcatttctaaatttgctcatatttaactgttttttgttttattttcattttcttggttagagttgaaatgataggagaaagttgtgcatttctatccttaaaggtaattcctcaacttgtgtcctggagaagaatcaggtcatttttcccagttagattttgctgctcacatctgtaggcagaacagtcagaagtcttcagcctattcccaagtgatgatcaatgaactgaagtactggaagaccttttttgtcagagccttggctgcatatgactcagctcccaaaggtggctcgtttctgtgtaggcagtcctttgatattctgtcatttcatttcagtttggcatggccactcctcttatcattgtataaagttgattttcttaagttagcctcgctaatggtttgttttatttttcttccgaaagataaaaaacacatagtatataaccattcgccaaagatctgtggtggttggtggcatgggttaaaaaaaagatacagcaatagatagatgatagtttccagtcatgtgggtttaacttcattttctttggtttgatgcctccttgtagcaaagaaagaagttgaaggctggactgtttgttttaggtacagaggaatccgattagggatcagctctgttcccataaaccactgtgctgagacctttttgaagaattttaaaaaatgaaagcatattgcctactgctattaggaaatctatcaaataaataaataaaaggccagataattattttctgatcttcataacaacatggtatggtttgtggcagagagcttaaaaatgtattagatttgtcttcaattcttgtgttcttggtaattttctgttttcccaaacagagagtaagattttagtctcatgactttggctgatgtcagtggggctgaagtttctaaatcacccacgcacagctctaaaactgtcactgtgaattgagtccaggacaacttggaaacaagttgagtgtttttcaagtaggtacttcagcatgttaaggagatgtccatgcaaactatcactaagagaaaactcatgaccataatatagagcgtgttaaacttccagctgggttgtgggtttggggacatgtttcaattaattaaaagtgaatttatgtgaaaagttctttactagaagcacattttaaatgatttttttctgcttctatgttcatctcagacactcaaacactggcctgagagtttgaatattgctgaaacctttttacgtgatagtgccactcccttaaaaatcatcattgcttaaatctctgtagggtgttggaactggttgggaagaaaggaacagaaagaacagaacttggaaacaaattctgcccatagtgttcttggtcacttttgcagatcagaattagtagctggttctccagcaaatctgccacctcctgtgttgcccttaggtgcctaaaatattatagattttcaataaaacaaaagaaaaaaaatatacttttttaactggattataagacaataaaatcttatctttaagttatcacaagatgcgataaatggattatgcaaaaggatatggaaatgtttataagcaaatccaaggaactttgaacgacattagagtgtgatgattttttaaaaattaaaaattttttttaattttgaaaaatgttaatacaaagtattatacataggtaatttatcacatatgtgtccatgattcagaatgaacacatagtaacattctgtcagacggcttcagattgtttcactttttaagaaaccattatggttaagttcagattcccctttgtttccctgccccatgcatcttccttcctccccaaggacaaggactgtcatgaattcagtgcattcgtagtctgtgttttataatttattttcatacataaacaacatataatttgtttttgtttttaacctacataaatactaccatacagtacctctttttgtaatttgctttattctcttcagcattatatattgaggattcagcacgctgaaaaacatagatctactaatcattgactttgccttttcatagtctttttatactttttctgtagaagggaaagagaaatggacttaaagatgatgtatttgaaagactttagctgagtggggatttgtgaagagaaagggtttgagtggggtgggctttcaagtctgtgcatgggaaggatatgatggatcaactaatgggagaggaagaaaccagaaaggagcatgccagctgcaagtcctgggcatctctgtggcagaggaggggaggtgcaccatacaccctgagtaagaatagtgctcgtgaggatgggcagaaacatgttttggcttactagaaaataaataaagccgtttgcctcgaccactttgttatgcttcttgctgtgggtccagcagcctgaaactcacttacccatctgatagaatcacagcagagggaacctgggggaaaatgtgattcctcctttttaattttatagatgaggaaacggaggcctgtcaagaagggactagggtcatactagtacatacatacatgcagagccaggacctacgtcaaatttagtttgacagctgtttgtccttttgtgttactaaattgatgtttgacatactgtaatcaaggctgtgtcagcgcattcatctaattttagtttaaataggcatagtagggccgagagaggagcatttgaataggatgcatgagctaggcactatgctggagagtcttaatttgaagattcagcagtgggtgaatggtccctgccccagagaggggatagagaaaaacctaagagagtctcaatacactgtgccagtggtattaaggaggagacctgtgaaccaagtgggtgttaaaggaagtgttacaaaaggcatggaataggcctttgaggtctgggattctagcagtctcctttctggtttccttccctccccatcatcactccagtcccccacaaatccatgtgtctgggctaaaagagatgttggcccaaaagagatgttggcccttaactggtgagttgatgtagacaggacctgtgatgcttcctgaatcagtctgtgaggcattgcctagtgaatggtatctgtggttgatttcctgagtgagcccttcccatgagagtgtctcctcgagtgtccccacaggccgatctttcatttgtttctgctttacctctggcttcctggaacagttctgttatgtgactttatagcagcgctgagagctgatggtaagccttctgagacacagaggcttgggtttttacgtcagtggcccttgtaggccaagggagtgaaaagtaaaggaattgagataaaatgctgtccttgccaaattgtggtttctgctttatctttcaagaagtctccattttctcttaagtcacagttcccagaggtgcatgtgggggttccagtgacctttcatgtgtggttcctgtctcagagaatggggtgcaaaaagcccagcgtagttaagcttttcagattttatattctgtgctttattacagtcatacaaattttgtaacccctgttaggggctttattaatgtatttatttgtaatttagacttacacattgatggcagacactttcacttttagttttggtagcctctcagcttcctgtctgaaaagttccagacttactagtttttgttgattagaaatcacatctgttgcttcctaagggccaggaaactcacccttcccatcagatcacttgagtcgttgttcctctcattaagctgtaatctgtctcctggtctccaaataaagacacaaacaccgaaaaaaaaaaaatcacatctgctcgtgtttttcctcctccaaataacatcacagacctgcttcctagaagaggactgcagtgtgtaatttcagtcacattctcacatgtgagtgacttcactttgaaattcagaggccacttgtggcagcagtggaaactcagaatctgggatctgtttgctttgtccatgtgaccttgggtttgctttcttttcagattgcagtgcttttgtccacaaaggctgccgagaaagtctagcctcctgtgcaaaggtcaaaatgaaggtaagactttctggctaaaacaaggcttaaaataaaagggtttaaaccagcaaaatcctcgggagttgggagagttgaggttgtggtggattttgtttattttaatcatttggtaccaactttgagaacaaattataactaaaaaatattttttctcttaagcgatcaatcttcttcttgagtaacactggagaattagactttcagaaaagaaaacgctttcagaacttcttcacgttcaatatacatttcttcgtgattttaatatttccgtattgctcttaaagtggttttcttcttaactacgtctgcaggcctaccctgctgttcatacacctgtcttcctccttcaggactatcagggcagcaggtggaggtcaggggcattgacctgctggtgggggtggggagggtgttatggttagccccagcctgtctggtagcacttttctcctcaggtatgtaatataggtggctctgatcacatgacgtaagaatagaaagtgcctgttttatggtggtatctgccctgagcatgtatgctatgtaatcatgctttcccagtggcccttaaaaaaaagtgtgggttaagggccataccttttaggtagcctgtgaggttttcaatgttctagtcgcctgtaagtgtctcttcattccttgtcaaaggagtgctttccaacttcgtcgacacagatgattaatgagctgtgtgcttcgtcagtcaccaaacacagttatctagtgccatgacctcaacctggaatgtgcatcagaatcaactcgagggcttattgaaagacaacttactgagccccactcccagagtctcagattctgggggagagtccaggaatttgcatttctagtaagttcccagatgatgctgatagtccgaggaccttactttgagaagcactaaaactagtgtcaaaatggcaaagaataggatagccagatcttctttagcctatggacacatattttgtttggctcatgtagtatttttaaaatgtgagttagtgcagctctttcaaaatcatgttttatatcagtttggattcttaagttctcctgaaaaaactggaagatttataacccttggctccctgatatttccctgtacccagcactcccagtttttccttttttccatagtacttatcaccttcttagagtctgtatttacccatctttatttattattatatagttttttatagtctgtatcttccccccactagaatataagctccaaactcattaagcaggctgagggcaggagttggctccatcagtggcgcctgagcacctcacagggagggagggatggctggagctgagtggtgctgcctcctttagacaggatatgccagttccaggctgccactgccttcccacaccccaccccaccccagcttgcttctgtcatttgttgcctgccggcaccatagtcatttgagtttgtgatctctgataagactcaattgttgtgaatgtactagtttatacagaatgatcatgatagagacatagcatctcccatataagagaatataacctaaaagggggaattttattttattttattttattttattttattttattttattttagagacagagtctcactgtgtcacccaggctggagtgcaatggcacagtcttggctcactgcaacctccatgtcccaggttcaagcaattctcttgcctcagcctcccaagtagctgagattacaggtgcccgtcaccatgcccagctaatttttatatttttagttgagacagggtttcgccatgttggctgggctggtatcaaactcctgacctgaggtgatccacccacctcagcctcccaaagtgctgggattacaggtgtgagtcaccgcaccctgcctggaatttcattttaaataggaagtaacctatttcttctaatgatttatctcagattaatcgcttcagtgtataatctctcaaagtatttttgctacatggctacaacgaaagtattaactaaaattagtattttacccaataatttagcaccttataaatgctagttactggaaatgaaatgcaaaagtcaaaagatgctgcccttaaggcaccagcaatctactggggaagacggacagttactataaatgagaaaggtgccagtcactgccttgggtgaggagaggagagaagctatagatggctttaccaaggaggcaacccttaaatcgtcttaaaggggaagaatgccatgcttctgaaggtgagaaaagcattccaggcaggatagacagcatctacggcattggagtacgtggcaggcttagaggatggcaattgggggcgaccgtggctgggacacagggtgcttagggcagtgcaaaaagcagagtgggaaaggaagctgaactgcttgctcccttcctactcggcttctcagggcttgtcagaggtgaattgtcaatggacttactttctttctctttagcagcccaaagggagccttcaggcacatgacacatcatcactgcccacggtcattatgagaaacaagcgtaagtagctcagcccacctctcaattccctttctgactttctggttctgaatgtaaaaatgctgttgtaatattcagttattattcatagtcaagatatgaatacctattttgtggtaagtgagagaaggctgctgttttatcctgcagattcctttacccatataacattataccatcaaaccctcttggaaggtctctaaaacagtctgtgtattagcttaaaggcagcacctttgccctgtgtgtttaagcaagtgacccctgcgcatctcaacttcctctttaatagtagttgagaattaaaagacttgtttttagtgccttacaatcatacaaatcaaatgagatctggcttgttaaacttttttttttttattatttttttgagacggagtctctctctgtcgcccaggctggagtacaatagcacaatctcggctcactgcaacctccacctccctggttcaagcgattctcctgcctcagcctccccaatagctgggattacaggcacgcaccaccatgcccggcctaaacttctttctaaactgagaagttatagaaaatagttctttttttttattatttctaaggacctcaaatgttattcagaattgagtaaatcacactcttccattcacatcaaaccattttcaccagtgcatagaagactccactttggttttactgatacttttcccttttcactccccattccctgtctcattcctactttagtatatttaatgtatgtccttctaatctgccatatttttagacatatgtatactttgaaaaaaatgtattattttgtgtgaatttaaattagataatatgacttatgcttatatgttctgcttatttttttcactcaatattgttttgagatatgcatgttattgtacgctattgtttcagactatggcatggtattctttcataagcatatttcacatttaaagttcccctagagacagaatatttactttgcttccagctactaccataaataatgcaatgattaatatcttcttagctggctccatgggagcctctgtgagacttttcccaggcagtgttcttgaaaatgtagttttttagaagtaaagattcttgggccccaccctgatctgtgaatcacaaaccgtgggatgggaccagcattctgtgtttttttgtggtgtgtgggagtgtgtttaatagagacagggtcttgctttgtcacccaggctggagtgcagtggtgtgatcatagctcactgtaacctcaaactcctgggctcaagaaatcccctcacctcagattcctgagttgctggcactccaggtgtgcgccgctatgcctggctgattttttaatttttttgtagagacggggtctcactacgttgcccaggctcgtctcaaactcctggcctcaagcagtcctcatgccttggcctcccaaagtgctgagataacaggcatgagccaccgcacccagcctggtctgtgttttaatagatcctccaggtgattctgatgcccactcaagcttgaaaaccgctcctttatgcccagtttctctgagtacttccagatagctcctgaatggctatactagtctacactcccagaagagagtgattccctttagatatatttaatctggtttttatccatcttcacacgtagatgactagaagaggagcttctccaggttgatacccacttttagtctgtgatcttacccattccacatactttttatgtctagcttcctaaaatgctttttttcttgtgacattatctgttgtttcagaagtctgttttctttcttattttcatgtctttcttaaaaacaaatgcctattatgtgcaaggttcatgagtattacctttgatccccacaagtatttttttttttttccttgagacaagagtcttactctgtcacccaggctggagtgcagtggcacaatctccactcactgcaacatccgccttctgggttcaagcagttctcctgcctcagcctcccaagtagctgggattacaggtgtgagccaccacacccagctaatttttgtatttttactagagatagggtttcaccatgttggctaggctggtgtcgaatttttgacctcaaggcatctgtctgtcttggcctcccaaagtgctgggattataggcgtgaaccactgtacctggccctcccacaaatattcttattcctgttgtactccactgaggcaacatagtggtgtagagtacagattgtgaattctaattgtatggattcaagtctgacaccactgcttaagagctgtgtaactggacattaccaaacctctctgtgcctcattttcttcctctgtaaaaggggacgataatagtatcatagggtggtagtcaggtttaaatcagatcatacctataaagtacttagcagtaaacattccttaagtgttagctttcactgctatgatcatcacaaataaggaaacagcaatattgagtcacttacttgggtagaatatggattggttacaaataaggaaagctgttattttcttcccccctatgctggcttttagatacaagttattatgagctctgcctaacatcattctgcttttccagccctttcactgattccttctacctgcttcatcttctactctgtgtctcccttttacattaatactacataattacttctgccttcattccatggttcttctcatcagaattgtcctctcttttttcttctgacccatccacatccttgcaattcttcaagaactagtgttttcttcctccatcagattttatccgctcagtgacctcccttcagaaacattcaggttatgctccaggccctttaactcttaagctcattctcttttctacccacttgctctttttctcttgggtgggggtgggggtgggggcagaggggtagggccacatcccataatccttgtgtactttctgcagctagaatctggtcaggttttagaatgtcgggtttctgctattttattgtgtcatcatcttgtaaatagaatttgaattggaaattaatgattatattaatgctcattgagtcaaagacatcctgaaatactgtgaagtcataactaccaccccagtcttatttccttcacctcttgacactcctggggatggacagataatgcaacctgtgaatgggacagcaagtccattaccagggaaaaatgttcccaagtgccagcgtgaccactttagcaaattagatctccagtttcctctttagtcatgttaatgagaaatatgcactatgagaacaatttagaattgacccttgaataactcggatgataggtgtgccagccccacccccatgcagtcaaaaatccacataaaactttttgactcccccagaacttacctactaatagcctactgttgaccagaagccttaccaataacataaacagtcaattaatgcattttgtttgttatgtgtattatatactgtattcttacaataaattaagccaaaggaaaaaatgttattttaaaaatcataaggaagagaaaatatatttactgtttgttaagtggaagtagatcatcataaaggtcttcatccttgtcgttttcacattgagtagaccaagaaggaagaggaagaaaagaagggttggtcttgctgtctcaagggtggcagaggcagaagaaattccacatataaggggatctatgtagttcaaacccatgttgttcaggggtcatctgtagttacaggtgttaaacaagtgttaaattttcctcatctgtaaattaaaggaaatcatcaaaatctatgctcgctagcagggagcgcagaagaatcacttgagcctgtaagatatgtagactcttgggttccacccctagaagacaaggggggctgagattccatatctaacaggcactccagatgtcttcatggtgaacggtcctaaagaacgctgctcccagttatctctcaggttccttttacccttaaaattctttcaatcttggggccaggtgcagtggctcacgcctgtaatcccagcactttgggaggccgaggcgggcagatcatgaggtcaggagtttgagaccagtctggccaacgtagtgaaaccccgtctctattaaaaatacaaaaattagccaggcatggtggcgggtgcctgtaatcccagctactcgggaggctgcggcaggagaatggcatgaacccaggaggcggagcttgcagtgagccaagatcgcgccactgcactccagcctgggcgacagaacaagactgcatttcaaaaaaaaaagaaattctttcaatcttatttgcagcttaaatattaaaatatgtaatactcccacaggattctttatccccgttgcctgtcccaccccagaggtaaccactcttcttagttttttttgtttattttcctggagttcgcttgttaaagtaaatacaacttggattatttttctttcttttaagcatgaaagatagcctgttatatactttgttctgcactttgattttcctccccttaatagatcttggagatagatctatctgtgtcagtacttggaaagtgtccttattttttgtaagtggcattgtattctgctgtgtggtgtagtataacttattcaccagtcttcttgtgatactcatgtcattttcagtcttttgcttttaccaatggtgttgcattgaataactttggacataacatcatttcacgaatatgcaggtatatcttgtaaaataaacatagcctaaaagtgaaattgctggatcgaagaatataggcatttacaatttcaatagttatcaccaaactatcctccatggagtttttatacaaacttacagttccagggcaaatccactgtaaagcgccttacttctgcttgttatttgtcagatgggtcagtaccaggtggagctggatgggtgatgcttcagttagtgtcctctcctccatggagtttttatataaacttacagttccagggcaaatccactgtaaagcgccttacttctgcttgttatttgtcagatgggtcagtaccaggtggagctggatgggtgatgcttcagttagtgtcctccttttgcagcctcacagcccaaggagcgtcctcggtccgcagtcctcctggtggatgaaaccgctaccaccccaatatttgccaatagacgatcccagcagagtgtctcgctctccaaaagtgtctccatacagaacattactgggtaagtggagatatttaaagatagcacagttggcatctaggtgaccagagcataataatcacatcatatgacaaaaagcttttttttttttttaagaaataaatctataaggtcatgggttggtgcagacaaggacgatggggattatgtttctgatgcatgtcatgatggtcattctgtcgcaaggatctcctttaaatacccttagcaggctggttgctgtaggctttttgtatatcatcagccctacttttgaagaatctgagttctaaaaagatgattttttagatcaaaataagtaggaataggaaaaagggtgatttaattcagaattttgggttgcaaccacttacagatgtcatgcttttctgttgttcaagtaaacctggttgttttgtttcttcttacctctgttttacatctttgccttttaacacttaagtcagtttcatggaggtgagtgctgagccaattattactattaggttctcactcactcgtttgcactgagtttcttttctggtctcctggccaggccttggctgtcaagtggttagcagggggctgataatgatgttgctgactattttgggtaagatgcctgccttcccgtcgggtgaataagccatttcaaatgtaggactcagagtatctctttaacctatcttggagcaaaattcctaactaaaggatgcaaaagtctccttttgtttgtaattcctaacctctgtgctggctaatgttttctcctcctctaaaaagtttcaggtatttttgttttgttttgttttgttttgtctttgtattctcattatttccaaaagtgtacttttcaaaagttgtaacattactaaagtttgtatgcattgtaactttcaaaagttggtctttaaagtgttcttgctattgtgtctactcacacatcaattgggtgcctgctgtgctagctggtgagttgggattgagaaagtccaaagagaacatagttgattgtaagtgctagatctgtagttatctagagaacagaaaaaacagtgtattggttaggcaataagttttaaacagaaagtttcttatataatgtgtacatggtttgatggaagaaagttccccttgcttcttatcactttctttaaaaaggctcaaaaagtcctcagaatttgagtctccagtgatactaaatgctcccgactttgttaccaggccatgtgcatgttgctgtggccccgacataagcaatttgtcttcagtcactgtagtacttccagccagttgtcattctagagtcttcaggtactcatttaagaatgcaagccataggttatcagaatgtatttgacagtatgtatttttcttttgtccccagagttggcaatgatgagaacatgtcaaacacctggaaattcctgtctcattcaacagactcactaaataaaatcagcaaggtcaatgagtcaacagaatcacttactgatgagggtaagaggaagttatggcctttattttatgcctctgtagggactgtgtgtgtgtcattacctagaacataagtcttaatggagtgacagtacctgcctcttctgtatcccgtgaagattctctaaattgtcagtaaagtgtccagtgctttgtcatgactgcgtaatcagactcatccagcagctgtcaagtgaaggatgtcatttatttcgatgtgggcctactctttagtacaaatcttttccttcccttagacttttttacatgtacagttctagctcacagagcaattgtaagcctgctctcttaaatatgaaaaggtaccaggtcccttccaattcttaacttcgtgtagatagaagtcatgtcttaatcatgtttgatttatgtcatgtttattactgttaacctaagtctcgaatgtagagtctgtcactcctgaacaggatattgatttttttctggtactagaatatgatctctgtgaatatcccctgtattcatgtgtcttatgaaatcaactatcatcttgaggaaagtccaacataggcttattttacaggtcacaaacctgattctgatattgattttttgatatattgaggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatggtgagagtcttcattttgctctgattatatttgatttccattgtccagcatttttaagcagtaatttgttggactatgaaaaatcagttttttagtatgtggcttcttgaaaagatttcctttaaaaactttaaggtacagagacgtggtcctgttggtatcctatctcctttttgccccactcttctgttttcagttctactgaacattgtacttatatgtgagtacttatttatacagcagtcctagaaagagatatctcagtttttttccttacctacactaaaaactagactaaacacaagtcatttctgagaactgggtatacagtcagttacgacaggtgctgaatccagtgaagacctctttggaagtcataatttaagactgatggaatccggggtacctattatcagaaaataggacacgtgaaaaatagaggaataagacgaaaacacttgaccaggctcagcggctcatacctgtaatcccagcactctgggaggctgaggcgggtggatcactcgagcccagagttcaagactagcctgggaacatagtgaaaccccatttctataaaaaatacaaaaatcagccaggcgtgatggcatgtacctgcagccccagctgctcgagaggctaaagcagaaagatcgcttgagcccaggaggttgaggctgcaatgagccatgacttcagcctgcacttcagcctgggtgacagagccagaacctgtcttaaaaaaaaaacaaaaaaacaaaaaaacgagaacacttttaggggaaagatagctgttgacccaattttaaggttcaaattgggctctaaactagctttgggactgcagcagatgatctttgagggcgaatgcttataaaagagtgttcctgacacttgatctttttcctccttttagagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcaggtgagaatgggaaggatctcaggttcttacatacactgggaaaaagggaagtcatggggttccacagccatgcattcacatcttctttctaccatttattatctgtgtaagctcagggaacttatttaatttctctggagccttgatttccttttctgtaaaatgcagacagtagggtttctctcctaatgttattttggaaagttaaagggagggtatatataaagtacctaatgcatatgatagatgctcagtaaaacttagtttttcttcctcagagtctgtgccatcatcagaaacagtatagtttaagaaatcaattaatatggccaggcacagtggctcatgcctgtaatcccagcactttgggagatgaggagggcggatcacttgaggtcaggagttcaagaccagcctggccaacatgataaaaccctgtctctactaaaaatacaaaaattagccaggcgtggtggcatatgggagactgagatataagaatcgcttgaacctgggaggcagaagttgcagtgagccgagctcatgccactgcactccagcctgggagacagagtgatactctgtctcaaaaaaaaaaaaattgaaaattatttaaatatttggggctgggcacactggctcacacctgtaatcccaacagttcgggaggctgaggcggatggattgcttgaagccaggtgttcaagactagcctggcaacgtaccaagagctgtctctacaaaaaaaagtgaaaaaatgagccaggtgtggtagtgcacacttgtggtcccaaccactcaggagcccgaggtgggaggatcacttgagcctaggagttcaaagttgcagcgagccatggtgatgctcgtgccactgtactccagcctgggcgagagagtgagagaccccagctcaacatttaaaaacaaactctgtgtgtgtgtgtgtgtgtgtgtgtgtgtgttggaaatcttcaactttcccctctgcctcaaatcagaaggatctcatgtgtctaaaaaccagctgaagcacagaaagttgaataagtgactatctgtaaaatgcttaataaaatatgtattgttgatactttcatcaaggtgtggtatggttttagtcatactccaaaaaattcagctaaaattactttggtacttgtagatgtgattgtcatagacagattttaatgtttctttttaaaatattcttcttgaaaaacacattgccagtataacctttacaggcagaggggtatataacatgtacatctgactaggtatttccccaaagatgcagattccccaaagatgcaaattccccaaagattttgggcaaatatctgctgctgtgtagaagcagaggcttaattgttggaacatttgtctgagaattgtaaattttgtctttcctttgtgttcttgagcccatacccctcacttcattaatttattagcacattcactcattcatttttcaggtatttactgagcatctattaaatgccaggtagaactacaaagggggatatggcttaggcctctgcctcagggaactcctaggagtaaaagtaagcatgttatgaaataaatgcaaatgcagtgcggtaaatgaacacagatagctgcaacagatagagctcaaaattaagacctacaagtgatgacttttcctcctgaaacatccccttgggcatttccatttctctctctctgcccctcctctctggtttcatctaacttttactttctctaacttagtacttcatcaaactttgacttgtattaccatttgtacctccttgtacttgtgtacaacccctagtaagatctttggtgctagaattcacagtttaactcatagtatccgtttgctcgttctgtgtgccagtggtaggatcaacctttggggcatttgctttgtcatatgagcagataacttaccgtccctctgtctcagctcctccattggtaaatggtgaagtgaaaatctaccctgatccttctttccagttttttggtaaggatcaatttgtgttgcctctggaggtttgtagtacatggaaatcaataattagcatgtattttatgaactgcatacagaaattcattgatttagtgcaaagtgaacatacctttagaggaatcattgagattgcacacatttgggaatgatttaagggcctcatagaattattaggactgctggcctgaagtaagtagtacaaacagatacctaggtatgatggctgtttgtcatgtctgtctaacttatcaaggtcagatatttaagattgtctcatgaaaaactcctagtgaatctcattgttttattactctgtttatgacaaatagaagttagaatacattttgcattttccgtgtgcacagtacataaagtttctttaattttttgttgtttttcaaatctgtataacagctttattgagatttaatccatatgccatatagtctacccatttaaagttgaacctcttgagtaactgccagactgctttccaaagctgctgcaccatttcattcttttgggagaatttatgaggaagcgctcttgacttttacaactagactggaaacattttacaaaatggtattatgagtttggcgccccatggcataacttctgttctcttttctctgcagttttcaggtgagaatgcagaacgtttaaagaagacatatggcaagttttgtgggcaacataaccagtctgtaaactacttcaaagacctttatgccaaggataagcgttttcaagcctttgtaaaggtattgataagaaacatgaaaatccccgttattgttgagagccatgtgtccctgtcggctttcactagagcctttttcatgtgattcctcacagtctgtttactcccttgcagaagaagatgagcagttcagttgttagaaggcttggaattccagagtgcatattgcttgtaactcagcggattaccaagtacccagttttattccaaagaatattgcagtgtaccaaaggtaagtctcctttctaactcggtcttgtatggtcatggactgtttcctctgtggccagtagtactggaagccccatggaagtgctatttcatgctttagtatgtctaaaagagaccttgtgttttatcttgaattttgttgaatgaaaatttggactgttatgttaccagacttaggatagatgatagcaagaaggaaagggaacacattgattccatccagagttcaatgacctgaacagtattctgttatcactaggctgggagataatttccactagttattcccagaagtgctagaattgctgctgtttttcacttaatcagtaattactggtttctctctcttggctaattctgttcctaggtagttattttaaagattacaaggcagtacattaaaaattaagtaaaacaaataaaaaaaaaaaaacttggttgctcttcctgctattactgtccctcctagaagtctttagttccttttatttcagagcacaacatatgattgcatattatttatatcattgaaaacttctgactttttttagaatcaaacttatgacagcaagaaggataggcacatgatctctgacgtgttggcttccctctgatagcatagtcacaaagggaaaagatgatatggagtgagaagtcaggattcccttgcttctgcccttgtccaaaaagagccataaaaaacagaattattctttccttccaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaaggtaaggcttggctcttttgtcttaagtatgtgcccaggtaaaacaggcaaaaatccaagtgcttttgttggaaattcactaccagatttttttcccagagagcccatctctaaacactacccaggagcaacaagcatttagttcttcgtaatcttatatcaaaaatggtttgtgatggcctgcaaaatcatacaaaatagaggaagaagacaaagaaatgatgcagtcagggaaaatggaaaataaggttttaaaaaaacaaagcaaagcgtaagattggtgcacatatgcaagctgtcaaggaaggtgtattcccctataagagatggacagccaggttggaattgggatctgtggcaaaactcacaaggagggagacacagtcagcgagtttcacagaatctgtgagttcaaaacacatcacttgttcacaagagatgttagaggagtttgcagctccagacacctaatagaaagttaagtttaacccacatcaattagatttttttattgttataatttatgatattcgtatatctttaaagcaaaataaatcataaaggatgcccattttccatttggttttaatttttacatttctaatagtcagccgtatcaagttaaagaagctatgaggcttgttttttaatttatgtgtacatttgattttttttgtttgttttcatcaaacctatactccatgggcctatatgttacaccaatagccttgaattatacccaccccgtcgccctggcctcagtgagctgaggacattgaagcagggtaggccagtactgtcagcctcactggcatagaaagaaggtggaggaaatgggtgctgctttcatttctgaggtataagtgatgatgtagataactgctataggaaatgcccacgcatagaacaaatggtaaagaagttccaggcagtcagctggtttcaacaatgaataaagcaggacaccctgcttagaagttgaaatcaaaatgaagagccttggaaagagatacctgctctacagtgtggtgagtgctggaatggaggagaaagcaagaggaatagcaatagagtcaagtcttgaaggatgacggcacataaggagaaagtgttccccacactaaggaagagaaagtggaagcacagagttgaaagggtgtggcacatccagggaagagtggacacccgggactctcacgtgagagagcagagtgaatgacaggggagtgacgggaaaccagcccaaagaaacgggaggggccaggttgtaatgaggtgcattctccagactgaggagttaacagttgatactattgatgagggaagggggcaaagaatgggttcaaaaacgagaacggcaagcaggagagggatacatgaggtggtttttcagtatgacaactaggggcagtttagagtgcagctggagtgaagagagactggtgacagataagagactgtgcagtgctttggggaagagctcatctgggcctgcattgtagcagaaggcataaaaaagaagggcagaaaagattcagagaaagaaatctcctttcccaccaccagctggctgtgtatttcatggttctgtgataaacttaaactaaggctccttccctccagtcttaatattccatgatgttctgagagccctagctctctttgagacttttacgctgtctggcagttcagaaatacctgccccttcttgtaaaggcctgaatttcctagagctgctgttgcctggatccagcgctttattctttcctttacatagcaatttatttattcccaaaataaaaactagtagattccagctgttgcaataaagttgtggtcaagccagcggcagaacgataggttttctggcctagaatgcctcctgtagagataggagttggtgtttagtcattttcacccccaagtgaattcatgccaagaacagccagtactatgttgggtactctttgaaaggggtgggattgtttttctctgatccactgacactgatcatataaacttcaagattcaatgaagttaaaatgtgtgtctctgcttttttggggggagggggagggtgcaggcacctgaattatttaaaagtaaactttaaaaaaaaaactttttcataactgatggcagtacacagaaaattgcagtagtttagcctaaaaaaattagacctccctaggaatcagatgtccttgcttctgttttcttcatagctttgcagtgaattccacagaaaggggatttcagttgcggcagaggtagaagaaaaggtggggcatggactgcataaatcagttccatcctttcccagggaattgtggacttcactttccacagtgaagatgttacataggggccaacctgctagctcgagatagactcaactccagagacatcaaaccatcctcaggagactagtggaaaatgttactacctactcctagaggattagtcagagctagagtttaagctgactattgcatatggagctgaggaaagagccctatattcacatgtacctgtaagactggaaggcgcctgcctgtgtggccactctttgttcttttgagggcatggaagacgtcttttcattagacttagatatttctatacttcatctttgggcagcattcctgtctcctgccccacacctttcccattactgtaattagaagtcgaaaaatattgcaatctgagtattttttggagtatcctgctatgtgttgctgtttaacatctgtacaagtccagcttttcagctttattcttaaaagtattttattcttaaaatcttgtcttatgggatatatctttctaggactgagtacttaaacttttccaaaacaaggctttggtgataaatcccattttaaaatgctgctaaaaatctggtgaccagatctgaatcctggagaactgtaaaactgttgctttggaggagtgtgatctcagatcatagtttgcccgtataggggtgtatgtgttgctgaaacacccttcaataaaaaaccttctgactgtgggtaactattaagtagtcatcgttttatcttcccttctcccatttccattttccagaggttcaagcagttcttctcactgacattttagttttccttcaagaaaaagaccagaagtacatctttgcatcattggtaagctgaattgttatttttgtaatagtattataagcagctagtttagttatggaatgtaagcactatgttattgctctcccccgccctcttaaaattaaatggctcaggacaaattcctctgagtaatttcccacatgccctcagaattttctggcatcccctcttcccaaaaaattattattctgtttcatcacagtcttcttttagtgtcttggacatctgactatttgatctatgaagaaacctggtcactggagcatttctcacatttgagcccataaatggtgctcatgtataatattgctgactggattctttggggaacctggaaagattcatcgtgtggaaaacatgactggaacctttagagccataaattactatttcccttttgaaatctttttttgttaaaatctgaatgaaataaggagatacttctctttatcctaaagtagcccttgtttttcaaactatgtgcttttttaacagcatctggtcttaccttagattgaagctgtccttcagagttagaatattgtatatgtatcttttatttgccctcttccctttttccaggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgtaagttaaccaccaggccccacccttcccagccctcctgatgtctctgtgtgatttcataacaggctggactgtgaccagagtaattgacatcttaggaattttttgttctgtcttgtttgggttgtattaggaacagagatgaagatgaaggaattcctagtgagaatgaggaagaaaagaaaatgttggacaccagagcccgagaattaaaaggtgaggcattgcgagtggtctgagccccttgtctggaatgtctgcagttgcagaagactgctggtggattttagaggtacgggtttgccctcagttctaaagctgccccagcaggcacttgaaagcagcaaaatgaatagctgttaacaaaagagaaaccaaggccaggctgacatgggtcctcgtaaagaatggctgcaaggatgtttccagtactggatcaagagaatattgattctcttgactcaggatccgtgttctcaaacctcatgacattctctgtactttgtcacaggcgaatttgccaaaatttgtagtcacatctaagattaaaacaaggagagaaaggaatttggggaaaagaattctccagttaatctgatttaatcctcccccagtccctagcgttatcacttatccgcatgtttacaaatgagttgtgaggtgaagttttgggagcagggtatgtatcaatctatgtttgacccttatttattgagtgctgactgttttgtgtagtcttgtcagtatccctgcaacacaggcattctaatccccattgtgccgatgagacagtcgaggcccacagaggacaagctacccagggttaacgtgtgtagttagtgggtaagccagaattctattccctgtcttagcaaagcctggtactcacgtatgtagttagtggctaagccagaattctattccctgtcttagcaaagcctgttgctcttttctctttgccagtggcttatcgaatgtttcaaagtaaagactatgctttggatagaaataaggcttagagttaaataaatgtaagcacctaaggagtttggttaggccttaaagccatacagatgatagcattctgtctcactgagggggaaattaaaaatatggacagctttagaccagagccagagttatagcaaatttattggcccatgattaggatgacaaggataaaaatcttccttctttaaattttgtcaagtacctggctaggcatactgctaggtacaacagatgcaaagattccttaaaaagagcccttgcccttgagaagctcacaccctagcaggggagacatacatcaatgatgggccacacagtgatttattagaccacaggcacaattagcatgtgtgggatctgctcatcctgcctctagtaagtctcacagagaagctggtgcatgagctacatctgaaaaaaattatctcagcacacaagagtggttatgtgcaaaggtgaaaaaggacttgacatgtctgccaaggaatgacaggttcggtgtgtctggagggtcagggctaagggatgggatcttaagctggaaatgcaccaggtattaaaaggcaacaagggactcatgtaattaaaaaaaaaaatttttttttttaacatgttgaagatagttaggagagttgcttgagggaatgggaagccactggaagtacaaagaccatttggaagactgttaggataggttaagtgagaatgagctggagaaggaagagatgtaagaaataaggtcattaaaatctgatcagttggccaggctcggtggctcatgcctgtaatcccagcactttgggaggccacggcgggcggatcacaaggtcaggagttcgagaccagcctgaccaacatggtgaaaccccatctctactaaaaatacaaaaattagctgggcgtggtggcacgtgcctgtaatcccagctacttaggaggctgaggcaggagaatcgcttgaacccgggaggcagagggaggtagaggtttcagtgagccgaggtagcaccactgcacttcacttcagcctgggtggctgaacaagactctgtctcaaaaaaaaagagtctggtcggttggtggtaggacagagtaaggagacagagtctctcacaggtttccaaatcaggtgacctggaagatgaagagttgttgactgagaaagagattccacactaaagggaggaggtagtgggctggagaaaagattggtttctcacgtgctgagaacaaggcatctcagtagaggtggccacgtgggcgccatggtctgctgctaagaaaggggagggtttttgatggtttaatgaattatcagcatatagaaggtcattgaagccatggggatgaatgagatcctcaagaggaaagtgggtaaggtaaagaagacagctcaggccaggtgcggtggctcacacctgtaatcccagcactttgggaggccaaggcgggcagatcacccaaggtctggagttcgagaccagcctggccaacatggtgaaacaccatctctactaaaaatacaaaattagccaggcgtggtggcacatgcctgtaatcccagctccttaggaggctgaggcaggagaatcgcttaatcacttgaacccaggaggtggaggttacggtgagccaagagtgcaccattgcactccagtctgggcaataggagcgaaactttccgtctcaaaaaacaaaaacaaaaacaaaaaaaaaagaagacagctcaggatggagctgagacaggagcccagataagagattccattgcagatggcagatctgtaaagtgtcctgagaaagaatggtaggaagagaactggtgtcctaaaagctaaagaaggaaacatgttttaaaggaagaagtaatcatcaatgctggaaaaaacaacctaaaagacctcattggattcagtcatgaagttgagctgggaaagcagttgcagagtggacagaagctagagagtagtgggctgagaagtaaacaggggacacgggagtggaagcaaagtgcagacttgttatgtcacaatttccatggtttgccagaaagatccagaatggttttccagatagaaatcacagaacagaaacaatattgctgtcttgatgaaaaagaaaaggcagtgtgggtggggagggtgtcctgtcttgtcactttccataaattaccacaaggtggtgctcgtgtcttagtcattctcgtaattactaaacaccaatcaaatcacagatcattttctccttcctgcagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgagggtaattaacattcagcattgccccctcttcatctactcccagagtggtttacacactaatattacctgccagtttttacttttttactttaaagcacaaatgcagaaaattacccaaaacaaatatttcactatagtaaattatcaggtgaatatccttttaaccactactcacatcaagaacttaaaggggccctgaagccccttcctccacatgctctgtccccatcacacctccctccctccaaaaggagcagttattctgactgttttttaattagtcacttatgcttttttttttttttttttttttttggcaggatcttgctgctctgtttcccaggctggagtgcagtggtgcaacctcggctcactgcaacctccccctcctgggttcaagtgattctcttgtctcagccacccaagtagcttgggactacagatgtgcaccaccacacccagctaatttttgtatttttcacagatacagggtttcaccatgttggccaagctggtctcaaactcctgacctcaagttatccacccaccttggcctctcaaagggctgatattataggcgtgagccactgcacccggccattaatcacttacttatatatctttatggcttaagtgcctactcctagacattatagtttaatttgcttatgttttttgatatgcatcttaaaattcttaatttacagttccccccaccatctttttttttccatataatttatctttgaacaatctgagctttttgacttagagagtttcccacagtttggattttattcatacagtcctgttgtctgtttccttcagatttgcagctggattcagaggcgtaattaattactcagacttgatctctttggtaaattgtgcccttatagtgttgtgttctttcattgaggaggcataaatatctagttgtctctttttttgtgacatataagaaaagataaaaggataaattcttgattatttttcccctccatttatttaccagtttttaagaccatgaacatcttctgaaagtgacccatagtttttattatggactcatgaattgaaacatgtttgatggggccaggcacggtggctcatttctataatcccagcattttgggaggccgaggcaagtggatcacctgagggtcaggagttcaagaccagcgtggcccacatggtgcaaccctatccctactaaaaatacaaaaattagccaggtgtggtgacatgcggctgtagtcccagctcctcaggaggctgaggcaggagaatcgcttgaacccaggaagcagaggttgtagtgagctgagatcgtatcactgccctccagattgggcaacagagcgagactatctcaaaaaaaaaaaaaaaaaacgtttgatggatttcaagtcattgcaattcctaaccttattaaaagctcagaatgttccttttgtgaacacctctttctttggcttctagtcctgtggacgtgaccatagtagtcttttagagctactggtatagtaagttgttccaggctcatcttaattgttttctgccccagtcctggtatcagccatttctccaagagttctggattctttaagtgggaaattatattttcagaccacagtctgggtactgggagtggtcattgctgctaggttgattgttactaggttgggccttttcagtggacagagcttggggaaaaacatatatataacattatatatatattatataacataatataacattatatgttttacatcatatataatttaaatacctattgaacataaaatgtgtatatgaaaatttatatttacactttcgaattcacattgatattcttaaactgtggactacagtgtttgtttttttaactaaacctatttagtattacatctctatttcctttctttcacattgcaaatccttgttcttaaggatacatcatagaattcgaatattatatatttactttctggctttatccaacctattactcataactgttagtaatactaatagtattactaattactattgctaatactgttagtaatactaatagtattactattactattaactaatactaatttactaattactattgctaatactgttagtaatactaatagtattactaacactattttgataataatatattctaatagtaatgctgctaccactacatatgacttttacttgctgtccgcattctcccgtttttgaaaaaatagttgtgctgtgtctacgctgtcagtttataactgttacatgccatatgctctccttgtaagccttgaccatagtctttgttctgtaagtgaacatacttcatgcttaccagaagttcttaggtcagtcaccctctagtcatgtggatatgtgaagctgattctctagcatgtgcctcaggaaaggttcatgagagtaatagtccatgagctctttcatgctggtaataatttatgccctttatacttgaaagcctattttgctgaatataaaattattggcttgttcatattttcttccccaaggtattaattactctcaagtatgttgttttatttttttttctggcataaagtattgccatcagagactgataataatttgattttccccatgtaagtaacatgctctttgcctagatgcccaaaggatttttttctaagtacaagtagttttacaagaatattccttggtatttgttaccctaggttgatgctgtcaggttcacagtgttctgttttcatatgtggtttcaaatttttcagatttcaggaagttatttttgaattataatttgtactattttccctgttccctttgctttggtcttcttcaaggtctccatttatccttatgttggaccttctttgtctatcttcagtgttggtcactttcttttaatacttttgatctcttcatctttttaatgtttaaatggtcttcctttcaccttcttttttattaagccattttctgctgggttaatttgctcttatattctagtttagttttgatttctataatgattgtttttcttttgtttgtagctttgctatttcatttctgtgttttctaattctgacctaagttagttctttcatgtcttttgtcattttcttttctttcttttctttttttttttttttttttttgagacagagttttgctcctgttgcccaggctgcagtgcaatggtgcgatcttggctcagcctcagcctcctgagtagctgggtttatgggcatgcaccaccatgcccggctaattttttgtatttttagtaaagacggggtttctccatattggtcttgaactcctgacctcaggtgatctgcccgcctcggcctcccgaagtgctgggattacaggcatgagccactgcacccagctgtcttttgtcattttcttaatgtgttttggtcacctattttatggacatgtctttccgatgtgcttttattatctgtagagaagttagaccctgtgttctccccaccatcactccctgttcttaactttatatgggatttgacttcaatattttctattgctcatttttatgtgaaattagtgtcttaagtttacaggttcagatagcttttctcacaccataggactcgtctatcatttttgtgtagtttttcttttttaatatggcttgtcttatcagatttcctgctattggttccctcccttattccacctggcccttctttttctttatctttttatttttctcctgtttaacttttattccattttctccactttcttctttctgtgagccataccctagaaaagaaccctagtgggccagagttgagatgcaaattcttagactactctagccccttgaactcactccatattggcaaagccagaaatcctgactgttttacttgctgttctcaaatcaatccatcttactttccagggaatatcttctgtctgctttggatatgattccagaagccatgtcacttctagtaaattactctgccttccctgtacactttcaaatttcctaggcctcttgcatataaagtggaaggtctcatctctaaatttctagtagaatccaactaaaacacataccctgagctgagacccttctctgagcaaaggaactcacccagtcactctttggaactttcaagtcgtgctctttgtacgtatcatatatactatgaacttgttttcccctcattgaaagataagatgtcagctttgcatgtttcctttattccagtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggtaaatgatgtgaagtcatgagcttttataggcaatccttgactatctcacacaactcaaaatgacttgtactttagtagctacatcaccgctcccaatcagcaaatttcttagtgagatttcaagacactcaagagcttgtcagtcagactcatattcattttgagtaacaaaaaagattttcctaagatctcagctaaaagagtaataatacatgttcctgcttccatttcttctgcatccgtaaaattattaataatcacttagctgccaccaagcagctccccctttttgggggcatcagtaggtttcagacatactacatccccaagatgcctatatgatattctttccttggctaatctgtttcacaactttaaaaaaaaaaacaaccctattttttgtttaggaggcgagaaggaagagggagatgatggccaagatcttaggagaacggaatcagatagtggcctaaaaaaggtatttctctttaaaatacaccatgaacctccttggcactttcctctgaattcataacctttgaaattatttcactttgatgttgttttcgatgcctgaattgctgcttttaataaaattattttcagggaaaatcacatttttaaaacaaatagtacagttaagagctccacattattggctgtttggcctcactggcttagggcagtgtgtttacattcataactctaccatggtcctggcaggaccagtttcattaggtttgtttcaggtgctccaaaccgacctgacctccttacaaggtatcagtgataaatagttcaacctcttaaaccttcactaccttagtgagaggctgtggtagaaaatggaaagctacagcctaacacagaaacacactgaatgtcatttttgcatcaagatcttcatttttttatatgtatgttttttgttttatagggtggaaatgctaacctggtatttatgcttaaaagaaacagtgaggtaaggacattatgaactatttaagaaaatatgtgtttgttgtcattgtcaagttaggaatattgttttttccttttttttttttctttttgctgttacaaagaggctaactgctggctatcatctgtatgtgtaaacaatacagttgtcagtttccttggcctttcccctgtctttggtcctaggggcaccatcttggaattttgccagttagagaattgcctgctaagatggcctttgattcgtttctttgattctctgtccttaaggaagcctcttgctgtttttttgtttgtttgtttgtttgtttgtttgtttgagatggggtctcactctatcgcccagctcgctgcaacctctacctcccaggctcaggcaatcctccagagtagctgggactacaggcatgcctgccaccatgcccggctaacttttgtattttttgtagagacagggctttgccatgttgtccaggctggtcataaactcctggacacaggcagtccacctgccttagcctcccaaggtgctgggatgacagacataagccatcttatccagcgcttcttgcttttaatgagctttctctaaatagggcctgtgaaatccctgtggtggtttcctttggtctaagcacactgagtagaattcatagcagccttttctctatcacaagcctgatactaagagccacaggtctggaacatgggcatttaacttgtgggtaatttgacacagtaatttcttatccttcaagtactcaagttatatcatcatcttttttttttttttttttttttctggggatggatcttgctctgttgtccaggctggagtacggtggtgcgatctcagctcactgcaacctccatctcctggattcaagcgattcccctgcctcagcctcccgagtagctggaattataggcatacgccactacacctgactaattttttgtatttttagtagagacgagttttcatcatgttgtccgggctgatcttgaactcctgacctcaggcaatctgcccacctgggcctccaaaagtgctgggattacaggcatgagccaccgcgcccagccatatcttcttctttgagtattgctttagacttaatatgtgtttcatctgtgaagcagtcatggtgtccttctggaaggatgcccatcccccatcccacccccaggactccttgttgtgacataatcttcagattactgccatctctaaaattaattctgagtatctgactttgtaagcagaatagaagccgatacatgataattgctttttagagtatagttctcaaggatgttgactgtgtttcttctttttcttgtccttgcttttaacgttaagttaaaagtctccaaggaactttatttttgaaattttaaggggaatctttcctttttccccctaaaatacagaaggatattgttttatatttgttgccacaaaagtctaaatacagtggagtcctgaaggaatccttcagtgtgcttatctttaaatgacaaacctgagcttatggaagctacttgctctctggatctgctgcttgaaattagctcacagcagcttccacgtcccaggttcaagcaattctcctgcctcggcctccagagtagctgggactacaggcccgcactaccatacctggctaatttttttgtattttagtagagatggggtttcaccatgttgcccaggctggtctcgaactcctgacctcaggtgatctgcctacctcagcctcccaaagtgctggggttacaggcgtgagtcactgctcctggccttgatttttctttatggcgacttttccctctatatttagttacaagaatcagggtaagaaatagtacaagacctgtttgtttttcagacattccagtatggattagacactataaatgcttagctagagtcggcaggttcttctgttacttctgtttattaagaataaaataagaggggccgggctcggtggctcacgcctgtaatcccaacactttgggaggccgaggtgggtggatcacttgaggtcaggagttcaagaccagcctggctaacatggtgaaaccctgtctctactaaaaatattagccaggcatggtggtggacgcctgtaatcccagctactcaggaggctgaggcaggagaattgcttgaacccaggaggtggaggttgcagtgggccaagatcgcaccactgcactccagcctggacaagagtgaaactccgtatccatctcaaaaaaaaaagaataaggggtaaaaaattttctcagaagagctaagcctggtaattaagatttttgtgttttgtttttaaatgtattataaaaggaatacatgttcatggtagataagtaacataagttacttgataataaacataatcccaccactgaaaaatagctaccgttaaatgtttggtgttttcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaagtttggtgtttatatttccagccttctacataacatatccgagttgtatatgtgtgaatagtacaaaaatagttttacataattcatagcaatacttcgtagagcttcatatcttgctttttttcctcttaatatgcattaaaaacatttccccaaggcatgtttttacaaagcatgctgttgcacagcttcatcttattgtgtaccataatttacttagtctttgtgatagttaaccgtttttctacgttttgcttttaaagcagtgagccaagaaaatctttgtacatacattgttttttcacagctctctgattatttcccgagtatgccaaaatgcttttgaaaggaggttttgcagtgcttggtactacccattagacatacaaatgctcattttcatcttttaccaacattgagtattatcattcttattaagtttttgttcgtttgataagtttgggtcatttattttattttgcatttatttgatttcaaataaggttgagtaatttttaatatgttatgctattggccatttatatttctaatgtaaattgctggtttgtgttcctggcctatttttctactagggtattttttttgtcataatgttctatgagagccttttttaaatgaaagatttttccatttgaatttctattagttctttgccttttaattttaattttacatttttacatagaaatttttgaaaaaaatcttctggtttcttccattacttctgtgtttgcaaagccttccctgtttcaagattagaaaacagttctagttccttccagctctttttttttctttttgaaataggatctcgctgtcttgccctggctggacataaatatggtttattttttgcctttaacattttcagatatttgaacctttttttgtgtgtgagctaagatctcaactcaatttttttcagaaatttagccaattttctcagaacaattaattgaatattctttccattaatttgaaatgctatttacatgctaaattgttatgagaagtttctggaatttctgttctgttgcgttgatatgtatgctgtttttattctagtcattttaagtaatggaagctttctattacattttaacttgtgctgatgttcctcctatacataggtcactgtggtcttcgtttgtttttcttggctgctggtgctcacttagtttctttggtgctttcaatttgaaaatatttcataaagatataagcatttagttgtatcttaaaggagccatcttatcaggtaaacattagtgtgatggattctgagattcataaagccctgaaacgaatgtttccattttgttcctttggcagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaagtatgattataagtttctatattccgtatctctgtggtatttgaatagagtggccttcctaatacagcttctgtttcggacttcccaggaacatcctcaaattctgctcacttcctttcttgaagatctaacctgtctcgttcctactttctcccacttccaacacacacacacacaacccacccacccacacagacacacacacacacaaccacccccccccccaccccaggtaataccactgactgcaaacagcatgcaaccagattgacaaaaacccgtgagttcctgcacctttgaggttcttgtatgataaacagctgcaattatcctggagcatttttatgagacgggcttgaaaaatgaggggagagttctagtccgtcatagtgcctggtgccccctgctgtggggtcgggagggatccagaagctcgctgtcgtcctggccagagttgcagggctcccctctgtgtgcctcccagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaaacaaacaaacaaacaaaaaaaaaaaacagtttttaagaatctttgtagctggacacaatggctcacacctataaatcccagcaccttgggaggccgaggcaggtggatctcttgaggccaggagtttgagaccagcctggtcaacatggcgaaacggcgtctctactaaaaatacagaaattagctgggtgtggtggcaggcgcctataatcccagctgcttgggagtctgaggcatgagaatcgcttgaaccggggaggtggggattgcagcgagccgagatctcgccactgcactccagcctgagcaactccgtctcaaaaaaacacacacagaaaaacaaaaagaatctttgttttaccccgaaagagaggcagaggcagaaagtcttcttctgctttttgcatctctaagaggctgaaaaagagaatggaagtgctggggcattttggccagggcagtaatggatatttggagttggcacttccctcagctagaggagtctcagtgtgtctgagaaaatggcagtcagccatccaggattttaggagcaacgccactgctctgtgccacatcagaaatcaggcatggccccaacctgaaggaacttgtagcttaatggggaagcacaccaagaataaaagagcctccagaacatgtggtgcctgtggtcctgagacagcaggaaatggctctcaggccagagttgctggaagaacccatgtggcaggatcggtgggaggcagttacagagggaaacgcccatcccagcaactaggggaggccgccactcctctcgtggatggatgatattcttgcttggggatgttgagacagctgcactctgcatagttcctgatttgcctctctactgctgatgaaaaacctctctttctctatagctgctgcttatattggaaggcttttggttattcagcacactcactcctgagcttatttcagtgatattccttggttatttcgaaacatggatgcttgtggcagatggagagcctgggtgtacacagatctgcctgtgttttgaaatgcataccatgttgccgtttgtttgattgattgatcttggaccacgaaagaaaattatactgacagcttccagggtagggggcagttgtagctttctgcagatgttgccaaatatattgggggtggggagcagcaaatgccatgtgttgctttttatgacataaggagggattccacccccatcccaataaaatcggtgctttgacaaaggagggttcccaggcagctaagagaacccagagtagatgatcctctttatctctggtttaacctgtgactaggattcttggtgtaagctcggcttttccacttatcctctaaccggaacaggcttctataatctctttgccttaaaataattatctgcatccctgtgtagagcaatcttaagcagctctccttgtttcttcagggaatgggaattcttttctaagtcgccccatcaaaggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctccttgcctttctgggcctagagtagtcattggtaacagctagcatttggtgatttaaccctcaaatgactgtatgaagttggcactgctaaccccaagagaagtgaggaaactgaggctcacagaggctaactaatgtgccagcggccacagagcctgcggctgaattccactaaatgcctccctgttcatgtaccactttttcccctgaatccttctctttaggattgatctctcctttctgtgtgggaggttaaagaaaaagtacattttcctggcctcttcataaattctagtgattatttaaaagttaaagggagcattaggcagtgaaggatatcacttaagaaccttattaaccaaatttgttcagaaaccccggtgcgcagaagagttaattgcccataagccccagtcgcctgtttgcattacagaagactttgggatggggaggaagttcaatgaaaggagcagtttttctgaatttttttcattcttggttttcacatttccagatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattctgtcatcagatccagaagaaatatcctggttttccagcatgtttacccacatgttttggccatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctggttggtgctgtgacttattcctattcctgattcctgtagaagggatactccccatccacccccatagctcttgaggagacgccttatgcaccgagcagctgctggggacgcatttcactctctcggagtgggacccaaacccagagagtgactgatcagccctaaagtcaaacaaacagtttatgccaagagccaaaacttcctatttccagataaatcaatacagtgaacaggaactttgctatagagcctgcgacttcccttaatgttagtttctctctcttcgctaacattctccaccccgtcccacccccaaactagagcaactgccagaaactaattcaagaagaaagatcctctctgcttgtagctcccggctgattcactgggtctgatcccggaatgtcggggctcccctggagacacacagggctccagctgtcactggctccaccagcacagcctgtgccttccatttttagattagattactagcttcctactcttccaggtctgcgctttctggacctataggaagacccttaagtccagctgggccttggagaactgtgccgctcgcagtaatgcagagaacctgggcaaagctgcctggagtccccgctctgccacttcccagctccccgcccctccctgacagtcaccaaaaagaaagtcctggccaggcgtggtggctcacgcctataatcccagcactttgggaggccgaggtggtcgggtcacttgagctcaggggttcaagaccagcctggccaacatggtgaagccccgcctctagtaaaaatacaaaaattagctgggcgtggtgaaaccccatatctatctactaaaaatacaaaaattagccaggcgtggtggcacatacctgtaatcccagctactcgggaggttgagggaggagaattgcttgaacccgggaggcggaggttgcagtgagccgagatcgtgccgctgcactccagcctggcaacagagcgagactctgtctcaaaaaataaaatcctgcccagctgccaagtgtctttcctttcaccacgaacttggaagtgcacgggtttctttgcagagtcttgtagccctggtgatagctgcctccccataagccagtaaaacactggtcttttttctctcgctcactgctcttggctgtcactgctgccctggcggtctcctcccccacagcagccatcctggcctgggtccgcggtggccctcatccacccagacaccctcagcagggcaagaggagtggttcccatggcctccctcctccgctctccaccgcaactggttctgagccagggacaggctctgtctgggaggcaagaagagcgagaagattccattctcttccagaacagcagagacacaaagcgcagagggccccaagaacactagccagccattcagtaggggcttaagtctctgcccactcctaacggatgctgctgtgcccagagcctctgccacagcacagacttgaccgccaagtggctcctacgaaagtggccattttccgtttgaaggtccctcatccccagggaaagcccgtggcctaggggcggccacctgtgaactagcaggagatgctgtctgcagccacagccctgccggaaaagaagtgggagtcgctgatgctgcaagacagagacctaaaccgaagtgtggggaggacactaggaggccccaaaaaccaaaaagccagggaggagcttgggaggagaggaggcatgcagcgtgcaagccttgcgatttccttggaagcagccacagaagcagagggcgggcgagctgagctgcagattgttagacctcagacctggaactccctgaactccctgcctgggggtgacaaccccctcatccagcctctgcacagcaagaagtgcctccccaagccccccacctccccgtccctgccacagttcctgttctttggagtcttcggagactcctttgtccttaaaatttgactctgtttcttcaggggcacagtggcagatcatccagagggtcctggagcagtccagttccagcgccgtcctgccacccctgtgggtgtccccccgggccagagaggagtgacaagtgggaggaagtggcatgtgccctaaatggggaggatgtgggtcccagagccccagcagcctaccccctccaccccagtttggggccctcccttgctgcctgcccgcccctgccccttccgccatccccagctgcctttggtatccaagtgacagcctgggcccttcccacccccgctaaggcctcctcctttcatatggtaatggcttgctctacacagccctagtcccacagatgtgtgggctacccctctctccccatgcctttgggaaactttcttcttcctgggaaacagaatctggaccctgccgaggacaaggaccccggaggcctcagtgggagagttgtggggagggggtcataacagggcttcttggaatggaccagctggaagccagcctgcttttctctcccttcctccctggtcactgcttccctttgagctgtccctggacttcccaccccacccccagcttcagagattgaggtggcggttgcctggacaacctcggttcttctctgcggtccaaaggagagggctgctgggcaagtaaagcagggctgcctgccctgaggagcctggaagaggggcacactggggtcccctctgtcgtggaggagtatggacaggggctgagggggccacgcggaggccccaggatgggcacagactccaggactgccgctggtagccgagtggccaagctgttaaacctttgtctccatttcctttttcagaagggtctgcagagtctgcaggtggcgcgcacattcgtcatgatgctgaagagatgagcagagtgcttagtctggggcccagcgcactcatctggaagcatgtcagcggagccgcgggacagctgccacggacggcagtggccccggattcatgtcccgagtctgaagagagctcctccctggccttttggtttttggggcctcctagtgtcctccccacacttcggtttaggtctctgtcttgcagcatcagcgactcccacttcttttctgacagggctgtggctgcagacagcatctccagctagttcacaggtggccgcccctaggccacgggctttccctggggatgagggaccttcaaatggaaaatggccactttcataggactgtttcaggttacagggtcaccccttcctgtccctaccttagactcccaaccccatcgctgcacctggcctggcctcctctggaaggaagctcagatttggagcctctgccagggcagggagcctgttggaaccagcccagggccagccggctcattcctggaattcctacctcctctcactgccctgggttggcaccaggtgctgagtgggcctcaggccaactgtgggcatgggctcgatgccgctgcttcctcctccacatcaaggcatcagccgtatctcaccccaaaaggcagagaggaaatccagctaagtcccacgcccaagctctgtgctggcttctggagggaagacacagccactgatcggcacttttggttcatgtgtcctcctacaacaaatgcgaacaaccatatacccttcacatggcttatgtctagctctcaaacggtatcacaagtgtaactgctacaaagtatataatctggggcattattttcatgcttcaaatatatttagggctaaagccttaagttgttcaacttacagaaaatacccaccatgtgacctcattagcaaagccagtacttcttggcaaactgattggccaattcagaattcaatttccattaaaaaagtttgattgcttttaaatttaaattaaaatgttatttagttgacaactaaaaatttttagtgacaactatctcacttctgaattatgacttaataatggggagggagggaggtaagatgaatgagtagatgggatggatggatggatggatggacaagtggatgggtggatgggtggatgaatgaatggtgggtaggttaatgagtgggtgcatgggcaggtggatgggtgagtggatgggtgggtagatgggtggatgcatgggtggatggacaggcaggtgagcagatggacacacaaagatatggaatcttgtcatgtgcttgtcaattgaattccaaaaggcactgccctgtttaacaaccctatgctttgcaatccacctttccctcatgctgcccaaccttaacacgtccatttggtgccccagatgtttttacaccctgagcagtgcaccataatgagtttcaggaggggcgagagataactttcttttgtgaaatgaaagaagggtgattgaggaagcaaggggggaacaggcatgggcagaggcacggttctgggaaagcgcatccccagatcccagaggagttcctcaggacttgcccagcctggggccccatcacaaagctcctctctgtggtggaagccctgtgtgccagactacttccccccaaggaaggtggccctggtgtcttcctgctctttctccatcaccacaagcatttgaagccctggcttttacctgggaagcgagagaaacatctcctcacccactagccctgactccagctcagacaagcctggacaaacgcagctcatgcccagtgacattctaggtcgccgggggaagatctgctaagccatggcctgaccctccgggctcagcatgcactgagcaaagcacccgaccagaacactcttctttcagtcatcacactgaggcttggacctgggggtgactgtccccaccaacaacacaggaaatcaatcttcctggaggtgatcagcctcctgaagagaaaagtctgaaaatcaggaagtcacaaagttttttaagactctgcacgctttccaagcagaagttaaggtcctttgaaccctgtgattgcagtaaccatttctctggggtggctcatacaattccaagccatggaaggaggacaaagcacttgtgccaacaggagggacgacccgcctctgtgaggaacctcctggtgggctctgggcttcctggcagccacagctaaaagggaaactttttgttgttgtttattgttttgagacagagtcaaactctgtcaccctggctggaggggcagtggtgcaatctcggcttactacaacctctgcctccagggttcaagcgattctcctgcctcagcctcctgagtagctgggaatacaagcgcctgccaccacgggggtttcaccatgttggccaggctggtctcgaactcctgacctccagtgatccacttgctttagcctcccaaactgctgggattacaggtatgagccaccgtgcccggccagaaacatacatttttactgaaattgccttcaactccccagaaagctggaatactttctttctagttaattttcacacacacacactctctctcttaagttggaaacgtatatggggcaaaggaaatggacatcattgacagaaatctagtagcctctttacccgatttagttcaatccttacaacaggcaatatgatctgtttttttctttgttatcaatgaggaaatgaagttacaggagcagagggaccttcccaaggagggccaccaagtagaagaaaagctgctgtttgcacccagctggcttgactgcagtgtggcccctcacgctgcacagcacaaactgaggacccacgtcctgaggctcagctgagggagccaagcacatgggctgcaaagatctggccttgatcccggagcagagctcacactactgctgggaggaggagacaggcatggcagggacctcgcaggcctacaggaaaggcagccacagctggcaacaccagcttggagggcagactgggagctgaaaccccgcccccccacaccccggccacctctctcaggcaaatgtcacagctgcatttaacagtgctggcttttcggtatggcctcaactcccattttaaaaatctcactattttccatgggaagtggggagatggagagagggagagacaggacctgctcctcgacagtcttggatgaagccctagttagggttgtacagatgagagacacagagtacctcaacgttcactctgcagagtggacagaagcggggccagcttcgaaagcgttgaggaagctcacaggagccaatgtgaagaaagtgcggccatggaggagtcatccgtggcactcgctctcagagcctgcatttatcctgcatgcacgtgtcaggatgagactgtgccatcctgttccctctgcggtcccgacgctggtagagccaccacagggtgggcttggcaggatgtgtctcttgctcccatcctccctggttccccaccatccctgcaagctgagtggagaagctgtgatgagtctacctggaaatggctttggagccctgggtcctggcatggagctggtgcccatcagtagaattacttaatctatcgtgcaacccaggagtgtctggaagcttctctgcgtaccagagcaacgctgctcatctcctttacctgcagaaaggacaggaaaggagtccagccctactaaattcaactcaaaaaagccactgctcccctactgcaagccctcaggggcccgagcgccaggtgccaaacccaggccaaccccagggccagagcaaggcccctcaggttcagggggcctgggcagctggggccagacacacagaaactgccagagcttctgctgccatgctgagcatgtttcctcagctttaaaatggtgacctcaacagtgactggggctaggcaaggtggctctcacctgtaatcccagcactttgggaggccgaggtgggcggatcacttgatcactaacctcagtcagaggttagtgaaaacaaaggtgtcattcttctcccacccaagtgcatggaccccctgaatttgatcccaaatcccaagttaagaagcctccggcctattctaggcttttccttgacctttaatgaggcagagccacatcccaaagcccaacaaggcaagggaagatgcaggacaatactgtgcccgttctgggaaattcacccaaatcaccctggctccctgggcagggcctgaacctctgcaggtgccatgggcgggccaagctgcaggtcaggtagggttgggcctgagggaagaagagcagctggggggccgatcaccttcatggcctcttcaagttggaagagaccattcccacctcctgaaggagagaggccgggcagatccatcggggctgggcctggggccggggctgggacatgatggacggggcatgcaagtttcttgctctgcgaaatatccccccagtgatgatccagaagaaccaaggctctttccaagctgtgctcattagacaactgcttctgaagaagttgcttctttccccactatgattctacagccttcggtgttgagcaagggatggttgccacacacccttggggtggatgactctgggctcattcttgtcaattcctgaccaaagaaatgtcctttgaaggcagggagacctggctgagcagccaggtggaggaggcagttggctaccctctccttgcccttggcaacttgacagtccccccaggcaggctctcaggatgccaaagcctccaagatggcccgttttctttcctgcatcaggcacaacccaggaaagctccactggccatcttgggaccgaggtttccagggagaccttgccccatcactgatggggaaggcgccttctcccttccccaagccccatcccagactcagtctgacccctgggaggccaaggaacatggagctaggcctgctgggcaatgactggaagcaacactgctcccagcccccagcccccacaatgtagcatatggcttggtttcaaatcccagttccactgctgtaatgtggcggccattctccccctgtaaagggctatctgggcattggtcctggtgtttagtgctttatagaatttgacctcaacttttaaccctactatcattaagtctgtatcagagaatcaagtggtttaaccaagcttgcacatacatgagagccacacgtgagagcttgaacccaaactcaggtgggcctagctccaaatccacattctgtcagttgcaaccgtgttttttcctcctcctcctcctcctctttccagcatgagacattgggcaagttactgtgacctgtggacccatttcttcatcagcaagaagaggacaagaatgtctacctccgggggtcactgtgagggttaaaggaggtagttatgcaaagcactggccagtgggcttgacaactgcttgacaagaagggtttgacaagagccaggatcttggcagatgacggctctgcatgctcccagagaagcgggaggcagggcggtgtgcccaggttccttccaacccctgacccagcatgtagaggaagaggctgctacctgtctaatatctacgctccctttacttggcgttggagtcctggagtttcctcggggcactttccagtcccgctcgcagtcaggcgtggatgtgactgagttctagctgttgggaaaatggagaagttatggtgcaacttctgggacatgcccttaaaacaggcttgcccatcactttctctcctcccctttccactggctggaatgcagatgggatggccggggctgcgaaggccagggtggaccaggaaaccgctgccttgcatggaagacggcagggcagggagagagggggtgggagttggagagagagggagagagggggagatagttggagccctgtgggccacagctggctcacactcaccctgtgactgtgtgacagggaacttcacctctgctgctgtctggactctagctggagccaactcctggctttggatgcccagagtgaagcgctcaggcctgtgtggaagtggtagcgttcacctgtggtccccaccactgctacaggagcagacagtgcgaggcagagtcccaggatgcccctcccagggctgcacctctgggcagggggagggacgaggccctctgtgctcttggctcttctacacgcaccatactcacctctgagacacacccgctcaagatcattccattttctaaggaatctggcgtcatgcccctacgccagcatcagaagcacttcttacactgtgaaggcgctatttggattttgtgggccagcacaccactgagcaccacggaagccactgctgagagccaccgtgctggggcacctccgggttcctgttcacagcagagccaccctgcacgcaggctgcgccacggcatgaccttctcgggctgcccgctgtctgaggggcgcctgaaggtgagatcacaaaacacagaacacgatgtttacccgtgagcatacgcttgagctcatgaggttcatggtgactatgaaaacgcacaaggagggcaggtagcccagggcccacggtgcaaccagtgggcgcaacggtgccgtgagctggcgctgcggccgtgaagctgcctcctggagccatttcgcccctctgaatggcgctcgggttattttcagacaaaggagcatcaactggaggttctgccttttcgaatggatggaattacattcccaacttctatttaccagagtttccaggagagaatcactctcaggaggggcagacaggatcaggactctccacggaatcaacttcatggcttctaaagcaacttcaggaggcacaggaatggggagacctctcatctgggtgggttcccccttcccagctcatgagaggggcagatgccagcaggcaggccttgagccttggctggtgggacaagaccaaagtcagccaccagcaatgtctccaagactgatcccagcacacaaggcaggcaaagaattttctcaactctttttattaagttagaaa

SEQ ID NO: 227 - DNA, 34705 bp, Homo sapiens
ttataaaggtaaactcatgccatgggggtttgttctacagcttattttgttacccagatattaagcttagtactcattagttattttcaacatcctctcccttgtcccaattttgataaattggtaaaggcaacagcctgaatagaggtgcattcaaaaaagtgtaggaagagaagaatgatacagaagtgtagaaagtattcaaagaatgggttataaatacacctgacaattgagatgacaattttctttgagatggcagaaaaaacagcatgcctatatgctcttaggaagaatctagtagaaagagaaaaactgatgatgcaggagagagaggatcagaattgctgaatcatgtttgcattcatttcctatttctgctgtaaaaaaatatcacaaatgttgtggcctgaaacaccataattaattttctcacagttcatcaattatgaaacatcataattttctcaaattccaatgaatttggaatcagaattccaaaatctggttcaacaggctaaagtcagggtgtccacaaggttgtatttcttcttgagggtctaggggaaaatgctattctgggccattccaggttccagagaatgtgttccttggctcatggcacttattctatcttgaaagccaactacatggcatcttaggatctctgtcctatgcgtctttccttacacatcctctttgattgtggccctcctgggtgccacttgtaaggattttgagatgacattgcctatccagatgattcaggaaacgcttctatcttaggatccttaacataatcacatctgcaaagtttgttttgccaggtcaggtaacatagtcacagcttccaaagataaaggcatgagttattggcagggcagggggagggagcagtattgagcctactgtactagctttgtggagaacttgaagcaagtaagccttaattttctagccttgctaatagaaagtactatatcaccagccactaggtcctgaaaaatctagatttcatctcagatataatgaaataaaaacctgttccttagctctgatatcatttataccctatcatatgtccccttctagtcatagtccctttattcccttagtttaccatttctcccaggatttgtgaatatcttttttcactgtacatgcagagaactccagcattgctgttctttacattctcaacaactgaaagtttctactcatacttagattatacttcaggcaactacttctatgctataacttatacagacaaagaagtacttataactgctctatgaacctttaactttaacacacttcatactaatgaagcctcttacgcttcgattttcactacacatcagttcatcaagttcttaattcattaagggtttcggtcattgggtctctcatgtttcctctttccaaattcattaagggtttcggtcattgggtctctcgtgtttcctctttccattctttcaatctccacacaagtttacatattcagatttgcttacataataaagtaaattgaaatcctcagactacactcattctctctaaatttctcctttaggttttctgctggttggggtctcttgtccttgtacctattgatctgtgcttatagcaaacaaactggatcaatctgcttatagccagaacaaattgccctgattgtatttttgtagatcatctagccaaaagctaaaatcctacaccagagattcttattcatttgatctgtagaaaagtttaggtatcactatgtttcctttattttgtttttggatttgtataaaattaaagtttacaagtgcagtttgctacatagatatattgcacagtggtgaggtctgggcttttagtgtagctatcacctgaataatgtccattgtacttacccaaaaatttcccagcctcccagccttctgagtctccaccagtggaagacggaggatccagtgggcagatatcaagtgcctataggtgtgcctaggcatggagttgggaaacctctgctctttgatgaattttaaagaggttatttgggttttgttgtaattattgttgttgggttgagttccttataaattctggatatcagtcccctgttagattcacaatttgcaattattttcccccattgtataggttgtctgttctctgttgattttattttatttttttttgcctttacagaagcttattggtttaattaagtcatatgcgtctcttcctattctctcatttgtgtttttgaaatcttagtctgagttccttgccaggacctacttaagaattttttgccccaataagttttccttagattttcttctagcacttgatagtctcaggtcttacatttaagactgatttatttccagttgttttaaaagcttgcaaagctattttgaggcataagcaaggttgcaaatgtctaactttttgaaaatatcaatttttcattatggtttaggggttaggattgtattatcaccaacatgcattttatgagaaaagctttgctaaggtcactcatgtttatttccttgcccttggcatgagctacagtgggaagagtgctgcaacccagccctagccaacaccgcatgagagggactgtgctgcaggcttctgagaaggtatctctcacatctagaaagaagcttttaagatgtggcagcccctcttcttaaagtggctcttgtcctgttgccctgggagttctaaaattgctgcagcagcctccacccagcctgaggatgacatcaatacatagaggaagaagagtcaggaaaagatgagagaagttacagactctcttgggcgaccccgagagcttaccattcctcagacttcttcacatggtgctaacagatttgtatatgtaatgagacagtttcctgattccccttggaggacttgcgaggggtgtggctcaccggttcaaactgcttgagggagggggagcatggagatgggcaggtgcacaggccagggcgagcgctttgggctctggctccatggtagtgtctagtggtgggtgcctgcaaccacagtgttgtaaagctctttcagctttgccatctgcagacggcttgagtctgcagctccatggaccctctgacttatctcaaaggcagagggccagtgtgacagctttctatatcccaagctcttgccaggcatcccagaagagtcagatcacatgtgggctcaaaggatgagggcaagattttattgagtggtggaggcagctctcagcaagatggatggggagccggaatgggggaatgagtaggaaggtgatctttccttggagtcaggctgcccagtggccggactcttctccaatcctcctaggccaaattcctttcagtgtccaatgtccctcctcttctctctttctgtgtgtcattgttctgccgtccatctggttgcctccttgtctcttcacctgctggtctgcccaggaacttaggttttgggggtttttatagcagcagaatggaggtgtggtgggccaaaaggcaaattttcggggcatgaaaactgaaatgcctgttctcatttaggggcacggctatccaggcttgaaggtggggcctttgctgggaaaccaccctcttctacccagtatttccctgtctcctgtccatatcacatggagtttaaaccattcagaaataggtttttctcacctggttttatgctaaccaaaacaactataatattaatacttttctctttacaacctcccctgcttgttgacctatccaggagtggtcgcaaggtgtgcaagctgctgagtcaccctgactgcatcaacccgagtagattgtaggggtgaacaatagtatcgagaaatagtaaaatagcaaacagtgcagacaaggcagacgtctcaaaaagtgctcagtggaattgtcactcatccagagtcaacattggtgacacagttgtttcttcaaacagagttccctctatgaaaaaactgagcaaggtggaatttactttaaatttcatgggttgtgaaatttcaactaatgtcataattaaaacttcctacatattgccttaggcacctctgtcttttccccaaacttttctccagggcatcagcagcacctcagcctcttccacagcctcccagctcttcctttttcctcctgcacggcttttggcatcccaccattttccacagcaatgcaggctaactgtgagcttccacagcctctcacagacatgacttcacccacaagcctctgtgaggctcaagtgtacccctttttgttcacatagaacctcttcaccccagagaattgagtcaaccaaacaggaaatctcaggacaaacagtgctggcaaacatcattttgtttaaagtatcatatcaatatatatttgttgagaaaatattcggagttctttgcaaactgtaacacttgttcagaaaaaatagtgagaagaaattaggatcatttatttacttgaggcacatgagtgttctctatgtatgactcaaggacatcccacttctgtcctccctgatcttccatcttccatctgctttccatcctcttcccatctccctttcctcatattcctctccctctccctcacctgtaggactgagaattcctgtggtctcctgagatcagtttctttccaccacattgtaaacaagctgtggaaagttttagttcttagcgactccacgacccacactagtcaggcagaagcccccatgtacaaggtaccccttgagccttggcaaggtgcatgacacacacttggtcactggaggaaatgatgagtagagagtgacaaatagaagaggggaactttaagcttgagccctctggagtgtaagagtggttgaggcttggcacttgccacctagatttcagacaatgtgtcaggaatcctggatacccagagagaatcctgttccagggccggatccccaacataaagcttttatttaggcaatgttgagcactaatatgtggttggagctctgcagggggtctccatgggtgcactgtgtagcaaagctgtgggagaaaggccttacccctcaaaattccagaattataaatctaccaggcgctaacaacttcagcctggaaaagccatgggcattaaactccaaactgtgagagcagccatgtgggctgcaccctgcaaagccacaggtacagtgcttcccaaagcccccagaagcctacccctgtcaccagtgtgcccagaatgaagaatatagagtcaaggaagatgattttgcagctttaaggtttaatttctgccctgtcggctttatgacttgcatgaagcctcttcctcttctctttaagctgacatttcccttttgaaatgagattgttcaaccactgcctataaaaccattgtaatttggaaggaaataacttggtttttgatttcacaggctcatagctggtagaaatttttcttggatctcagataaatctttgcattttagacatttaagttgattctaaacctgataaggctttagagactcttgaggtaaactgattggattttgtatgtaagaaagacctgaaatttatgtctgcagctttttctcctttatatcctcaactaacaatattttggggtttctatgattctttgctaaaatttggattcccgtttcaatttctcttgtgcataatctgtaattattttctctgtagttaccattggaatgacatactgcatcctatagttataccatccactttgaaatcaatgtgaatttaacttcaattccatacaaaaacttcttttccacaggtacctttctgcttcacattattgatgtcactaattgcaactttatacatggtgtacatgttaacagaaaggtattcttattgtaatgtaaatcttgaagaaaatgagagtaaaaaacaaatttcacaaatacatgtttccacgtttttcatacacctacctttacgagaggtctttatacctctatatgacttcacgttgctgtctaaacttctttcatttcaaagtgaatgactctcttaagcatttcttgtagagcagttctaatggcaatgaactcctgcagcttctacatcacatagtcttactaactttgtaatttttaagaaataatttggctgggtgcagtggctaaggcctgtaatcccagcacactgggaggccaaggtgggcggatcacaaggtcaagaaatagagaccatcctggctaccatagtgaaaccctgtctctactaaaaatacaaaaattagctgggcatggttgtgcacgcctgtagtcccagctactcaggaggctgaggcaggagaattgcttgaacctgggaggcagaggttgcaatgagctgagatcgcaccactgcactccagtctagtgacagagcaaaactctgtcacaaaaaaaaaaaagaattttttttgccaaatatggaattattggctgtaattttttttaattgatcacattaaatgtatcacttactatatcctccaaagactctcgtaagaaatctgtggatcaccttgttcaggatcccttgtaccccatgattcttgtttctcttcctactttttgttttgttttgttttgttttttatttatttatttatttatttttaattttattattattatactttaagttttagggtacatgtgcacaatgtgcaggtttgttacatatgtatacatgtgccatgttggtgtgctgcacccattaactcgtcatttagcattaggtatatctcctaatgctatccctcccccctccccccacaccacaacaggccccggtgtgtgatgttccccttcctgtgtccatgtgttctcattgttcaattcccactatgagtgagaacatgtggtgtttggttttttttgtccttgcgatagtttgctgaaaatgatggtttccagtttcatccatgtccctacaaaggacgtgaactcatcattttttatgactgcatagtattccatggtgtatatgtgccacattttcttaatccagtctatcgttgttggtcttttaggttggttccaagtctttgctattgtgaatagtgctgcaataaacatacgtgtgcatgtgtctttatagcagcatgatttataatcctttgggtatatacccagtaatgggatggctgggtcaaatggtatttctagttcaagatccctgaggaatcaccacactgacttccacaatggttgaactagttaacagtcccaccaacagtgtaaaagtgttcctatttctccacatcctctccagcacctgttgtttcttgactttttaatgatcgccattctaactggtgtgagatatttttttttgggaggggggattgagttttgctcttgttgcccaagctggagtgcaatggtgcaatctcgactcactgcaacctccacctcctgggttcaagctattttccgggattagcctcctgagtagctggaattacaggtgtgcacccccatgcctggctaattttttgtatttttagtagaaatagggtttcaccatgttagccaggctggtctcgaactcctgacctcaggtgatccgcctgcctcggctcccaaaatctcttgctatttaaagattatctctttgtctggcttttagagttggatgataacacatacagatctgggtctcttagagtttatactatttgcagttctttaagtggcctgaatttgtagattgttgtctttaaccaatttgaaaaagttttgatgtttttattctccaaataatctgtctaccaccatgggtttgcacttctccttctgggaatccaatactatcatactggtcggcttgaagctgtcccataagtcccttaggaccggttcacatttctttattcttgtttcgtgtccttagactcaggaacttcaaatgcgctatccctatgtgtattgattatatcttcatcctgctcaaagttgctattgaaacaccctctggtgagttcttcattcaggtactttttttgctccaattttttccttttttataatttctatattactactgtatcgtgattttcttattgttttcagattttctgtagttcttagtccatatttttcattagcaattttagcatatttaagcagctgtttaaatgcttctctactaattttaatgcctgtgattcttcaggaaagatttctactaatttattttctttctcataatgaactgtgatttcttgtttccttgtatgccttgtcattttattttatttttttgagccagagtcctgctctgtcgccaggctggagtacagtggtgccatctcggctcactgcaacctctgcctcctgggttcaagcgattcccctgctttagcctcccgagcagctgggactacaggcgtccgccaccacgtccgactatttgttgttgttgttgttgttgttgttcttgttgttgttgttcttattttagtagagacaggatttcaccatgttgaccaggatggtctccatctcctgccctcgtgatctggccgcctcggcctcccaaagtgctgggattaccactgctccaggcctgtatgccttgttattttatctaattgggcatttgaaaaaataaacatcttttttactgtatatagatttgttctatgtcatgacagtcattaacttatatgtgtggcaggttctcagtcaaggcatcagccctacataaaacctcaagtccttcttagtttgtttctgaacatgcacctacgtggactgtgtttgcccttttatgtatccccaaataaccaatggcttttgaattgcttactattatgaaatttcgcatcccagtttctcctcaatggcttagatggactattgcatgtctcttcccctggccttttgcctataacatctgtatgtgtatagtcaccctgaatctctactgagccactccagaaataaataagtttatttcagtcaattttaggtattttctgatgtttccatgagttatatgggaatcttagaatccaccatcttgttgaaattactctgtgaaaaatttcaatatctttataatattacatttatgtcaatgataacaatttacctatttttcaatttctgtttgttttatgaaaaagcaaatagaagcaatcagggcactgcaagttgtgactactccaagatgtgaatcatggatcatgcaaattacaatcatgttttaacctgacctccaaagggagaataaagtaaaaattatcccatgcgaggattattcaccagtttatatgtcattagttaccagtttttctttatgaataatgtttagcaatattataaagtatatctaatagttatcatattttggcttgttactttttggtagcaattcataaaaatggctggaaaagacaaataaggcactgtttgcatgttacaaattatatccaaagtccaaaagctgttaataagaaatcttccaataaaaccacatcatattttcttttttatttacacccacatcaggattacaactttatcaggactgcaccttgatcaggaagggatgtttctcttacaaggctaataagaaaggaacaataaatttgctgatgaaaaaagtaatgcattaaaaaattttaactttaatttttaattgagggcaatattttaaagaaatgctcattagtcattcctttaaattgtgtgtgtgagagagagaaaaatgaaaattagtcatttcaaatgctgcaagatgcagaaggaactcatcatcatgacacaaacaaaaaagagctgtgccgctagaggtttctgtattcttatgtaaagtcacaatttgttctacaaatctctttgagtaatttatgtctcatatatagagatctggaatagcaaaaatacttcagaggaaattaatgagtgtatcatgaccacataataatttacttatgaattttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttcctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacctggcctaaagagaatttctcatgtactattctcacctctgggaaaattacctgaaacgataaaatatcctcattttaagaaaaaaaaaatactagaacctaacaaggaaaatttaaattctttttctttgttaatatgggtcaaatttgtatcaaaatattgtaacagaaaaatttcttgtttctctgacaggaaaattaatggaatagattttcttttctagacttagctatttctacactggaagaaaacttgtatctcaagactgtcttgggaatacaatgtgtgtgaatagggactagttacataaaatttgggtttcacatttctgatctatacaatataaggatttacaaagggacattttgaagaccattgacaggagtggtttactttgtaatataaattgacatggagaggaagtaaagatgaggataccactaaagctccagctttggtaagcctttgagtactcatacagcaaagaaatgatcaaggatggtatgaggagagggctgtgagacccagtatctagttccttgtaattctatgggaaaaagaaagcctctgaaatactttccagataggaaaacagtttgctttgtttctgtttttgtcatttaaaagatatactttcaaatctgtatccaaatttgttacgtaagtcaataattgtaaatttcactgcaatcatatgtttcctaaaagagttgccttgaacttatggaactgaaccccattttgctaatcacttactccttgcagtctatttcttatacaaatcaatatccttagagtatacatttttacacctactatttagttctgtcatgccgacagaatggctaatggctgtgtagaaaagacttgacataatagactgctatccatagacaggcctgtttcccatataaacctgctggtatctgataaggtggatttctcactatttcctaactgataagaatggtggctgtaagtaactgcttgtgcaaactgcggagtttctgtgcacctgctttccttttggagacttttggaagttttgtgcctgcgaagcagagtgagtcaatgtaaccagtcccagacaaaatcttagtaatggagtatgtagagagcatctcttgtagacaacagttcacatacattgacaaaatatgattccgggtaaagtcagtgcattctgtgcaatatggtgggagaggaatcacaggagcttacactgtattccttcatatttccttccatgtggctatttcctcgtgttaatttctttttttgtttgtttggtttttgttttgtttttctgagatggagtctcgctttgtcgtccaggctggagtgcagtggtgcgacctcagctcactgcaagctccgcctcctgggttcacgtcattctcctgccccagcctccccagtagctgggactacaggcgcctgccaccatgcccggctaattttttctatttttagtagagatggagttgttaaccaggatggccttgatctcctgatctcatgatccgcccagctcggcctcccaaagtgctgggattacaggtgtgagccgccacgcctggccattccttgtgttaattttaccatactaaaaataattaagattatatctataactataggttgcatcctgttaatttttccaaaaaatgactgaacctgaaattgttttggggacacttccaaactagtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaaggtactgtgcctatgatgagcttgtgtgcacatgtatttattgtgattgtgtggaggtggcagttctatgactggatccatagtatagggtgaattgtgcttatttattacgatttattcacacttactcatgtattaaaactaatatcaaaggcaggaagtgaagatggctttctcatctttgcagtgttccaattcatgccttcaaagtgcctttactttttgagctcagcacagatcaatatggtttaacatagactatagaatcagaaaaaatcctaatcatattatattatttcttacctcctgggtgagtttcttacacttgttatgattctcagtttccattattatgttgatcatagagagagaaagcaatataagcaagctctgtgagtattaaagaataacgcctacattatctcaaattgtgtccagcccaagttgacatattaaaaactctgtttgcttcctcagtttctaaaccacaaagatacttaatcttgcccattgggctgaatagatgaaataattacactactaacatgagttgtaaaacttaccaaagataattcagataatgggtatgcttatgatttgataacaacttttaccttttgagtaatttcactctttcattcaatatatgtactaactatatatccaacatattataaagttcatcatgatatggcagaacaaaaggcatcacaagaagagagagaataattttgcctgtggtcattagttttgaagtagtagaaaatgtctaaatattaggtggagcaaactagtaaaattggctcaagttttcattacacaacttcctttctctaacctctgcagctttggtgcaattcccatcgaccagagttggtccgaccagccttggaaaggtcactgaaaaatcttcaattggattatgttgacctctaccttattcattttccagtgtctgtaaaggtaggcagcttgtgtgatcaaattaatttcacttttgttctcagcataaatattgtttttatggatatttgaactaagcattttcttaggaggacatagggattataacatagaagaagaatcctaaatctaactcctaattcctttctatgggatacattttgaatccatacttccgtgattgcatgtctataagaaaagaaagtgcagaactctcaaagcctctgcctcaaaaacttgaggaaatgatagtcatctccttgaaggcacaaggtcttagttatgattcctgatttcacctcttgggatgttcacagacacagagtttcatgaagctgtggtgtccagaaaacctgctgcacatagggtgcacaatgagtttccatcttcttgcctctttttaaggggcgagaactcagtccgggagtgtcttaaactacagaccttcatgggaaaccttgttgcttctgcttcctctcttttcacactggaggttttatttttgcttagccatgaattcttgggtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaagtatttgttccaacctttttcgttggtggcatttatggctttggagcactgtcaggcccatgttcattaccgtgagctcctgtgcatctcctaatttccaaactagccttgaaaacacctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagaggtatttatttatacatgtaatagttgtaagagattagagggagcctgtcacctgaagacattccttataccttcatatgtagtacactctgtacataccactctctggagcactgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccaggccgtggagaagtgtaaagatgcaggattggccaagtccatcggggtgtccaacttcaaccgcaggcagctggagatgatcctcaacaagccagggctcaagtacaagcctgtctgcaaccaggtgagcaccctcagcctcctctcctttctgttcttcatgcccctctttctgtcctattgccaagtatccattcatttagtcccacttatctttgtaaaagagaagattctagagagcaaagactctgtctcgaagggcatagagggatcttacttgtacccggcttagaaaagtcttagaaaaggtgttgtaactttgatgctgaattgtgtgttatatttatgggaggtcaattcaatcaaggaggccaaggattgtcaattagactcagggaaaggtggacttacccctaagctatgaaagatgaccagagaatggatgggtgaaggtgatttggagggaactgtgcatagatatgaagccgtgaagagatggaatgaacagtacataaggagagagtgagagcaagagaagagaaatactagggattcacatgggcttcggatgtctcagtgcctcttggtgtctctgctttcacacttcttgaccaagggcatagatacactaaaaattatctgcagacaatgaaggtcatccatggtagaaagagaaaataacctgtttatgggagatatctgttcacagtggatgaaatccacactgaggaaggttcagcagaacatggagctgacctatgactgcccccgctcctagttggctgctcttctttggagtctgtcatgcaatcagctgcttaaacacatctattctctatgtgttccttttgtagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaattaatgtggttttaatactagtagttccccaattttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatctatagtgccctcatgtcatttggtatccagtccatatttgaatttttccttgcttaatcaaaatatcttttgtagctcttctttttttaaccagaattcaattgtttttatattgttgtattttgatatcagttaacttgtttttcccagttgttgaaggtttctgtaaattagaagttagatgagagtgttttattacattgacttaaacctttggggcaagaaaatatttttatcatgctgtgtttttcaaattgcaccacactagactgcatacaatcacagaatgccccactagtggtgaaggtagttttaaaaacttggttaagctccaacaatgatagactggattaagaaaatgtggcacatatacaccatggaatactatgcagccataaaaaatgatgagttcatatcctttgtagggacatggatgaaactggaaatcatcattgtcagtaaactatcgcaagaacaaaaaaccaaacaccgcatattctcactcataggtgggaattgaacaatgagatcacatggatacaggaaggggaatatcacactctggggactgttgtggggtggggggaggggggagggatagcactgggagatatacctaatgctagatgacgagttagtaggtgcagcgtaccaacatggcacatgtatacatatgtaactaacctgcacaatgtgcacatgtaccctcgaacttaaagtataataaaaaaaaaaaaacttggttaagctaacagtggtcagatctgttgtttttaactcatgttttctctttaacaattactagtaatctgctgggggataattctcaacagaagaagtcatattcccatgacaaattttcacatatgattgagtatacatcagtgatttgaacttttttctactgcatttctgttttcttctttgttatttcttatttgttatttccttggggtttttacataatcatttacaattttaaccacttgtttaactattcttacctgacatttaattaaaaatgatttctcaccaagtaaaaataataaactactattcctctaagtgagggtaaaggtgaacttcttccttcaattagcaatgtactgtgaacgtaattactgtaatgaccaccatcagagtagacaaagattgttgttctttttctcattgtcgcactaattactacagactcacggattcttgtgttatgatttttaatttattttactcattttttaatgctcacatctactcagcatatatatattatatatatatatatataaaatatatatgaaagaagaatgtgatcaaagactcatgagggcaagtgtaaaagacaaaagcacttgtttcatagggaacccactggtgacatttgagatatcaacatacaaatccatcatacaaaaaggaaaagtaatgaaagactgtgaaaattatcagtatttatgtgtgtatgtatattttctagttcatctatatagatatatatcatagatggcatatatgatatatatattatatgtcagatcaattagaaaacatacatatacatgtatgcatttttggtattaattaggaaactagttcttttgtctttcagacctgccctcatgagtctttgaccaaattcttgatttctggcacgatttgatgcccaaggctcaaagaatcttacctcatcccagctctgaaattggccgtgtctcgttctagtggtcggagttattgagaaaccaggatagggttcatggagttgcttgtgctcagaaatagcatttctattttcttaggagagaggggcataaaatttatttttatgaaaaagatcatttttgacaataatattctcagttcaaatttaatgctctacattattcagcttcttttactttggtgattttaatattagtgtaacttttggattatctgatgcttttccatcttgctcgtctgcaggtggaatgtcatccttacttcaaccagagaaaactgctggatttctgcaagtcaaaagacattgttctggttgcctatagtgctctgggatcccaccgagaagaaccatggtaataagagatacaggaagtttacctaaaacaccggtttgataaaaaaaatttaatcagatcatgctgtttcctggagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactgtatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcctatgcatgaactctttgtgtacgtcataagggtttcttctactctagcacaggagaggcaacagaggtggagagaaataggatgggatcaaaactacagatttgggttagcgttaagtcagtgatatccatatccctctgctggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttttggcgaggtggttgtgtgtctttatttttatgtgtaggagaccatatttataccaataccttaggatataagacaaacccacttaatatagaggcttaatgcaaaagcatttattgagctcaaggttccatggttagaaaattagcctgggctcagcctaaactcagtccattccttctgttcctggctgggctctcatgtgtgttcagggcagtgaggcagctctgcttcaggatgtccctggggcatctgtgtgagcgcccccctctcccatgcagttctttatcctccagccatccagcccagggttcacctcagcacagggcatgaccccaaggcagtgagtggacatgtgcaaagccttttcaggtctaggctcagagctgccaaccattgcttctgggaaattctatcacctaatgcaagttacaggacaggtcagactcaaggggtggggaaaaagacaccacctcttgttggaaggagctggaaattcatataaccaagcaagtggatacagggacatgtgattgttagagggcatgttcctaattaatctatcatttatacgatatgtgtgaaataacatattaatagttatatgtatgaatatgaatatatataaattgatatactatttcatatattcttaagaatacatccaagtctctaaagaattaatatccagaatacatgcatatatatgttttctaattagttatatacagatatatgaaatatcatatatgatatatattataaaacctatgtcacatatatgacatatatcatgtatatgtatatgtgtcactatttgctaaaacattaagtaaaatcagtgtagaaatccataggatactctgaaataatgatacagagaatgagaaagaaagtaaaaaatgacaatgaaacaattgatgaatctaggtaatggcatttactatattattttaaaaatatttttagacattagaaaacccacaaaactaaaaggaaatattatgaaataactgtggaaattatcagtatttatacatatgtgtatgttctctaattcatctagtatatatagatatatgacatatgtgttatataatatatatgttagattaactagaaaccatacatatatatgtatttattctggatattaattctttagagacttaaatgtattcttgaaataacatctcccaaattttacctgtgttgtcatattctctgtggttatgttttcacaaacaaaagtttctatccttcatgtagactaatttttcatgcctctttcttgtggttggtgagtgttgtgtcttatcctatattgggaatatcacaatatattactgtgttatcttacaaaattgttaatattctttccttataaatttggttaattctaatgggattgactttttaaatactgtatgagataaggatccaaatatgcatatctaatttttgaatttttagcaaaatttcccaccaacatttattgaaaagttcatatttgctcacataacttgatttttttacctgtaacatatatgaaatgtccatgagcaattatctggcctctcttccatcttcagttaacttatttacttttctgtactatgatgttaaaaagtaagtttcacttccagtatggtacaaatatttttctaacttcttcatttatttaataatatcttagctattcttgactaatgtgttatttaaaactttgaatcatcttattaacttccacaagcaaataaatgtttagtctcttgttgacattgtaataagcctccagatcaatgtggagagaactaaatgtttgacaatattgagatttccaatgcatgatcataatatgaatttcccacttattaatagccttttaataaatatataattaatttcataactttctctgttactgatgattttaatagtttttgataacttttcatttttgttttatggattttctaatatatagaaatattaaaagaataatgcaacaaatcttcttacctacattcatcaagtgttacattgctgtcattttttactctctttctctcattttctgtattactccttcagtttccctatggatttatacacttatttgattgaatgtattagaaagagtgacatctttttgatatttagagtctcccaaatttacatagtgagagtacccacaccttttgaatgtgaaatcgttagtatttagacaattattggcttgagtgatgttgaaaactaatttttcctattatacctgttcattggagagatagatattcaatgttattcatcaaacctactaaattatgctagacattacaaaatttgcctctagattcttgtgggtcttctaggtacatgaccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttaagtattgtctctgcaccctactgtctgatgaacttggttgttcccaattggcaatgatgtaatctaaaaataattaaagttttctattactttgataggtgtttgaattccagttgacttcagaggagatgaaagccatagatggcctaaacagaaatgtgcgatatttgacccttgatatgtaagtaattttggagatggttgtcctaatttattttcagaggaggaacgtaggatgggtgttgagagtgacctccacaccaggggcacagaggccaacgtgagacagaggtgagacaggagctttctggaagtctcctcctggattcactccagagctctgttctctggcagggagagtggcctggggtcagcatgggtcaacctgtgcctctgctctcgtgactccaaggaactttccagagcagccaagatcattgctgaatctgcaccttccatgtaggcctgctgtttgtgctactgtctagtgtacacactgtggatattgcccatgtggtcgcattagatgtttccaaatctgtgcttctatcttgttcttcccaacctgctcaatgtcttaccagatcaaaggcagttccgtcaatcttgtgggccaggttccaattcccacctctttcacatggaattgcttgctggatcctgtcgatttagcatttttaatcatttcaaacctttttcgtgcctgtctttgcatgtttgcccatgagccaaacactgcatttgcctccagaaagtctgtcttagtgaagcgaataggagcacttggccttggtgttctgcaatatggagatctcagtgcagagaatgaagaaatgttaaaatcaaatgcagagtgtagatgcaaaagcaccattgttggagataatttataaccaataacagaagtttactattcctctgtgttctaaggttctaggattcatagaaggtcattcatataatgagggaaaaaagaagttatgtaactgctggcagtagggatttcaacaagtaatagagatgatgagataatgtgtgaaaaaaacaagcacaatggtacatcataagtacccaaaatttggtggatattattagtagtattttattcatttagaggaaaatacaaaatgaaaacggagatgataaaaagaaaaggaaaagtggcaagcattagaaagttttaaaaccaattaatgtttttggggatcatgaaatcaatcactagtgttattttgtagaactcaaatatggtctggagtaaaccacttgcgagcttccaagtgtttgctcttggtgtaatcaaaaaggataggctcaattccctaattaataagttgtaattgtacatgtgagcagtcatttatctgtgtctttacattttgtgttatttctgcctataaaatggtttatacattgtagctctttggatattggaccctatatcaaaaacaacaatttacatttctgaatctaaccaactatgttgcatatgataggcaggtagtaatatgtaaagtaattaagtataattgctaccagtataatcatcacactcaaaattgtttattagtgatgagcatatgtcttgcttattcctcttcaatgtaaggcagtatagttccatttttactgagaatttgaaatagaaaaggtcagtatatctctttgctctgttgacagatgtagagaaatatgtttgaacatttcactttgtgtgttttatgtgttaagttccaggcaggggaatagaattaaattattctttattttgaaaatacagatatgataaagtcacattcattaaacaaagaaacacagattctagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccattcacaacgttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacattgaaaatggcacaagtgactccttccctgtcaccaatgacagtcatgtgttgcataatgcctgggctatcttctgagaatggctttgttaggcaactgtgtcatggtggggacatgatagcattagagagaattctctcaaacactgtcatggccttatcaactatgcttctgtaatattctgaatccttcgctgcctttccaacagtgtttacaacggtttcctaagaaatgaaatccatttcaccaaaccacttttcttgctcatccataagaaacacttctcctttgttaaaattacatcatgagattgcaagcattcagtaacttgcaagctccaatttgaattctagttgtcttgctatttccaccacatctgcaattactttctccactgaaatcttgcattcctccaagtcatccaggagggttgaattcacttctttcaaactcctgttcaagtaaatgttttgccctcctgtcacgaatcatgaatgtttttaatggcatctagaatagtaaatctttttcagaagattttcaattttcttttcccaggttcttcagacaagtcaccatggtagctgtagacttatgaaatgtatttcctgaaccataaaacaagaacatcaaaattactctatgatccatgggaaacagaatgcatgttgtgttagcaggcatggaaagaacagtaatctctttcaacctctgtaagagagttcttggttgattaggtaccttgtcgataggcagttctaatttcaaagaactttttcttttgctgagcagtaagtcttaacagtgggcttaaaatattcagtaaaccattatttaaggagatgtggcttaaatatctaggctttcttgctttatttatagaacacttacagagtagatatagattaaatcttaaggaccctaggattgttagaatagtaaatgaacatcatatgttgtaatatagttagccagggaggggaaagatctctacaagaaataattttaaaaactactcaaagaaatcagagatatcacaaaatgacaaaacaagtacaggggcagcaaaaggtaacagatgtcaactatgagatctcatcaagaactaagaaaatggagaaaagtaccagatggcagatgggaggcagtgtgagcatgcctctcccacttggagattagtgtgtagagatttacattgtgaatttcttttcaagaaccaatgcagagacttaacagatatatgaaaaaatttcacatacactctgaagaagtctcaggcacaatcctactccatgaaataagaaaaaaccatcacatccccagattctgaggggagagagttcactccagagcatacatccccactggggatctggaaattcaggccacaagagaaggctttgatcctgtgcggacaagtgccttgagcagaatccacaggggagagctggaagtgcatggcagatatgagcacagaagctgggtgtccagccttgtgggcagaccgggagggatgtggcctgaaagccatggttattatctcagcgtgtaagctgatgatctgaggctggtcagagttctgtgcgcagactgcctggatgtaaacctggcactgttagcagagcactgcatgaatgaaaggaatgaaaatagccttgccaactgcataggtgctgggtgaggctcactgtggggggcgcacggcaagctattcaacattacgtacaggcatttgaggtcggggcatggaaaaatactgaggcagtgtgtgtatgttatttgtgctgagaatgaaactccttgaccttgaaaacaggacagggagtggtgtgtgtgctgtgataaggaatgctgaaaacggtctcctgagaatgcggtttgagtgcttttacaaggccacaggtgtctcacgacctgacctcataaagccatctagtggatgtttgtggcttaacaagccccttcaataagtacttggcggagggatgctggggggaccttcttagaagagctgcgccccacccccctccctggacagcccagctacaattgtctgagaactcactgcaagctgtaagcggcccactacttcccactcccttttttgaactcttctgtgcagcagaggcaattaaactctcctctggaacattaccccagcagcctgagaaccaccccttggcgctcacaggggctgcagcctgccttatccaaggacagttagagtgcagacccacctaaccctggacccactggtggtacccatccacccatcctggtagcttaacacaaagatacacttttaggagcttcatagcccctcttcccccattgcctgagaaaccactttccctgggcaacttagggcaagctcaaatcccactgctaccaccacagctggtgctcttttgcaagtgccacctcctagctggagaccaaccagcacagtccacacagcacctcaaggaagaataaatagaactgttcccaggaaggagaaaatgcctgcatgagctcagctgttaccactgcgtaccacaccctgaccagtcagaggtcttgagtcggtccgcatgacaagttcaccgctcgcataaccagcattcaagaaagccagcacactaagcctatctacagccagggagtctcagagtctacgtcactcccctgccacctcaatcagagctggtgctggtatccactgctgggagacttgtgctgaggtgaagcctgggctggatggctggaggatgaagaactgcacggaggagatggaggcacccagacagatgccccatggacatcctgaagcagagctgcctcactgccctgcacacacatgagagcgcagccaggaacagaaggactgggcaacattcaggcggagcccaggccaattttctaaacatggaatatgagttaaataaatggcttcgtattaaagcctgtatgttaagagggtttgctttatatcccaaagtattagtataatcatgatctcctatgcataaaaacaggacaaacaacccaataaaagagtcagagagttaacaagcgcttcacaaagataaaactctaagagaataaatataagaagtatatactatgtgagtatatatggaaaagaaagaaattcacaatgatttggagactaaagaacacctaattaaactccttgtttatgaaaatgaagaaaaggagatgtccctggcagagggatacaaggtaaattgtcaactcaatgctgaaacccaaatctcttgtttgggtcccatcctaattctctccacccatgctgtctttcctgtggtaaagtggaaaacccttatgatgaacacaaagcatttgtgcatagaatatgccagggaaaaggagatggcccaagggtgtcctcagaaccttacaagaagcacatgtttgaaggacactatgcaggagccctgaggcccacagccccgctcctcacctgcacgttctctctgatacgctgctcattgtagctcttggccaggaccaagaaaggagaggaggctgatggcattcacctggagagtgcttctcctgtgggggtgcaatcatcatgaattgttccaggaaggctctctataggtgcatccactctgcgctcctgtgggataagccccagctgtgtctacagtggtgcaccagcggggaacaaggactgcttctccaggacctttctcagtcacagaagctgcctgcctgttggggcagaggggcaggcttttcctactgcacccagctctgcagttgtttgtctgctgcaagaaatttcccaacagtggaaagacctgggattcaagggctgccattcaggtttttctgtcccactggtgttcccttatgtggtactcttttccctaccctcaaaatgggacttcgagagagctggactacagtgattgctactgctcttctgggcctagccgcccagtgggctcccagactccaggctggtgctggatttgtttgcaaaggatccagtgatgtgacctgtcgtcaagtctcccagcagtggacaccagcaccagctctgattgaggtagcggggagcaacgtagactcggagatgccttggatgtaggtaggctcagtgtgctggctttcttgaacactggttatgtgagcggtgaacttgtcatgcggaccgactcaagacctctgattggccaggatgtgatacgcagtggtaatagctgagctcatgcaggcattttctccttcctgggaacagttctatgtattccttgaggtgctgtgtggactgtgctggttggtctccagctaggaggtggcacttgcaaaagagcaccagctgtggtggtagcagtgggatttgagcttgccctaagttgcccagggaaagtggtttctcaggcaatggggaaagggggggtatgaagctcctaaaagtgtatctttgtgttaagctaccaggatgggtggatgggtaccaccagtgggtctagggttaggtgggtctgcactctaactgtccttggatgaggcaggctgcagcccctgtgagggctaaggggtggttctcaggctgctggggtaatgttccagaggagagtttaactgcctctgctgcacagaagagttcacaaagggagtgggaagtaatgggtggcagcgagcttcacccagcacgcatggagttggcaaggcagttttcattcctttcattcctgtaatgctctgctaacagtgccaggtttacatccaagcaatctgtgcacagaactcagacaagctccaggtcatcagctttcccacagagagaataaccatggctttcaggccacgtccttcctggtctgcccacaaggctggacacccagcttctgcgctcatgtctgcaatgcacttccagctctcccctgtgggttctgctcaagggcacgtgtcctcacttgagattatatcacaaaattcagttgggagcttcttttaccctgtgatccctctctgagctcattagctgacttcgccaagggtccctgtgacatgtagtcaggaatggcttccctgagttcacactcctgctgcttctatttgtatatttcactggctcactaaatccattcccactctgcataggatcaaagccttatcttgtggcctgaatttccagattcccagtggggatgtgtgctctggagtggactatctcccctcacaatgtggggctgtgacgttttttgcttgtttcatggagtaggctggtgcccgcttcttcttcaaagtgtatgtggatttttattctttttttggtttttgtgttaagttcctgcatcagttcttgaaaaaaaattcacaatgtaaatctctacatactaatctgtccttcaaagtgggagaggcatgctaacaccgcctcccatctgctatgtggtacttttgtccattttcttagttcttgatgagatctcatagttggcatctgttaccttttgctgcccctgtacttgttttgtcaattgtgttatctctgatttctttgagtagtttttaaatttttcttgtagagatctttcccctccctggctatctatattcctaagtatgatgttcatttactattccaacaatcctagggcccttaagatttaagctacatctacaatgcaagtgttctataaataaagcaagaaatcctagatatttaagtcacatctccttaaataatggtttactgaatattttaagaccactgttaagaagtcctgctcagcaaaagaaaaacaattttttgaaaataggactatgccgggaccagctcggtcggggagatgctaacccagcggcgctagaggaattaaagacacacacacagaaatatagaggtgtgaagtgggaaattaggggtctcacagccttcagagccgagagccctgaacagagatttaccgacatatttattaacagcaagccagtcattagcattgtttctacagatattaaattaactaaaagtatccttatgggaaatgaagggatgggccgaattaaaggaataggttgggctagttaactgcagtaggagcatgtccttaaggcacagatcactcatgctattgtttgtggcttaagaatgcctttaagcagttttctgccctgagtggaccaggtgttccttgccctcattcccctaaacccacgaccctccagtgtgggcgttatggccatcatgaacatgtcacagtgctgcagagattttgtttatggcaagttttggggccagtttatggccagattttggggggctttttcccaacaggactgccttttggcaatgtacctaatctgatagctttcttatagagaggctgaaacagattactgctgtttccgtgcctgctaatacaacgtgcattctgtttcccatgggtcatagagtaattttgatgttcttgttttatggttcaggaaatacatttcataaatatatggctaccatagtgattggtctgaagaatctgtgaaaagaaaattgaaaatcttctgaaaaagatttactattctagatgccattaaaaccattcatgattcgtgacaggagggcaaaacatttacttgaacaggagtttgaaagaagtgaattcaaccctcctggatgacttggaggaatgcaagatttcagtggagaaagtaattgcagatgtggtggaaatagcaagacaactagaattcaaattggagcttgcaagttactgaatgcttgcagtctcatgatgtaattttaacaaaggagaagtgtttcttatggatgagcaagaaaagtggtttggtgaaatggatttcatttcttaggaaaccgttgtaaacactgttggaaaggcagcgaaggattcagaatattacagaagcatagttgataaggccatgacagtgtttgagagaattctctctaatgctatcatgtccccaccatgacacagttgcctaacaaagccattctcagaagatagcccaggcattatgcaacacatgactgtcattggtgacagggaaggagtcacttgtgccattttcaatgttttcctaccaggtttatagctttctatcctttatatccactgttaccattttgtgaggtggcgtgatttttttttaatgacatttggattcccttctcatttcctcttgcgtatattcataattattctctttgtgattgctgtggtgatgatgaaaaactttataaagttatgacaatttactttaaatcaatatgaatttaacttcagtttcatctaaaaccatccacttccccaggttttctccacttcacatagttttggtcagtaattacagcttcctacattgcatacgtattagcttagaattatacttatttctatacatttatatcttaaattgaagtaaaataatgagtagaatccaaaatttcaaaaatacatgtttttatattttaccatatgttcacatttacaagaagtctttataactctatatggctgtaagttactatttcctttcattcaacctgaattcctcccttcagcatttctttgagagaaaaaataggaaaattagtgattggaggtccctataaaattttcttacatctcaagtgtt

SEQ ID NO: 228 - DNA, 41853 bp, Homo sapiens
tttctctgaatcaatctataaataatcaataagaagataattatttagaaaatgaggctccgaaaaatatgttggctttacattttttgcctgtgcaagtaaatataaaaatgtcttttctcacatttcttccatttataaaccgtttttaaaaatcataaattaagacatgtgtgttttaaaagtctcacaacatgcagcattttaaaaattgtcttatgctttactgctccctcccgtaggtaatcactgttacatttctcatttactgcaaaattctctgtgcatatggagcacatagatggatagatagatggggtgtgtgtgtgtatatgaatgtgtatgtgtctttggggtgagtgtgtctatgtgggtgtatgtatgtgtgtctatttgtgtttatttgtgtctctgtgtatgtgtatgcatattacatatgtgtatgcacgtgtgtgtatacagtatatgtgtgtgtgtctgtgtacttgtgtctgtgtatttgtgtgtctgtgagtacatctttgtgtgtatgtctatgtgcccatgtctgtgtatttgtatgtatgtatgtgtgtatttacatatgtgtatgtttgtatatgtatgcatatgtgtatatgtgtgtgtatgtatatacagtatattaagtgtttgaatgtatgtatcatatttatcaaattccacgttgtattaattgttctcacactgctataaatgactacctgacactgggtcatttatgaagaaaagaggtttaattgactcacagttctgcatgggtggggaggcctcaggaaacttacaaccttggcagaaggcaaaggggaagccagcacatcttaacatggccgatcaggagagagagagagggaagcgggtactgtcacacacttttaaaccatcagatctcatgagaactcactatcacgagaacagcaagggggaatctgcccccatgatgcaatcaccttccacctggtccctcccccaacactgggaattacaagtcaacatgagatttgggtggggacataaagccaaaccatatcacacgtcttgctttttcactgaatgtgggaccttggacactttccctatcagcatgtgtggctgcaccacatggatttcagtagtggcagaatattcccttctatagattccacaattcatccaatcagtctttattcttccaatttaaggcaaaacaaattccaatgtaaaagcttaaggccaggcgcagtggcttacacctgtaatcccaacacttcgggaggccaaggtgggcggatcacgaggtcaggagatcgagaccatcctggctaacatggtgaaactccatctctactaaaaatacaaaaaattagctgggcgtggtggcaggcgcctgtagtcccggctactggggaggctgaggcaggagaaaggcgtgaacccggcaagcagagcttgcagtgagccaagattgtgccactgcactccagcctgggcgacagagcaagagtccgtctcaaacaaaacaaaacaaaacaaaaaaacaacttaaattaatattaaaaatagttgttgtttccttccagtggacttaattccaaccaggctggtgaagaagccagttggatagccagtccctgctgaaggtggatggcccctgctcttgtctcccggttatcaggctctcgctgcttttgggccagaggaacagggcgtcctccttgaggctgcgagtcgtccctctgagtgcctctcaccaagggatgaagcagcagccatttggccagagagcagtcactcacccatccttgggtccaggagaggcattgcaggctttaccctcagatctttctttccaaagctccttctcttcaccctgtatccagggcacttggcctgaagagcctttgtcttctggaagcttctgctgccttccctgcccagatccctcagacaaggagctgtaaggcccaactccaggaggaaataaaggaagagggaagaaggagaagcagagagaggagagatgcataaattaatacctccagaagcagccttgctacagacacatcatttgttcctatttttttctctgtgtcacacagtgctataatgcagaggaactgctgcttcgaagggtacgtgcctgcacagtctgagattggcaagttgctatcccctgtgtgtccccatcgagggggacaagaccctttccttccacattctcatgtgtacacgacggggctttaacatttactcatatatataccatcttcttgtcatctagagtttcaattctttcattataaagaatgtggtaattgttcatttgtttacatctttatcatttatattattctcctaaattcttgcccaagacatttgaagcaccctaaaacaagaaggcatatctgggtagttcaaactaagattttatgaaaagatgcaaatcatttacagaaaggacaaatatattctagacatctgagattgaattgttgtaaatttgactatgagctataaaagctgacatataatatcaacaatattattatctaatattatctaatattagatatcatcccataaatgaatgctttcatattattctaaacaaaaaatttagaataaaaacctacaggaaattatcttatagttctaaaatatgggctacctttccaacttaaaaaaaaaaagcacagtggtagtaaagagaagtagagaggaaatggggagttttccatactgaagaatatctgcaatgaagacctgggtacatttttttaaattacaaaactaaaaaaataaaggcatctaatatataattcagtgtgggaaaataaaaacaaattgctagtttaacttaccaatactgtgagcaatttaaaattgttagattccaccaaataattgttaaatgagataagccaggtaaatgtcctagcacaatacctgaagtacggtattctcaataaatttcagttattgtcatttcagtagttacaattattttcaaaagttgtttaatctttttttctttcaatccatgttaattctaactgactcagcttaaaaggaaactacttcaagattgaatttgaactagaaatgggatccccttgtagtgatgtttgagagagcagggattactctccttaaggcttctatttaactaaaattttattggaactggataacatgtggaggtcggtcataatcaatcactgatagacataaatctgcaaagaattcacttgagggggagatgagtgtcttccaccccattcaaggttgccattttccacaaagttcaggcagtggagtgaaatgccacaataatactctattaaatcaacacattggtaatgtgatggcaacacctgtagccatttcagatacaggcagaagctcgcagttattaaagccacatggagagggtacagcaggaaatgaagaaagagggaagaaggagaagcagagagaggagagatgcataatttaatacctccagaagcaaccttgctacagaccatcgtctgtttctattttttttctctgtgtcacacagtgctataatgcagaggaaccactgctttgaagggtatatgcctgcacagtctgagattgacaagtcgctgtcccccgtgtgtccccatcgatgagaaccacatttatggttcttgtggttgcttggacagtctttattttcatcatgagacaaagataaggcagacatttctggtgaaagtctaacagttaagttgtggtaaaagataggatagttggcgttgggcaacttcagtgaaaaagagctccttataatatcataatcttgtcctcagaaactcgtggactattatttgtggctgccttttcatcctttactttagcaacttaccggttgctttctgtgtatgtggggccagtttatgtgagatttgaagaagggattttcctttattgggaatgtctaatgagcacttacaagcagaatttcctcccgatttttttcctctgcactctgaatactggaaagtgttttgagggccttctgacagtacaccacagtgatttttttttctgtcgtaatccatttatgactaaaaaacatgatgctttttgtttttgagatagagtctcgctctgtcacccagggcagagtgcagtggcacagtcttggctcactgcaacctctgcctcccaggttcaagcgattctcctgcctcagcctcctgagtagctgagattacaggcatgcgccaccacgcctggctaatttttgtatttttagtagagacaaggtttcaccatgttggttaggctggtctcgaactcctgaccttgtgatccacccgcctcagccttccaaagtgctgggattacaggcatgagccaacgcatctggccacatgatgctttttttttggttgctcacatgacaagctattatttttgtgtcactttaaacagaacttaaggtatagacttcatgcattccttcttgagccctcttccattacagcagttaaattttgtccagattctgtaaactagtattgctgcctgagtggccgtggtatttcctttgagctgaacttggccattttagcttcttattagacaaaacagtatacttggagtcctggtgaataaccagacaaatggaatttcttgtccacaaagctctagcacagtggttcggcgcagaggcccatgcttccctacttgatcttgtcgtcactggctcagccaaatgctatttctcaaagttcataaatctcacatcctctttgtggagtctttcccctttttgtacatgtataatccccggcctctaagtagtctattcacttctaaagctgttgacttggcaagataacaactgcatcattcacacaagcaaatctgctcttggaggacaaaaagaggtttattttggcttagatgactccgattggccatctccattgaaaccttggcagaagataggtcccttggctactggggagaaaagtcaagtaaacctttagtgccaggaatggtgtttgtaaagattcggcatgaagtggtacatttcgtccttgggcttcttactggcttcaacccaaacagaatcacttagtgctgttccccgggttaatgatgttattagaacaattgactcaaagcaagaactgaaaggctgagtgctttgttgtgaggtgtgcaaaaattcaagtctatcaaaacaggcttagcagagctgccaccagcaggacagcgtttagcttttgtttgctgcttctttgattcttcatgggcagctggcatttctgttgctggtttctactctctcatccctagtggaccctacgttttctcccctgagtgtgcttatctgtccagctgcaaaaaaaaaaaacaaaaggtgtgctgttgtttctgcacttctccctgtcctcatctctcaacatcatatgtgtgcagagaaatcacacttgttgctctgttgtctcaaaaggtctagccctgagtttgctgaggtgatgatgaaggttgtgtgaagctgtgtcaaacactgagaaacatacacacaggctgtagcagatgtgtgttattccctcaatgcatgcaccagtgatggggatttagaatgagccactgtgcaaagatgccccagagagactattccctatacattattattcagtgtaagatacccaataaagcaactagataaagaaatgcctatatctaaacctaaaatattcactcactcccagcgttaacttccctcatccttaagaacaggctatccatggagctaccaaaatgcacttttaaaaagtgtgttcatgctgcacttcatattcatgctcccttttcccttgacaatgtgttatatgttgagaatctttaaataaaactgctcaaccaccaaaaaattatttctccccatttctattcatcagtacttcttatcttgaaggctgatttcaataatcatttatccctcacaacttcatacaatttcttccttttagagtcccactgaatatcatttatatttatcccacgctatttttttattctagtttatattattacttgtgaactttcctaatctcgtctcccaaacacacaaaccctttagctacttccatgggaggctatcttatctattactctccacacccccagccacgggatatgcaggagacactaatggatctagtatatcacacaggaagcagatcaccaggacgacaattacaatcagcaaatcccagtatccactaaagacagtgacaagggtaaaaagacaatagctgagagcgaggtaataagtgttcatgaagaatttcttaagcctcagcatcttagcagctatagcagaatgccataacaaagacaaaagtattttgagtgtgaagttataccatgacatacaaatgcatctgtcaatgaggccgttagaaatcttccagaccaaaggtcccaaacacccaccataaccttctgattcaatagggcacatatggggaaactgtactgttaaaaagcacttctaccaagaaaaggcaaaaaatgtcccctcaccactccttctcaacactgtactggacatcctaactaatataataagacaaaaaaggaactaaaaggtatacaggctgggtgcagtggctcacgcctgtaatcccagcactttgggaggccaaggagggtggatcatgaggtcaggagtttgagaccaccctgaccaacaagatgaaaccccatctctactaaaaacataaaaattagccaggcatagtgatgcatgcctgtaatcccagctactcatgaggctgaggcaggagaatcgctagaacccaggaggcagaggttgctgtgagccgagatcccgccactgcactccagcctgggtgacagagtgagactctgtctaaaaaaaaaaaaaaaaaaaaaaaaaaagatatacagtttgggaagaaaaaaattaaactgtctttgttcacaggtgacattatttgctatcttaatttaatttccaaagaattgatgaaaagcttctgaaactactaagcaattatagcaaggttgcagaagacaagattaatatacaaaaatcaactattttcctatataccagaattcaacaagtggtatttgaaattaaaagcacagtaccatttacattagcacccccgaaaatgaaatacttatgtataaatctaacaaaatacatatgagtcctatataggaaaactacaaaactctgatgaaagatgtaaaaataaataaataaatcgagtgatattccatgttcatgaatacaaggactcaatattgtcaagacatcagctctccccaaactgatctaaacattcagtgtaatctcatcaaaatcttactaaattattttgtggataaactgaatccatagttcatatgaagaagcaaaagacacagaatagataactcaatattgaaggaaaagaacaaagttagaggactcacactacctgacctcaagacttacaataaatctactgcagtaatcaagacagtgtggtatttatgaaacaggcaaatggatcaatggaacaaaatagcacagaaatagatcaccacaaatataataagctgatgtttgacaaaggagcaaaggcaatacactggagaactttcagtcttttcaacaaatgatgttggacatccacatgcaaaaaaataaatccagacacagatctcacactcttcattaaaattaactcaaagtggatcgaaggcctaaatgtaaaacacaacactatgaaacttctagaaaataagagaaaatctagatgatcttgggtttagtgattttttttatttttattttttatattgattactgtgttccaggatattctaatttactaatttttattttaatttttttctgtctagtctctgattttttaattttaatttttatttcaattgttttggggcgacaagtagtgtttggttgcatggaaaagttatttagtggtgatttctgatattctggtgcacccatcaccagagtagtgtacattgtgcccaatgtgtagtcttttatctctcactcccctcccagccttccccctgagtccccgaagtccattatataattcttatgtctttgcaatgacttttaaaatacaacatcaaagggatgagccatgaaagaaataattgataagctcacttcgttaaaataaaaatttttttattttgctaaagacaatgtcaaggaaatgaaaagacaagttacagacagactgggagaaaatatttacaaagacacatctaataaaggactcttatccaaaatacacaaagaactcttaaaatccaacaataagaaaatgaatgacccaaataaaaaatgggcaaaagacctgaaaacacaccttatcaaagatatacagatagcaaagaagcagagtaaaagatgctcaacgtcatagacttatggaatttctgttaaaacaatgaaatagcatgatacacgattgcagtgcagtagagcttcccccaggaatactgttcccagacttgtgcagggctggttccctcactctttgcctttctgtttgcagcataaatgccacttcattgaggtgttgaggattccctcactctgtcccttccgcctctcaccacaagcacctgctttattttactatagcacctgctctttttttttctcatgcatttgcttttatgctctgtccattcattcctacagatggtgagctcctgagggcaaggcccatgcaggtcattttcagcactgcaccctggcctaacttgccccgtgcacaggtgagtgctccaggcacagtttctgaatgaataaatgagagtatcgaagatcccccttcccacctgtgaggagctcacattgaggagatggatgctcacaggagatgcaagttgggtgggaggcagggggacacccagagtgaccctgggagtttctctggctgcagccgccccattgagcagaatgggcagcgcctcccctgatggccagcactgaagacccaggcaaggaacctagaaacaaagccctcatctgggtgtgggtgtcctcaaggcagtaggactcccagggctgaggggggcaatgaagggggagctgtaagctccaggagagataagaggggcgtcggaaggctcccttgacccctctttccctccactggccctgggggagcccagtccactcataaggggggtgtccagtccaccccatccacttccaaacgggggcccgaggctgcaagcaaggacgctcccctctacatgcagggctcggcctcccctgcaccacccaggacccccgctgtcctgcaagccccagccgctctgggccaggacccagggagtggaaggcattttccaagggcacagtggctccctgacggggaaccaaggccaggcacgcttctcccagactgggggcctcggggcacctgagaatggccatccttggtacaagagagcggggacccactcccgcgcaccctgtgccccaggggacgcaggactctgcaccctgaccctagagcttgccctaggatggcccggccatggcgaggccctggaacggtgaagactctctgcccatcaacctagcacctctgccctaccctcagtcgcatatgcacccggtgcgagggagaaggcaaccaggaggtcacacctaaggtgggggcgtgagcggcaatgccagccgattgtaaaaccttccctgctcctgcgtggctctgcaagccaatcgaaaattccgtcgtctatgccgccagccaatcaggatgtccagagcgcggtgcttccagccatttgggactccagctggctctgcgcctccagccaatcggggtgcccgtccttaatacaaccagccagtcagtgcccggcgcgcgacaccagcagccagtcaggaagccctgcgttcatgcttccagccattgtcggagtgtcagccgtcacaaggcacttccagccagtcgcaacggcgggtcgccagcgccgcagtagctcgcgcggtgcctgtcggtagtcgcgtgcggggcggcggggcggcggggcggccggcggcggccatgggagatatcccagccgtgggcctcagctcctggaaggtgacgcggtcgcgggcagggaggcgcgcctgacctaggggagcgcgggacttgggggcgcccgatgggacccaggccggggctggggagaagtgcggcggcctcccctccgcctggccgacgcccgggaaaggcgctgctgaggtggccgcccaccgcccacaagcagcccggcccggcctttcctaaaacggagtcggtgctgcccgccgaggcgctctctgggagaagcgggaacctcggcagccaagcctcagactctggggctgcggccgcggcgttgggcggggctgctctgtggagaggcggagcccttgaagttactcagaactggagcggggatgccgaggggaggccttggcggcgctggactcggccggaacagggaacctcgaagcctcctctccagcaaagagagaaagaaaagttggggccgggcgtggggtgcgggcttgtaatcccagcactttgggaggccgaggcagtaggatcgcctgagctcaggagttcaagaccagccaggtcaacatggcgaaaccctgtttctacaaaaaatgaacaaatcagctgggcttgggggtgcgcgcctgtggtcccagctactcaggaggctgaggtgggaggatcactggagaccaggaagtcgatgctgcagtgagctttgatggcgccactgcactccagccttggggacagagccagaccttgctggaaaaaaaaaaaaaaaaaagaaaaaaggaaaattggaattgctgattaggctttaaaagaaactttgggatctcatgttgttccctgtttagaagcaacctgccctgatgcctgagacatataatcgctctgtgcatttatggggtgcagcgtaatgttttgagccgtgtatacaattgcaatgtggttaaatcaagctaattaacatatctatcacctctctcagttattattgtttgtggtaagatgtttgaaatgtcttgttattttgaaatacacatgtgtagtaaattattgttgactgttggcatcctagtgcgcagtaagtcttaaaagctgtgtctcctgtgtgtttgaaactttgtaccctttgatcagcaactccccattccctccttcctcacctcccccagcccccagcgtcttataaccaccattctattctacgacctttctctgctttgaacttcacaattcctgccagtgatttgagacagcactgactaaaaagcgtttaaaatttgatctttaaaaaaaaaaagctaaacttagttgttgataaaagctataagaagtcatataggaagttagttactgaaggagtcagaatgttcaaggcctgctcatgaaaatattatttaaattatttctcttacctgcttaccaactcttagaggctaggagtgtcgttttgttcatattggttctcagcatctagtgaaggacgtgcatctgtcagcccttcattcagtaagcactcgatggattaaactgttgagtctcttgcttccctttatttctgcaacaatttggtgcaggagtccagactttcgtgcacacaggataaggaaaaattagtgaaaactgtgcttaacaggtcaaaatattctatttatttttcttggactgcaggtgcatcaaattggattaatcataatcactcatcactggtctatgcaaaggcttatttttactcgtctatttttaatagtgaataaacatcacagacctatccgttatctgttgccccagaaatgctgcatcaatggccaaacaccagacctcagtggtgtacagcagcaagtgtattcctcccacacgggaggtcaggagagcagctctgtggaccttggctgggctcagttgggatggttggggctactccacttggctccgcacatctcctgtcctcgtgcggttagttagggagtgttctcaagatgatggctgaagcacaagagagcaaggggagcggtgagatgtctggagacctcagcctgggctcttcattattaggggccacttgatccatctgtgtgcctgatcggtgctgtcttaattactacagttccttgataagcgcccatacctagtagggcaggtcacctctccctgctgttgtagatttacagtgtacaatttgatgagttttgacagatgcatgtacctgggtcctggctttttattttggcaccttactctccactgtaagttttagaactagcttagaaggttccatgagaaactttattggggttttgattggaactacattaaatctgtagaccagcttggagataattgacacctttgtaatgttaaatcttaacttttctacaagcatggtattcttctctgttaataaattgtcctgaatatggttcatttctaacatcttttcatatggttgtatagtttttcctgaagagaatatatgtcttttgttggaattattattgggttcttgatagtgtgttatactactggaaattatatttctctgaagttacattttctacttgtttcacctgctatattcattacacttccagccactttactaaactgtactgttatttctgttaatttgtgttacatttgtttggattttctacacaaatgatcatatcatcagcaaataatggtagtttactttcctttttttccactctttaagcttaaaattgcttcttcttagttgttcaggtgcttctggaaagcacctccagcacagtggccattcttgttttgtacctgattttaaaggatgtaagatggatattttttaatattgatactctttatcagattaattcttttccccgacttactgggagtttagattttgaatctaaactggtattgaatcttaacaaatattgattgagttgacttttgtttttgtactttaatctgttaatattgatgaattacagattttctaatatcaaaccatccttagatatctgagatacactcaacatgggtgtggtatattatcttttcataaatattgttgcatccaatttgcttttattttacttatgaattttgcaacggtattcatgaataagatgaatgtgtgacttttaatatttttgtctgattttgattcagggttatgctagttttgtagaatgagttgagataagtccgtctttttctgttgtttgaaagtctgtgttaaactgagatgatttttttcttgaaaattttatgaaactggtggttttctcttttttttgaattccttgcattctttaataattatgtaactattcaagctttattcttgggttaaatttttctaggaattttcccattttatctcatttttccaagttattgacatatagttattggtaatattttcttttaagtccattttatctgcatgttttactgtccattcgtgtcagttttttaaaaagttggcctcttcatcaacctagccagaagtctgtttattttactgaagtttttcaaagaactgacttctggttttgttgatcttctctgttacatctttgttttctattttattgatgttattcttaatcatatttttatctttccatccaatttcttgggttctttttctaacttaagatggatacttggttcattagctttcaaccactctgaatctgttgcctataaaatgaagataattatgctgctctaactcctagggttaccgtgaagctccagtgagaaagtggtttgtgaactataaagcccttgtcagtcttcagtttaatgagactgcaaacccgcccacccccatagtcttccctagttctagtcccttcccttgcctgagcttcatttagagtgactgttctcttttctgaactaccttattgcttgtagcattatacattcatttaggttttgttatatacttctttttgtatggataccttcgtgtgagtctacacctcagcctttattattggacgctgtggtatctgagtatacaggataaatcttaagcctctttgcatctcagttattattcattctgtacttttttattgctttgatcattcaggaagcataccatctagctcagttttctgcagacactaaaaataacctatagtttttttttcccaaaatatgtaaaggagttggaacttagattattcataaattccttcataactgatattgcctgtttttagactgattatactagtaccaaattagtgacttaattttttatgtattatgttgtccacatgcttgggtgaaaggggagatttgtgttggattcctctgactgtgagaagacactttgttttgttggttttgcaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaaggtagggcttctctatgcaaggctggcagagcttgggtaatgctacatctctggagggctttctactttctttatgggagttgatgactttgtttcatactcaaatcggaataaacaagaatattcacagcttcatgagcatgctgaattatattgtgtgcaggtttgtttcatattatttacttggtcattcaggtaggagtacacagatatcccccaattaacaatacattatcaaaattcagttagtgatgggcactttgactacagtggtgaataggacaaagtcctagccctcatgaagtctgtttacacagcgattcctaaattcagaatcactggggtgattgttaaatgcagattccaaattctaccccacatctgttgaaggagaaactctgggtgtggaggaagcagcttgagcacaggcataaggcaggaagcagcacggcaggtgcaggggtttgtaggaagcttggtgtattagtctgttctcatgctgctgtacgaacatacctgagactgggtagtttataaagaaaaagaggtttaattgactcacagtttcacatagctggggaggcctcacaatcatggcaaaaggcgaaggaggaacaaaggcacgtcttacatggtagcagacaagagaaagtgtacaggggaactgccgtttataaaaccatcagttgtcacgagacttattcactatcaccagaacagcataggaaaaacttgcccccatgattcagttacctcccactgggtccctcccatgacacgtagggattatgggagctacaattcaagatgagatttggctgtggacacaaccaaaccaaatcacttggtctctctggaccacacaatgtcaggttgcaggagtaatgagaagtgaggctgagtggtggataggctaagccatggaagttcagctgtgccctgtcaggagctgtgcttttacctagagacagaggagccctgtttcatttttaaatagggcagcttgtatcatatgtgagtgcaacttgtgttgtatataggatattttagtaggtgaaagaagcttgcatttgaggcagaggcaggaggccaggtaggagacattaacagcagtgcaggtggaagatgatgaaggcctgcactggcacagtgggtgagggagggagaagaggaaatggatgtggagggtattgggagtcaggacctgtggaagatgcagagtggactacgatagtggagaattcaagaattcctttgcttttgatttggaagcagaatgtaagaccatgagatcaggagtcatgggttcatggtctagctgccattcaggagctgtgagtattagggattagatggctcaggctcacagcttcattatttgtaaaatgagactttggatttgagaatttcctgagtaacttcccagctaaagtttcatacctcaagattcaatgttgtttctatagttgaattgccttctgttttactttatggaagttaatgttcttcaggcaccattgctatctgcactagagcagagggtggtaagagagcagccttggtgtgtgcttggccaagcggggagaatgtcttctgaatagtccaggtagggatgtgagcaactggagatttctaaggctcaccctgcaatttggagcaagttgcttctgtgtggatcgtagtcagcagtggaaatatgttcattattttggaaatttggaaaagtcatagaaatgtaattagaaataaataaatcacacatataagcaccacatggagacaactgtgattaacaatggaatacatttacttccagcattcatttttttatttttgtgaagatactgtgctcgtttgttttcatttatttgattcccctttcttttactttcttttactttactttcttttactttactttcatgtttttcccttgctgtgatggagccttcaggttagcttatgtcacagtcaataaaagtaaaatgaggggaaaaacacaagtttttctacataatgagagtgtggaaggagatagctaaaagaagtaaggcagtgtgagctaactcacctataggctaacccacatggttacagtgccttaggaacagagaactcttaatacggagtctgtgtaagtgagaaacacaagatagagattcttctgatttttcgtcatatcttttctgcctgcaggaatttcattttcgtttttgtttttggtcccaatgaatccaaataaccatcaaatatctcttggattcctgagcttcccttgaggaggagtcaggcagaaggatcccagctttggagcctctccctgcaggtgtcctggaactcttctgaggataatgtccctgtcctcccatcagaacttgccgtgttgtatttgtggtcatctcatcttggctattttgggttcaagacagtagctttgtggggctacagaatgggtgccatgctggctctgggtgggcacgtgtgacgctggtcccctctcctttgtagctgtggtgcacctgccataagaagtccttggtggaaacagcatgcagaaagagtctcaaggccttgaagctgaactatttggacctctacctcatacactggcccatgggtttcaaggtaccgttcagtaggtagttcgttctgcagtttgcaggaccttcctccccgtgctcacaccctgtcttgcggtggggagagcatggaccagcattcagggcaggggttcccaggctgcatctgccacatgctagctgcggcatttgggcagtcctcttgatatctctgggcctcagttaaggagaggcttggcttgacctctgaggcccccacaggtctgtctttcaagccagtcgctttttttccaagccaagagagcagtagatttttttcccttaggtttttaggtgaaagcagtgatcagatgaggaaatactgctgctcagagaaagttcccagtgaattcctaggccttgtctcttcttgcaggttctgttctctttggggagtaaatgctgttttgcaatatgggagatatttgcttgttcacctgcagcagggtccagtgggttgtgctggtagttgacttttccacttggttttattctcttaattgcttcacagtgtgtctggagcatgcatctgagccatggctctgtcactaagctaccccagtctggccgtgcaacttccctactctaggcaacctgcttctgcctcacacgggtcctggccaggatgtccctgcatatttgccctgggctgtgatgacagcctgcctgggcaagggcctgatcacacagttgacacctgtgaaatacagaagcccttgcagggatgttcttcctacaatggaatgggtgactgctgctcagcagtcttctacataccaacctgtgagaaggtccctttatgtgtgccacactgttggttactgttttagagtaaaataacaaaaaacacttcattcctagcacagctttacttaactaaggctttgtatctagtttccataaacgatgtgggcagctgtccgttagtgacactgactaagaggggaagatacccagagggcaaaaccagagtgatgtctgtgccttgaaattcattgcatgcagaaaatcataattaaaacaatggctacagctgtattacactcattgccagccagcattgttgtaattatgtacccagaactatgttaggtactttacacatattaactcatttaattctcatgacagttctacaaagttgacactattaacatccctcttggagagatgatgaaactaagatacagaaagtttaaggtttaagttagattattggagcccagaagcatatgctcaggtcagacatttgttacactttccttgccctcatcctttagcagattcctgtctttggatttctgggtcgtagaaaaggaaaaggtctcagatcatccaacaaattacagaagagaataatgcagcatcgtcagcatgtcttctggccagtaggaactgctaggccttgtgtgatgctggacaattagatcagggtccgagtatgagtcccgggctgcaattttgtggaggcttggataaatggcaacatgggatgtggctttaaagtgagactgttagttacttcagctcatcatggaaaatgcctctttcatgtgtatcaggctggaacatgtgacattcttccactgttgtttaggagtgtgattaggtgtcattaaataaacatgcctatgccattcacccttaacatgctacgtgggagtacatgagggaggtagctggattgcacgtcagtgcttctctgaaagatgactttaggttcttgccctttcaagatgtatctctctgccctctacctcctgtgtacctttgtattctcacttccttacctgtcatcatgatggggattctaagaaagaagacaagaccctaacagtggagttaggagagggttgattgggctctataagacatgaagaaaatgcactcctcacccattctttacccgaaattagtaaactattttctggaggcaatgggagaggacaaccttgcatcagtaaggatacagggtcttcctttcccatcttgtgagagatgaacagtgaacatcaggctggcagaggctttgccagccatccagtccaccagccattcatcttttcttagaaaggtgaagactgggcctggtcacatggccaggctggggttgcttagtgacagggctgtggcttggatgcaggtctcctgacacatggttttttttgttttgttttgttttgttttcacacatctcaactctccttcttcgcagcctcctcatccagaatggatcatgagctgcagtgaactttccttctgcctctcacatcctcgagtgcaggacttgcctctggacgagagcaacatggttattcccagtgacacggacttcctggacacgtgggaggtgagctgagccacaccaccaggcagcctcatcctgtgtgggtctccacccaggatgcagtgagccctgagctgcttgtgttcaaagacatcaaggttgtctacctgagatgtggggtttgtggagcaaaaaaggaatcaatacccgaagaactcagagacctcagtgactttcttgttacctttggtttggtatggtgcagttctcttgacacatttgaggggtagctcattatagacctcactttttttctcaaatatttatttatttttttattaaaaaccatatttatttcagaaaatacaggagagttcttctgcattaaactaacattaaaaattttattttcctggcacccagcagtaaccactgttaatgttttatagttcctttttctctcaagcatttcagaatgataaagttggcagcatggaagctcaggctggggaggtgagaccagtgtcggggaaggttaccaagtgtcagcccatttccagggttcagaccaaaaacagccctttactgcaggggcttgcagtaaagacttgagcaggaaattaagggggtggtggatttgagaggttcctggaagttgacccacaggctggggtgggtctcaggcttgggctccagcatggctgaccgagcacgtgtggtcttacagtcttgctaaccatcatgtgggatgggacatcacatttgaggcccaagaagaaagtaagcttaagcttaagcttgctgaggttaggacagagcttgctgggtgaagctctccagggaggaggccagagggaaccctcggacagggaggagtcccaggctaggctccccccatcaatagaagacaaagactgacctaaggtatctgagatgtcaggaccagggcccatgggcctcaactctttctgtcacaatgttttaggtcctaaaagatttgggttaaactctagggtgctcatgtagcaccagcgaggttccggtgattgttgcagagttgaggcagtaactaactgctgcgtgttggcccattggtcactcaggacttgctgctgactacggaccctggcacgaagctatgctcttcctgaagctcaggggcagcctggcttgctggtcagtgaccagctcagagctttaggttgctctgccctaaagtgtcttaaaatagtaagtggagaaggtgggataggagaatggtgatgtatccgtgtgcttaagaaggtcagtgtctcagtggaaagaaaggtgaacaaataaaatccgcagcagacatgcttgccagacatcaggaggaataggaacaagaagagctcacatgtgtcgagtactggacgccagccttagctgacacttcctgtgattccacataacccctaaacatccccgtggcacaggccatgtagacctgtcctgaagctgagaaaattggggccaagtgaggccatgcaacttgcccagcatcctctagccagaaaagatgggactgaaatcagaccttgagtgcagaaatgcttttgaagcttcaagtaaaatattgtaaaaatattgggtccaaccagttttagaataccatacagaactgctgagggacgtagattgtcagtgcagtagacagaagcttcacacccagcagagtcgttctcttataggccatggaggacctggtgatcaccgggctggtgaagaacatcggggtgtcaaacttcaaccatgaacagcttgagaggcttttgaataagcctgggttgaggttcaagccactaaccaaccaggtaagccgatggaagcatcagagagtttaacctgtgtggctggtcccccagctgccacctccacagggctcttctggaaatggaagaatgggtgaagcacaaaacaggcctgttctcctctggcagcactcagaatggtgattaaaggcagcagctaggcaagtggctttcttgaaggtgcatctgggtagatggtactgttggcaggcagggcatgagctggtgcttggccctccatgtgcagtgcaggcaggtcaccaggtgtactcagaagcagtcagggtcctggcaggtgcctcacccttatccaggaacatgggcctcccctctacctcttcccagcctgcagactgcagcaagaaagagtggatgactagatggcttcacgcgaggctcacaggctgctgaaggtgatgcaggcacttcgtttttttaatgcagagaaaagacttgtggggaaataactattgtattttctagactagctttgtatgttcaaagatcatttatacagtacttaagctttttattgaagagtagaagtgcacatgtgaaaatggaactgtataaattctcataaactgagcatagctctgggactagcatccagctcagtaaacagcacgtccagtgcccctgtaacccctgccgagcacagcatcattcccattcccagcagctgggattcacgtctgaactttacacaggtaaaataaaataataatgcaacataaacccctctgtgctcgcctctttcacacagcactgtgtttctgtacatgtgattgtagatagtgctctcttatttcttgtggtattctgttttgtgaattaaccacaattgagttatccattctgctgttaatgggcacttagacagtttccagtttgggactattaagaatagagcatcatgttctatttttttgaataaatatgctttttaaaaaagttctgtatggagtagatgcagaaaagtgtgtgaatcataaaaggcatacatagcttgatgaatttttgcaagtgaacaaactcaagtattcagcacccagaacaagaaaaaagccctcagccattcagtagctcccctgggtcctgttgtagccaccaccatgaagagcaacctggcttctgacccagcttctcatgtagttcagctttgccttgtatacaaccctatatatataagttttgatatatgtttatatggatagtagcttccgttttgtgtcagtatttttagttgttcagcactttaaatacctgggaatgattatggcatagtctgagtagacaaagtggggtggagggtctgctttctgttaggttgatggacaccaggaacacaggatgcggaaggctccagaagggctggcctctcttttggaggctttccaaacaggctgatcttgatgagcttggcatgttcctgagagcaaacgcactattcatagttctctgtaatttacactaaataactatttattttaaatctccttataacctggaattatatgtgagagtttggagaatgtgcaagagacagagatcctgctctctagcttcttaaaattttcattcaagtcacctgtagaatgtatttgtcacatgtagttcctcaatttcattcattcattcagtggatatatttttagcacttcctacatgtctagattgttcttagtgttggtgagacatctatgaacaaaacaaattcaaacaaaaatctctatcttcatgaggcttagatcttggtgacacagaaagacagtgagcaaatatgtaaaatctatgagatgtcagatagtgatagatgctgtagaggaaaataaaggccgggggagatgagagctatggtgtgttaacaatctttatctgagtgctcagggaaggccctgcagagcaggtggtattggaacattcagatgatgtaggtgtccccaaggccgtggactcagagaccatgacacctgctggcctcttggagattgctctgtccagactcctcacaacagaaacacttaggcctggagctgggccccatggctactcggtgacagccaagactttgacgcaggtcttctcttgtagagcttttcttgaacactagtggtctgaattttatgtaagctatgattctgttatagattgagtgccacccatatcttactcagaagaatctgatcagtttttgccaatccagagatgtgtccgtgactgcttaccgtcctcttggtggctcgtggtaaggatacctcagtggtgtgttagtcagagtccgactgggaagtagatgccaccttctcatttccttgggatgactgagggagggcttaatggaggttttgacagggtgtggagggatggtactatagggggctgtccacacctctcaagcctgggattgaaggcatggtttattattggaagccagggagtggctgtgagtgggctgccctgggagggtcaggacctcttcagggacgtaaatcagcctggagtgacccctttgctgagttccccaccagggtgtcagcccccttctgacctcctgacaaggatgctccccaggcctctccatggttggatgaggcaaagcctgctgtcatctttacccaggccctcctgcagctgtactgtgctcccaagatcagctaagagacctccagccattcagccacctaagccagaagcttggaaatcatcccttcccacatcccgagtccaatccagcaccaaaatctattgattattctgccaggagaagttggactttgtttcatgatttcatttctgccatcactgtcactgccttagttaagtagcattcccgaggtcattagaggagcccctcagctccctccctggcccactccattccaatccattgctcccagtgggagctgaaaggagctgtctctttcctttcctatgatcctatcactttcctgggaaaaattcttcaggtcttggtgtggcctgtgagatgcagccagcctgacctctgcctgcctctggcctcattccttcccatccctgtgaacatcctgggcttcagccacatgaagctgctgtggggtccttggatagaacatgttttctcacctctgtgcctttgcaaatactgttctctttacccacaaatcttttttttttaaatctggcaaactccagtttctaatttaaggttcagtccagcatcatcttctccaggaagccctcctgaccccttatttatgtttcttacacagcccttgtcacactgtcttgtgattttcttctcagtcccttccactagtcaaagcaaccagagtgcaggtatcttatttattcttctcttcccagcttctagctcagcacctgggaaacattgggaaccccgaaaaggctgaaattacttgagttttatcacctgtgtgttttccttgtgaagtggggcatgtgtgtttgaacttggaaccagctggagagtctctagaaggctgggtccattccacagctgagctttggggtagcggatcctctgatggagtgagtcagggagctctcagactgactggggtgggcaactgggcactctgtttggttccttcaggagacctcgaggacgatactagcacaatgcctgaaacagggtgatggctcagtacacactcgttaaaaaactgaatcctcagagttctcagggcccacccgtgcctgagcagaggatgcacagggactctatgaccatcttcaaaaccacttttaaaggttccacgtgttcacaatattcactttttagtagtattttgggcgaacttttctgaaagtatcatcatcaacaaatatcgattcgctgtgctgtgccagggtgtacagtagaagctgagaagtcagagagccctgagagtcgggggagtcaaagcttgagagcccactggctgcatgcgctgacatggccacctggtttttgaggagaaacaccaaatacacatgaaaagtgatgtcgtgtagccttgttcaccaaagtgttagcagtggttatctccatactggaaatgtggggcgatgtgcttttctgcattttaaaatttcctgtagtcggcatgtgtcatgatcagaaaataaatctttcattttggacaaagatttcttctttctaaagaaaggggcatccatgttggatctcctggctcactcccctgtactgtgtctctctagtgagggggttgacctgatagacaaccctgtgatcaagaggattgcaaaggagcacggcaagtctcctgctcaggtagggagggagggctgttctgagccaggtggggttctctgaccgctctacatccttggggagtcctggggcttggcaggtcccaggaagggactggctcacccaggtgagtccatgactcattagaacctcccagcgtcaagcagaatttggtctgcagccgcatttctagtcactcaagccatgtactcttgcctccgagcctgtctagactcagaggaggagtttccaggccttctccctctgccccaccaactgcatgcatggttagtatgagatggtacagaaaagttatttattctagtcttctttgttctaatgtccagtggggggctgggcgcatgttaaggaattctcattaagcagattctctgatctcctccttgggctgatggctgtcattaccaacatattgacagagctgctcagtgaatgccagtaacaatagctgctgtcattgattcttggactcttactgcatgataaaactcacatgttagaaaataacttagactacatgggatttccctttgtgtgatagtagactttttgtttccttgcagattttgatccgatttcaaatccagaggaatgtgatagtgatccccggatctatcaccccaagtcacattaaagagaatatccaggtaggtgtattccttcttttatttggcgggtttcagatcatgtgttagatgggaagggatgactgctgtagcatacagcctcagggttgcggagcttgatgcaacaggggcttctccctctgcactgtgggtgttggtggttgaccttccctcagcgatcaaaggacccaggctccttccatcttagggccctttctcccctagggtgttggtgtcttctccatccagcccaagattaggaaggagggaagagcatcttgttgggatgatttgtgtgggccaggctggagcatgtgcaccagtcacatggctgcgctcgcccacaggggaggctggatgtctcctaagcgtgcactcaggagaaaggggaggcagttggtggacaggtcaccacctctgtcgcatggaggcatgcccacgtggcctgagggcactgctttgagttgtgtgggaagattctggtcctgactcctgtctagtgacttctgagaggcaggagtgaagactggaacaggtggagcgtgtgcagaacacagagaggcagcggtccttttcagggcaatcttttcacctaagccaagaaccacagaagtgtgtgaagtgtgtgaaatctatttttggagctatgtgaaggaactctgtgtggcttcaaccctgacgacatagtctgtaacccagtcagggccatggacttgggattcccacagtctcactcacgatttaactgctgcatgacctctctcagcctttgtttcttcagtagagcacccttctgataggatcactgagggtgaaatgtaatgatacagtgaagggatagcatagtgcctggcgtatggaagtacctgatgctcttagctgccagtcaccctcagtcacggatgtcacctgtgatgatctcacaggcaacgacaggcattggtggcagcccacacccattgatcatgtcagcataggtgtgtgtgatcctggggccagctgcacagctgcattttcatagacagcatgtgcccaggagtatgctccctcttggtgtctgagctgcccatgagctccacaaggcactgctgcatcctgagggctcggtttggttgtgccaagcaagcatcgccattggggtttattgacccatctgtaacagtgcctgtgccctcaggcttgctgtgcatgccaagctggctgcaggtgggcatagccctgccattggcaggagaggcaggccacccacgatgggaggaccaggggatgggcaggttcctcatggtgtctacagcactctccctgccgggcccttgtccagctcacctgctgcccgcatgcccttctcctctcctttctcaggcgtcctgctctttgaatggcccagagcagctctgggtgaccagccaaccttaagcctgaaaggtatggatttggctaaactgtaaactcagttctctccaatggctgctgacgggcctcttggaacgagactgcaggtctcttgtagtggttagaattgagcactgctgactgaccggcatctgctccacatggtgtgtccggaattggtgggttcttggtctcactgacttcaggaatgaagccgcggacccttgcggtgagtgttacagttcttaaaggtggtgtgtccggagtttgttccttctgatgttcggatgtgttcggagtttcttccttctggtgggttcatggtctcactggcttaggagtgaaggtgaggacctttgcggtgagtgttacagctcttaaggtggcgcgtctggagttgttcgttcctcccggtgggttcgtggtcttattggcttcaggagtgatgctgcagacctttgcggtgagtgttacagctcataaaggcagtgtggacccaaagagtgagcagcagcaagatctattgcaaagaccgaaacaacaaagcttccgcagtgtggaaggggacgggagtgggttgccagtgctggcttgggcagcctgcttttattctcttatctggccccacccacatcctgctgattggtccattttacagagagccgagtggtctgttttgacagggtgctgattggtgcatttacaatccctgagctagacacaaaggttctccacatccccactagattagctagatacagagtgtcaacacaaaggttctccaagtccccaccagagtagctagatacagagtgtcgattggtgcattcacaaaccgtgagctagacacagggtgctgattggtgtgtttacaaaccgtgagctagatacagagtgccgattggtgtatttacaatcccctagctagacataaaggttttccaagtccccaccagtcaggagcctagctggcttcacccagtggatcccgcacggggccgcaggtgaaggcgcctgccagtcccgggcggtgtgccggcactcctcagcccttgggtggtctatgggacctggtgccatggagcagggggcggtgctcgttggggaggctcctgctgcagaggagcccacggagggtcaggggaggctcaggcatggcgggctgcaggtcccgagccctgccctgcggggaggcagctaaggcctggcgagaaatggagcgcagcgccggtgggccagcactgctgggggacctagcacgccctcctcagccgctggcccgagtgctaagcccctcattgcccagggccagcagggcttgccagccgctccgagtgccgggcccaccaagcccacacccacccggaattcgtgctggcctgcaagcaccacgcgcagccccgattcccaccggcgtctctccctccacacctccccgcaagctgagggagccgactccggcctcggccagcccaggaaggggctcccacagtgcaacggtgggctgaagggctcctcaagtgccgccaaagtgggagcccaggcagaggaggcccggagagctagtgagggttgtgagggctgccagcatgctgtcacccctcaatgggggctgccagcatgctgtcacccctcaatgggggcctggcctaaggtgccctctgtgccctgcagggcagctaggattgcccctgggaggacataggctggggaagattatctgaccctcccatgggaggagccaccgagtgagcagctcagcaggtggcagggggccacatcgccccagttctgcccttctgccgtcgtggctctcaatgcccgggatccccatggcctagcaaaagtgaatgtgacacggggaccttgggcccagctgagatgcccccattcctctgttaggtctgctacacactgaggggaaatgccatcctcaggcagtgagacaggaccaggctgacgtgagacctgagggccaaagccgaagtgatctgatggctgaggacagacagcagcggcgggttaggaggggccggaggaagtgcttatgctgtcaggaggaggtgggagccaggtccacaagactcaccagggaggagaaaggcatccagtgcagggggctgccccggcccgccccctgtggccccagtgccgctcagaactgctgctgcaaggctgcctaccctttataaggagtcttctagaactgcttgctgttccccttaaacccaagaatccgcctaccccggccccagcactccccactacctccagatgacacgctgaggctactttctcctgccctcaggaggggaaggctcttgtggggaagagcctggggtgctccaggtccttgcattggaatcactcagtgcacccctcctcccgccgcaagacagccactctgccaggccggggtggatgctgatgctgtggccatgggtcctgttcctcagtgtgtggggacaacaaaaggggagggaagggctgagaagaatactattttcaaggaagaaaaatggatcactcagaaaatgtactctgtgatatgggtactgttagagttcatagtcccagggccaagtgggtccctagttggcaggtgtatggaacaaattgttttgttggggttttgaggggtagcagagtcagtgggaaaaattctgtgccatccttttttttttttttgagatggagtctcactctgtcatccaagctggagtgcagtggtgcgatctcggctcactgcaacctccacctcctgggttcaagcggttctcctgcctcagcctcctgaatagctgggactagaggcatatgccaccatgtccggctaatttttaaatttttagtagagatggggtttcaccatattggccaggctggtctcaaactcctgacctcgtggtctgcccatcttggcctcccaaagtgctgggattacaggcgtgaaccaccgcgcccagccgctataacttttaacaattcccatatgtcctttattccactaagatgagtgcagtatatatttccatctgtccaaggcttcctaaatgtagccaaggccaagccaacaccagtcacatgatcaaaatcaaagggcatttggggaatccaggctgtgattcagggaagttccaagtgtctgatgaagtgtttgttttacatctttgtgtcccttgcaggtctagcactgtgctatgtaggtaacatgtgctccattaaatgtgaattaaactaagttttctacaaacattgtgttttggttccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaataggtatttatcatacacattttagattaattaaactttctcattataattctttcctgtttgaagatgagccactgaatgaagctaatttcatgcactggggagtttaaaagtatataccatttaaaatgtttctcttaaaaaataatcattctttgttcctatttttgatttgtttttctgtttttcagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaatctgaattttaatttctttttttttttttttttgagacagagtctcactatgtcacccaggctggagtatagtcaagtgatctcagctcactgcaacctccgcctcctgggcttaagtgatcctcctgcctcagccccccaagtagctggttaattcctaaatactagtttttaatacggtcttctgataagtcagattatacctggggaacccccatagcggagatgaaatacagctcactttctcacatctgctcattcagcctgtttagattcatgtatcagaaggaggccctgcagagcatggtgttcacgcccaggcgttggtagagggtgtgggttaatggacttcctgtggtccagacgccatgatccctgtctttgctgtctgctcagtgaatctggcctagctcctgtgccctgggattcataccggatctccagggatataacttctcaactcacaggcccttggctcctattcaaaatgagttaagccagaaagaaattgatgtctactccatggtctcttcccgcttcttgtgtcccccacatcagcctccaaacaagcctctcatttcctcctccctctgcatcaggttcagggaagatatggaggtgttgcccagtggctgaaggggactgtttggggacagttcccctccacatcacttcccattttcactctatcacaagcaggccagctgagtcagaggtgtgggttctgcagataaaagttgtgcttttctagctctgtgatcctgagcagactgcctcacctcccagccttcagtgtccttgtccactcagtggaggaattgcagcacctcccggttgtggagacagcatctggcccaagttatgttctaggaagaatgcattgttactgcgaccagtatcattgccattgcctcattcctcagtttctcatccacctccctgcccagccttccagatgtgcagggatgtgtagaaaccttctagcttggcctcaagagaggactttgctgcgggtgtcaccaaaacgaaaagacatgactggtgcaagagcttcatgggagcctcgccctagtgggggtaggattgagggtggggtgtcatggtttgaccaaatttccagggagagtttaatcagaagactgtttacaaaggactgaggaaatgggagagtctcttgaccttcctacgatcaggccctgtccaccaccatggacctttaatttttccatgttcgtgactccttatcattcattagctgtgtgactttgtgcaaattacttaaccttttaaacctttaaactctttgtcactgtctacctagaggtgttaggattcagtggcatagtgccatgcagcaggtgacacagtcatctgcatgtagcactcttgtgaacacatgcgtgtgtaggtgtgtgacttgtattttatctcccacagagtcaaaaatctaactgctattttgtgaattttccttgtcacttatacttaaaccattgttcattgaccttaaaagtagagagtagaatggtggttaccagaggctggggagggcaggggtggatggctgatgaggagaggttggtcagcaaggacacagttgcagttgggaggaatgagtctcagcgctccattgcacagtagcgtgagttggttaacagtaatacgtcaggtgtctcacgatagctggccaatgaggatccactacgttatttgcatttcatggatttacttccagccggcatgaaaactgagtgaagctggccaccaggtggcgctgggaagcacttaatggtccagtgcatctgcggctcttaacaggagatggcagccttttactgtctttgattttaagacctcttcaactttgtacaatcacagtgaggaaggaaacaatggatagcaaaaataggcaaacactgggcaactgcaaagcttaaaaagtttcacagaagttacgcagcctcgttcttgagcagtatttcccagttcccttttcagatggtaattgataacccggcccctcttgtctgttcattctgagtggagctgacaagccctccccttctttggttccctgcttttctctagggaatgtgacttctgtgtaagttcttccccactctggggcctggagaccaaggtccacagaggaggtgtaaacgtgtgcccttaagggaccctctgcgtcaaatgattgtgggcatctctcctgactttaagactgggagatactcagatactcgtttcagtagctgcttctcctcattggcactttcgtattttatttgaatggaaaatccaaggataagtggtaatcaaaggcttaaaaagctggaaacagattcgggaggtgtggatgggcatcaaatgggcatcaaggagcaagagaccttggggaggatggcagggcctcgctgactgatggcagtttatgtttgattgttttgagaaactgccaactgtttcccaaagtgcacaggcttacagtcgcatcagcaatgtgcgaggttccggtttctccacaccctcgccagcattagttttggtctgcccctgttgttgttacagctgttttagtgggtgttcaatggtgtctcattgtggatttcattacaattccttactgcctaatgatctgagcatcttttcatgtgcttattggccatttgtatgtctttggtgaaatcccccatggcattcctatgagttcactgtgggtgccgcagggtgactatgtgcacaatcttggaactgtgcatttagacactatttattagttcccaactttaatcaatgataaaattcgcattttagcacgtttatttctccatcttttctctttcttccatttctccttttcttcacacagacatctaatatgcaccttaaactttatgtgtctaaaacaatgcttcaagctcaaccccagctctccaacaagctttctttattgttattccttagttataaagatgagggagacttggtcttgcccttaaacacccaagttgaaatgggagaggcacgcatgtggaggcgatcacagaacagtgacatgtgatgcgaccagctctggctgggtttgggcacattttcattttatatcatgaaattgatcaagaccctgtgtcttcattgtgttcctttttcttgttatgcagcatattttcacaggactgaattcttttacgtatccatacactggggcaaatcaactatccagacctaggttagcaacattagatgatgtgacatccaccatactgtggtcattgtcactcccggttggattctgctctgggcagagagggctaatgggcgtgactctaggcccagtttccatagcctggcagtcctcactaggaggctagagctggactggaagcctgtcttcaccaactggtttctggtactttgaacacatggagaacaaggaaaactacaatttttaatgtgcacttctgtcacgtatcgcctctgccacttagaattatatccatgctccaacaccaatccctccctaacattagctagtactaactcgatgctttctgtgtgccaggtactattctataagtatgttacaggttttaactgaatcttcacagaaaggtaggatttaccattatttctgttttataaatgaaataaccaaggaatagagaagttaagtaaattacccgcaaatacccagctagtaaagtgatgtaagtagaatttgactcgggaaatctggcttcagaggctgggcttttaattacataccatgtgggaaacagttaactaggtactctttctcttggaattaatctttttaaactatgtaaataagagggtgagacttttggtgttgattcccgagaagataggacacattccaccccacaggactggcatgtggcccagtgacagtgccagaccctttgaacacacagctccgttccatgtgacgccagtggaaaatcaaacatttcttggcagtattgacgagtatttggatgaaagaaacagaagagctcattaaacctgcaaaactctattccaatggtgaccagcattacttcacctgggaaatcattgaaaaacaattactgtgagactggattggtgagtcacacgagttcaagccattatatgcttaatttacttccagccctgattttaaacagaggcggtatatttaaatcagaaggagatacggaaacagcaatttcttggctagaaaaatcagcatctctagggggaagtggaaaattctcaaagagctgaagagcatgaaaaaggctccttctcttgtcaagatagatcacggccctcattagtgaagaagattctgcaggcacaaagggccctgaacaaatgctgggcaacaacagaaactgtggtgcgattaattcttgtaaaataataagacagaaatagctccatcaatggaaggagaataccgttagctagagactacccaaaggaagagaatctctgaaattaagttagattaagtgggattgagttgtgacagctgcagggacagaccttcaccactgtgccaccccacctggtgtctaatgaatttacgctgaagcaggttaggacagtttgcaagcagaaaatacaacagagatggattggcaaggtctgctggaattgctgctgcttttttattttcattttattttgttgtttttgttctaaaaatattttattcttttttttggcttacacggcagaaatccattttctcacagttttagaggctagaagtctagggtcaaggtgttaacagatttggtttcttctgaggcctctctccaggacttttccttctgtgtcctcacatggtcttccttctgtgtgtgtctgtgaccttgagggatattttaaagctgaagagataaaagaggttgtggggctatgtcttaagacaaaagaacatttaggaaacctcaggaaatgatcagagtgggatagatgttactagaagaaacaaagaaattgaattcaattaggagttagaatcatttacaaagcaatggggaaagtaagcccctaaaaactattgtagcatatagtaaccagagccaaactctcataatatattccccaaggcaaaagaaaaatatttacaagattggcgttgttttatatgtttgcaaacttatttaataagtctggctttgtagatttcatatctgagtctgcattcaatcaaaatgtcttggctaaacttcatgaaaaaaccccagcctcataaattagtagttggaaaaaggaggcatatttagagctttttcagataattgtatttctttgatacattagactggacacacagtagtttgtttaaggttaattgcaatattgcaatgaggaacttgttgccaaaaaaaaaaaaaaaaccaaactctgtaaaatatctgaagagattgattctaagccaaatatgagaaccatgacccatgacacagcctcaggagatcctgaggacatgtgcccattgtggtctggttacagcttagttttatatgttttagggagacataagacaccaatccgtataagtgagatagactttggtttggtctggaaacatggaacaactgaaagtggggacaactgtcagaggcatttaaatcagagcaactccaccttgaataggggctgagtaaaatgagactgagacctattgggctgcattcccagatggttaaggcattctaagtcacaggatgagataggaggtcacacaaaatacaggtcataaagaccttgctgataaaacaggttgcaataaatcccccaaaaccaagatggcgatgagagtgacctctggtcgtcctcaatgctacactcccaccagcgccatggcaatgtcagggagctaccctatagggtctaaaaaggggaggcagaaataatgtactccttgtttagcatatcatcaagaaataaccataaaactgggcagccagcagcccttggggctgttttgtctatggagtagccattcttttactcctttactgtttttttttttttttttttttttttttagacagagtcatgctctgctgccaaggctggagtatagtggcactatctcaactcactgcaaactccacctcccgggttcaagtgattcttctgcctcagcctcccgagtatctgggactacaggtgcatgccaccacatccagctaatttttgtatttctagtagagatggggtttcaccatattgaccaggctggtctttaactcctgacctcatgatctgcccaccttggcctcccaaagtgctgggattataggcatgagccaccgcacctggcctactcctttactttcttaataaacttgctttcactttactctgtggacttgccctgaattcactcgtgcgagatctaagaaccctctcttggggtcttcttccagaccctttgctgtaacatctttcttgtgaccactgaagggactatagtgaggaaccccccgccccgacccagaggctaactttgggtaagtggtgggtggggtccagtaacatttttctcatgaaccacaaaagggctgatactgaggagacctcccacccaaaggaaatagactacagcagtgatcagcggactttgggtaagtggggtgtgtatacccaggtaaagaatgggatttggtagcaggcctaacttaggggagttagggtctctcctaagacagagtaggttagaggcccctcttcataaaaggcaaggacacttgactgaccttgggttagaggcccaactaaggagggttagaggcccctctgggtaaagtctctttcggctaagaatgggtttggcactatgggatgttaactgctattgtctttggaataatctgccttgccctctttgctgatggctatgggtgacaggattagacatgtacaggatcatgggacatggggagctttttcctccctaagaagggaaacttgagagctgatgggactgctggaaaagatcgcttcatgaccacaagttgccacctgaacttttcagtgtagctgcctttgggtgggtctttctctgtcctccctgagcaccttgcctttcccaccctgcctcaggcagtgcttcaccatccctgcaaatgggttgaatgaatggtaaaaataactgtttatcttctcttctttgtaaagtgttgattaatggaaaaaaggatttgtgaggctagtcataagttggggcaaatctgatgtgctttgtgtgtctttctgtattgttctgtcataaggaggagtatcttagaatagaatatgggcttaggacagctatacacctgctgttcaagatggccaagcagacgtgtcagttataaactttgctgcaggtcccagaaaaaaaccggatgaggtttcccccttgtcttgtgtgtccttgcgagcttgaccttgtaaccatgtggcagtactttctcttggtttctgccatcacaatggcagcccaggttcaggtccaattcctggcttagggaatgagtcctttatcttctctctgtctgtatttgtatgtgttgtgcatgtaatgtttacatacgaaagagctttaatttattggcttaaaaagaataagagcttaaatcaaacattttgtcagaaaaataaaaagtgtaatgccttttagttcatgtgacttaagtaatctttgggaaataaagacagttttaaagattattggtaaaataaatacatttggtctaaattaggcaggtcaaatattaggtttgctaaatgctttaagggcataaactgcttcttagacttttgaaaattgttcaatttacctagttcggagcattcgattctagataaggcctggggacatgtggagagccatgccccctagctgtgcaggaaacagtcagcccttacctgaacttctgtctgctgtcctagcctgcacacctagtacaaaattaaaatcccaaacttaccaaggtttttcaccaaaagtaaaagtcgcttagagttaacagtgtaacatatatttgagactactggagaaactgttctacatgcaaggtatgtaaagaaagtagaatatgtttttggtaaaagactataagaagtcatgggaatgtagatttttctgctaaagggttaaataattgtcttaagttagagtaaagctgaaggtttaagctagtcgtggaaggtttgtgaaaaattaatcctgtaaaagaaattctgtttgtgaacatattggctaaagttaaaggggtattatctagctttttgtagactgaatattggaataaaagcacaacaggtttttcttagagcaaaaacctgcttatgacctgctctttaacaaaaattataaagggttataaaagctttataagaatcttaccttatggtcaaagtgaatacgattggatacatttatctataaggttttattaagaattaggtctgacatcaataatgcactaatgcaacagtgacagttgacttatttggtataaaagtcatacaggaagcattgtcaaatatgaaatggtgtttgattttctttcaggtgtgtttgtataaatgtattattagtatatgttccaaaattatgggaaactgctataattctgatatgacttagtgtatgttattaatacactagttgttacataaaatcattccatggcacagaggtaaccaaatttctttgtcaattatgtttttgactgtaactgtcctgagacttttgtcatccatggacaatttttgccttgttttggtcctctttagaagatggtttataatcaactgtagaactctactgttcggtggtattaagtacattcacattgttgtgcaaccatcaccatcatccacttccagagtattttcatcttctccagctgaaactctctacttattaaacaataactccccattccctcctcctccaacccctggcaaccacaagtctactttcttgatctatacatttgactcctctagggacctcatataggtagaatcacacaatatttgcctttttatgcctggcttatttcacttaccatattgttttcaagactcatccataattcattagttcacattgcgtggctgtaccaaaacatcttatgtaccctgatatggtttggatctgtttccccacccaaatctcatgttcaattgtaatccccagtgttggaggtaaaacctggtgggaggtgattggatcatggggttggagttctcatgaatggtttaacaccatcccccacttggtactgtatagtgaatgagttctcataagatctagttatctaaaagtgtgtagtaccccccacacacacatcttctctgtcttcctcatgctccaacaatgtgaagtgcccctccctctttcccatctgccatgattgtaagtttcctgaagcttccccagaagttgagcagatgccagcatcatgctttctatacagcctgtggaactgtgagccagttaaacctcttttctttgtaaattacccagtctcaggtatttctttatagcaatgcaagaacagactaatacgtactccataaatatatatacccgctatatgcccacagaaattaaaaataaaaataaaaatttttaaaaagattcatccatgattcagtattggtaggttatgtgtttctatggatttgttcattttatctaggttatctaacttgctggcatacaactttttacactactctctcatacttttttttatttaaatgagtttttaaatttctgatttcagttgagtcttatcattttttaattttcttagtaaagcaagctaaatgtttttcaattttgttgaccttttttgaagaaccaactcattgtttcattgttgtttatttctacctttgtaaatattttctattttatatatctcttctcttgtctttattatttccttccttctgttagattcggtttcgttctttttctagttccttagga

SEQ ID NO: 229 - DNA, 267716 bp, Homo sapiens
aatgatatctaagctagtctttaccacagtttaattcttacaataatactccaaaggagatataatcaaccacatttcacagatgagagagttggaatcttaaaaaggttaaactcttcgaggtcatttgacgaataaataatggagcctggatttcaactgaagtctaacaaattccaaaatcctggctaccggccatttatattcgtgtgtgtgtgtatatatatatatataaattatataacatatatacatatatcatatgtatatatattatatatatttctttttaagttataaagtataagagaccatgaagaaaatttcagaaagattttagaaactcaagggtcactctcagctgccagtaagaaaacaacctaagatactgttgaatagtattcattcagttaattatggtggacctcaaaaagtcataggaatttcctctagcactgttaagtaaatagttaatggccttttattaaaagactaatttttaaagtcatagcagaaattcttgatccattaaatgatagcaaataccctttgagtgtcaaacattgtatatatttattcttttcttgcaagcagaaaataggtgttacttatccccatttttcagatgaaattgaagcttacagagaggttaaataactcctcgaggtcacctagctaataaacagcacaccaagaatttgaaccaaacagacaagtctccagagcctgtaccataagggaactgcttggctgtttatgattcagggattaatttctgtcttcatgaagctgctgcattttgatacaaaatgttatatttccgatttgatttcaactcccagcttcatgctttaaaagaagtagtgttttgactgcatttagttatttgtacaaacctgtagcaccccctcctggccattcgaggtataccatacatgttatattaccccaatattagaccccaacgaatggcaaagacttcgtataacgaatggaaaggtccccaaatgcaaggcaggttccaactgcacaccttatgtgcttgatagttttaggcaagagactccttcttgcagggctgtcatttcccccgcctcaaaatcagaggagtgggtgatgtttttggtctcttctagttctaattgtgattctgaattgaattgataaactggatattgaaggaataggtgtggtgaaatgaaaaatggaagcttctagtttttattttgatccaacaataatgcatgttatttgcttcctcttgactcaacattgctctaggaaaagcctattctatatagactccttaacaaaaacattgattcctaaaggtcttctgaatgtttggatagccaatggctttgcagcccagcctggccactacatgaggccgatgactttaacaaacttatttcaggccagtgtaaatgcagtgttcaaaaatcccacctaagaaggatgggaacacggaggtttgtgtaggtaacatgcaggtgtgtgcacatgtacccaagaatgcacacacacatacatggacacaactgcaattgatacaaaaggctgaactgtgctgattcttacaggtacttggttctggcccagtctggaaaaaaagaaaagatccttagtctaaacatgcatacaaaatagaattcccaccatgctttgatgttatctatttataattttcaatgtttcaatgttttgtggtcttaaaaattacaaggattattatcaataatccttgtacctaatgtgccttgactctgaaggacatggtaactgcctgtggtttagaaaatgttttggctaaaagacaagttctcctccctcctctcatttttatatcacagagctgcacgggggcttggatcaatgcctgaatccagtgttcctgagtgcagagcatctttgctctgggtgagctttgaccatcctggagaagaaggctgctgcgggggtgggacaaagccaagaccaatgcccagcggccaaggccagccagatggctctgtgctggcagccagtgtacacggattttacctgaaggaaaatgtcacattttccacagacaactgaagaaagagagctctttggattaccctaattgtgatttactcattggaaccactgttttggattgtccaaaattaagtctcaaagcttaaatatgaggcttcagggagttatcctgaaatcagtgcttggtatcttcttgttttttgcttgttttttaaaaccttaattctcatatttttctgtcatatttctcagtgcctggtacattatcaccattaatccatgccagttatgtacagttttgcatgtttgttttttattttactcttttctctccttcattccctattcctgttcccccataggtgcccagtctaatgtatttgatatctgtccttagagcctccgtatctgtgaagactagagtcatgcacttcatcacatttcagtaacgatgggccgcatgtaccacagtcccatgagatgatagaggtgcagaaaaattcctgtcatctagtgacatcgtagccatcataacatcacaacacgactctcatttgtggtgaccctggtgtacacaaacctactgtactgccagttgtataaaagtctagcacatccagctacgcacagtacatacttgaaaattataataaatgaccatgttactggtttatgtaattactatattatactttttaatcattattttagagtgtacaacttctacttgtaaaaaaaaaaaaagttaactgtaaaacagcctcaggcaggcccttcagtaggaattccagaagaaggcactgttgtcctaggagatgacagctccatgtgtgttactgccctgatgaccctccgtgggtacaagatgtggagctggactacagtgatattgaagatctcgaccctgtaggcctaggctaatgtgtggctgtgtcttgatttttagcaaaaatgttttaaaagtgaaaatgttaaaaatagaaaacagtttatagaataaggatataaagaaaatattttgtacagctgtataatttttttttgtttttcttttcctttttcttttttttttttgagacggagtcttgctctgtcgcccagctggagtgcagtggtgtgatctcggctcactgcaacctctgcctcctggggtcaagcgactcttctgcctcagcctcctgagtggctgggactaccggcaagtgccaccatgcctggctaatttttgtattttttgtggagattttcaccatcttggccaggctggtcttgaactcctgacctggtgatccacccgccttggcctcccaaagtggtggggttacaggcgtgaactacagggcctggcctgtttgtgttttaagctaagtgttgttaggagtcaaaaagttaaaaaataaaagttgctaaagtaaaaaagttacagtcagcaaaagctaatttattaatgaagaaagaaatgtatgttttgatcaatttagtgtagcctaagtgtccagtgtttatagtctacaggagtgtacaggaacgtcctaggtcttcacatcctctcaccactcactcattgactcactcacccagagtagcttccagacctgcaagctccattcatggtaactcccctatacaggtgttacagtacttaaaattttatatcctatttttactgtaggttgtctctgtctagatatatttggatacacacatacttaccaatgtgttacagttgcctgcagcactcagtacagtaacatgctgcacagctttgtaacctagaaacaacaggctacacctatagcctctgtgtagtaggctgtgccatctgggtttgtgttctacaacgttgcattctacaatgttcacacaaggatgaaatcgcctaaggacacatttctcagaatgcttcctcattgtcaagcaatgcatgactgtatatagaattgttcataaatactgtgtttttcatccatgtaaatggcatgccatttctacctatccacgtctgcacaccagctcatgcccctcattcatgctcctttctgctgctcaccgctccacagctggcagcccctgcattccatccatccattcccccaaacatgggcatgttgctatcagcagggagctgtgatggacccctcacagggtcctcttattcctcgtgcaagcctttccctgggaagttcctcccagcattgctggtcagggggaacacacactcacatcttcactaaatgctaccagtgctatggtgttatcagaaactttatttatttattttttgccaatatgatagctatcaagctaccccatctctactaaaaatacaaaattaggcctttagtagaaaccctgtctctagtaaaaatacaaaaattagctgggcatggtggcacacacctgtaataccagctacttggtggctgaggcaggagaattgcttgaacccaggaggcagaagctgcagtgagccaagatcgcaccactgcactctagcctgggcaacagagaacctgtcttaaaaacaaaaacaaaaaaaatggcacaggtctgattattaggaagctgaggttcttttttatacttagtattcactgaagtgtgaattacctttcatgtcctctaaacataccaacaaggaggctggagttaggacttatgttagagccagcctgcctggggcacagcctggccctgccatttattgactgtgtgactttgagaaagcttcctcatgtaactctatcttagcttccctgcctgtaataagtaaaaacagcaactacctcatagatttgtaaagattacataaaataatacatgcaatgcatggcaaacgacagtcaacgaatgttattattatattaactattgccatattataaatataaataaatataaatgatataaacaaactaataatagtaattattcatttattcttgacttgaatgagatccttgtgtactttagacatttatcctttgtgaatttgggatggtacaaatatcttaggcaagtctatcatctgtctaccaactaactatctcaaatatcttttcattaaatataaattcttaattttggagtcaaactctttttttttttttttttttgcccatatactttgggtgtttccgagtctcatttaagaaaactttcccctctccaatatcacagaagtattttgcattttcttctcacactcagtttcaaattttattccatgttgatcctgggattagggtttctggacttccctgaactaatcgttcaatcagcctcttgttcgttcactcagcacacaagtatacaagatccagaagtgaatacagcatgcagagaaggttggagacagtgtgcctcttggtaggggaaatgaagggctagggagtatcatatttactctaaatgtggaaagaatgtagaaggatgagaggacgggggattttgaggatacagggcttggactacgcctgggggatgggattagaggccaacaggagaggggaaggcatcccaggagaggggttttgcaaaacggcaagaaaggtgtatagctgagggggagaaggcgggtggggtgctgaggagacgcctctgaagcaggcagtggatgaatactggggaagaggtgaagttcagctctgaagaccaagcagaggctcctggatctggtatgacatgcagcagatattcatcatttgtgtatgtgtttctgagagggagaggcgaggagggagtggggacctgttgggtacttaaaatgggtgggcagtagggtacgaggaagacaagaagtcaggtggcaagggagacaacaaggatccaatttgtcttctctgtcagtgtgaagaacagaaccccgactagattaaagtgcaaggttgtatgttttgcagggaaatcatagcaggtgccccaaatctggaaaatgatgcacaaaggaagctcccaagtcttcaggcccaagattctgaagaatggaggagcccctcagtgacgcaccatggaggggtttggaaggaagtccctcaagcgtgaagtctaaatcttatgaatgcggtccccatgtacagtaactgacacttagctggtgcttgatatattttaatgaacaaatgaacatgtggacttggaagcaataattggacactccaaaggcaacattccttggacaactggaacacaaattgaaggacaggtcgctattgccccaccccacttccagcaaccacaggaaggaggaaaaaaaattaggaacagtaacagagaaggaacaacaagagaggtaagaaaacaaggaaagttcgtatcttggaatcttgggggagaattggaagtttggtggcatctccaaatgccacagacagcactttgtgatcactggtagggttttggagagcagagcataatgacacagagtttaatatttactggtgggagagggtgtagggtatcagccatgtggcaaggtgcgtatggacaaggcactcctgggctggactggttttacagggcatcagagtgcagcagggagggaaataagcatgcaattctgacccaaccctcaagaatcaaacaacctgagtgtttgacctgagatcggggggactgggaattaactggattttaggaaacaaagataaaatttagatttctttggaaagagcttcagggtacctacctggccttcctctcaatttgcatagatgtaagggttatgtctcaaatatcttttaagtggaaaaagtcactatttgctgctgcttgttaagtgatccttaaaaggtattaccaatgagtcacaaaatatttggatggaatattaagcttattcgcgcatggtttatttggctttatgaacaacttatcaaccccctactgtgtgccttgaagaacgctgcccgtgaacatccaggcggtctcctcctggtgattcaggacaggatcatcatcaaacagggatgcacctgcagggctcaaagatgaacaaaaccacctggatctccattttctaagtcttccaagagaatattggtcattgtcttctctgtgctgttaccaaatgtccgattccatttactgaagtcctaggaaagtctcacaccaggaagacggtagctacagcactgtgtagaaaagctgtgcgatctgctcatctccaagttctgacacgtttgtaaggtttttagttgagttccaagtaaaaaccagaaggcagctgttagttgggctcctttgaaaagaggagtagagtcctatcaaggccaatccattggccagtctatttctaaggcttcaaggtgttcagccatgcaattttgcatggaataaagcactgagcttccgccatctttaaactcattgagttctcataacttttgtagtttcccgaaggcattttctttaatgggccatctgaatgggccatggggtcatgctgggattgttccaatgacctggttagaggcttctttatgtaagaaaagagggctcagaattctaaacgtgcacactccactgggcagcctaagatgtgatggatatggttttctggctgactccaaagccaccccagctttgtcaggaagagcaggcgtggtggaagcaatgcaacagcatggtatgggagcttttacctgtcccaggggccctggctaccctgagatagtgttaaaaattgaaattgctggccaggtgcggtggctcacacctgtaatcctagcactttgggaggctgaggccgatggatcactaggtcaagttatcaagaccatcctggccaacatggtgaaaccctgtctctactaaaaatacaaaaatcagccaggcatggtggcacgcacccgtagtcccagctatttgggaggctgaggcaggagaattgcttgaacctgggaggcagaggttgcagtaggctgagatcattctactgcactccagtctggcgacagagcgagactctgtctcaaaaaaaaaaaattcaaattgccaggcaattttactttgcaattatatgcatcacacaggtttacatgagtgactatttgtcatattggtaggaatgccaggtaggtgtatgtttaataagaactactggctttctttccaaacagttctgactcataactatttgaaggtctgcatgacattgggtttctaagaagaatcttaaatcatggagaggaagctcagaaaggaccaaggcctgactgggtgtggtggctcacgcctgtaattccagcactttgggaggctgaggtgggcagatcatgtggtcaggagatcgagatcatcctggctaacacagtgaaaccccatctctactaaaaaatacaaaaaaaattagccgggtgcggtggcgggcacctgtactcccagctacttgggaggctgaggcaggagaatggtgtgaacccgggaggcggagcttgcagtgagccgagatcacgccactgcactccagcctgggcaacagagcaagactccgtttaaaaaaaaaaaaaatgaaaggaccaaggcctggttcaaggccatttgggatacaatacaaacttgccattatatgactgggtgatgtgcctaggatgggttggtggtgtgagaacttgaacggaataactgagaaagagaagtggaaagaactttacactagtaatcccagaaagtccttgaaactaacattccttagaaaatccactgaaatggaaaacaatgttcactccacattcaaggacatttctggggaatgccaccaccacacgcccatcccctccatctccttcattttcaatgcattaggaattcttggattttggcaattcctgaaacaaacaaacaaaaaatctgataactcttatttagtgtaaaaaaaaatccaaaggcattttaaaaaacaggactaaatagctaattaaaatcacgtcatttcagaagaacttgttacattcatctaggaacattcatctagggctacagttatctgggccatgtcctggcaaactgtacactgtgagcagccactgtgggcaggagggtgaaaggaatttaagaatgattcatcacatcttctgctccaggagatgtggcaagccaattatctttgcagaacattaggtgcattttattattagagcgaatttttcagtcttggcttttaacatcctgtgtgtactctactgtcaggagtggctttctattacgaatcttacattgctgcattccacttgctgaattatcagtcatgctcctgggcagtgacatttgcttttcttgcactagaatagcattcatgatgacccagcttctctgtatattagcccctggaaaaatcttggctcaaaaacagttatttccctattcacacttaaaacaacaaagtcagtaatacaccaggaagattcaaaccatgaatcaggaatacatactaaatctaaaagtctaataatatacattcttgatcagcctatgttgtataaagaattatattagcagaaaagagtccaaatcaactaaaaggatttgcgttaagaattctcttttggaaataatggccaagtgaattcacttttctattccaactgatctaatttttatgtacctacgaacataaacatgccaaaaaggaaagtgaccagaaaatgaagctggtgtgagaagaaattgctgattatgaaggtcgtaagattatcagtgattcacggactgggagtctacagccggcacctttaagggctctccgttggcagctgttattggtgctgcagtaattgctggatgtcagggaacaccgagtgaccagcaatgactggaatgaaagaagtggggaggtgcggtgggggcgtggagtgcaacctagtggaagaacaagcatatttctgcacaaataacaactccaataccaactgtttcaagcagagtatccgactggaacaaaatttccaaaaaaaaaaaaaaaaagactcatcaaaaggaattagggtaatcgttgaagattaccaaaggtttatttggaatgacacagcactgaaaacataattgttacagatgatttgtggatacagcatacaccatctattttactttagaacaatctgtgaagatgagttgcataaatagaaagaggtggaaatatagaggagctgtttttatagtgttcttttgggggtagatgaatatgccccatctttctacccaatctcataaaggcagaagagaagactgcttagctgcccatcccaactagcctacctccagccacagcggctggacagctagataaatcaggccctgccttctctgagggtgcctcagtgtagtcgtgctatctgtcatctcatcctgaaaactgcacagtacaaacacagatactgttgactcttttgccaatgggatggctggttttgccattaggcaaaactgcaattgtaatgccagacagaataagagcaatgcatgtatcaatgacaattgagaggcaaagagctacaatggaaaggaaagaagcaactatgtatatgtagccttctgcatacacatagatccaggagtcatgggaactagcttgcgtgactgtgtgtccatatatatatagatgtgttggaaaagaacattgagaacttttgcagcagtttagttttaaacatagtaaacctgaaagggagcgagagcacgtgctcacacctgggcaggggaataagataatcttgtactacaggataattcatcacatcttctgcagggcagccactcaatacgatacacctgatgcagagaaattaaagtctgatctggagaaagctactttagaattggtgggaggggatcaagtacaagagtctccacagcttggacaaagcacaaacaaacctgttattgacaacatgggaatgagtgaggattttttccttaatttactttttttcctcttacatttttttgcacacatgctccattgatacatcttcccaaggtttgtctggcatcagtctgtaaatcattaagagcataataacaaaagtgaactcttcaggttttcatgaaggtttaaaaaccccgtaactgagctccttcttgcagtacttgttgccctaatctaagcgtcgggtgaagttctctggaaagaggcctttgtaggtggcaaggtctctgtactgaagccagtctgattccttcactcccaccagccagcctgcatcctgaaaaacaatgacagaactttcagggtccagcaaactactggaaaatccacactgccacaattaattaataatgtgttacattagtgttgtggttctgaaccaggatgtcacattacaggtaaagtgctgtgccgtgatcaatgggaaggcctatcccaaataagttgttagttaaaaaaaaaaagaaaaagaaaaagaaggaataaacatttgcaatgacttattgactgtataaagtatagctaatgctttgtacattgtgactgtacaaagcatagttaattgatattaactggattataatatgagttcttaaagaggagaaaaggattacaattacaaccagtgcaaagacaggaataccatgtgaaagcatttcatgcacaagagcatgacctgttctggggtcacagtgtaaaaaaggtttgaggttgcttgggttagaatggaatactgatgaggccatggaatatcttatatttcatcccaagccacttgctcataagaaagaactctgacccccagctcatatcctataaccccaataaactacctatgtagatgtagggctcatcaaatactaaaagctagatgtgtgttgccttatattactatttttgtttttataatacctaatttttcaagtttatataaactacaaagcagttggatgtcatggcattcttgctggaagcgctcctatatcctttataaattattcctcataaacatttgtctgtcatatagaagtgccatcacaaaaatgaaacagtttgccccagaaagggtaaagaacccatccatatatggtcatgcagaatgggagatgatacttaaaactgagaaacagaggctgtggtctgcccttggcttcctgaagttaagcagagtctagctggaaaagctgtgttgaaaggaacagtgggaaatgagaccataggaagtgcaaggagtgggaaatgactatctttattatgttaaccagtgcagaaaggaaattccagttcagatgagggatggccaggtttagtctgaacaaacccccaacatagttcaagtatatcagataaaatgaggcctcaaaaattaaatgaagaagctgaattcattcccttttgatataatctgagactctaaattgatgctgccatatagacaagaaatataagtatttagacagcccaatttttgaaggcaggaaaaaaaccgctgaggaaaaaaacgactcaataaaataactgataatatcctagctgatgaggaaaagtgccctctttaaaattatgatgtcatatatgtgaaggacaaagctatgcttaaaataaaagatgatagctaaatattttctgaagctctagaaagcatataaaaggtcatttttcccccacaagtgtctatatttgactttatttacagtaggtgaaaaatctaatggagccaagtagagttaagcacttaaaaattgtttcaataaagaaaacaagtaaaggactacacaaacccacaatcaagatatattccaacacatataatctgaaagacaacttgtaaagaatattagccaacatcaatctttagctgaggaaaatataaaaaattaaatattaactgcttaaaatatgtggtagaaaaagatttcctgtcttggtaatggtagaatggcttgtattagacaactccttctggagagaataattaaaaacattggaataactatatatctccaaatatctatatatacacatatgcaactatttatataaacaaacaactcttggttatacaatatataaagtgtaaatttatatataatgggatgggtataaataatgggtaaaactatttgaagatgctggaaatgaccaaaaggaggcagaaattagaaagtatttgacccttgaaagtagagaactgcaaggggtgagatctatgctgatacagcttttcccctgaggattatcctcactcagtgtgatgtggggcattcacagcatagagtgtaaggctcccagagaagctgtacactcaggggggttatcttgaaaagaaaggaatcactgggggatgggtatcctaacgtatgtggataaactgccttgaaatcctgggctgacccccaagctgtgcatgcataaagggtacagacccaccctaacaaagtataaaaccaactcccatcaattcaagggaattatccagtaatttatatgtctgctaaaacaaaaataagcaattttcagatatagaaaacagagtcagactctttaccacgtatggtctacctactatgtctagtatcaattaaaaaattattagacatggaaaaacaggaaaatatgaccaaaagattaaaaagcaaacaatagaaatatgccctgagatggcccagctgttggaattagcagtaagaaatttaaggcagctattataaatttgttcaagtatataaattgagagacagtaataatgaaagactataagtgggaaatctcagccaagaaatggaaacccatatgaaataacaatatggaaatgaagaattgtaagaatctaatatctgagatgaaaaagtcactggataaatttaactacgaactcaaagtagcagaggaaacactcatagcacttgaaggcagatcaatagaaattatccaacctgactaccagagagaaatagtgaaagaaaaagaacagcatcttagctatcaagaagtccaacttaagtataattagaaacccagaaaaaaagaacaaagagaataattcagaaaaaaattaaagataaaaagcaaatgtagtgaaaaacattaggttacaagtctaaggatctcagtgattttcaagtatgaagaccataaaaaaaaaaaacctacccaagcacaatatatttaaactgatgaaaatcaaagatacagcgaaatttattaaaagtagtcagggaaagtcactttgcatacagagaagcaatattaaacaaatgacagctgatttctaattataaacaatagagaccagaaaacaatgaaacatgtttaaagagttgaaagaaaaaaaaatcaactcagatttctaccttagtgaaagtattgttaaaaattaagaataataaagacattttcagatatacagaagccaagaagatttgctgccagcagactagcacttcagaaatagctaaaggaagttctttaagcagaaaggaaattaagaccagatagaaactcggacttaaggaaagaatgaagacctggaaatggtaaacatggtggtaaacataaaagactaactttttttccttttatttctttacaaaataacttctggttaatgcagacaaaaatcccattataaatgggatttttaatatctttgagatgtgtgatgctgacaccttttctttgtattggtaatttatgctttgtgacttttctttcttgagtatttctaaggttttaataattttgttaatcctctcaaaaacctactttcggctttatcaattttatctgttatagtcctttattgcattcatttgtgaatttatttttattattttcttccttctatgcatttttctatttaatttctatttaatgatcattatgaaatttttttttaactcacactatgatttatttgacccatgggttatttagaagtgtattttaaaatttttaaatctttgggggcttttaaagatatattattgttattaattttttgttttttgagacggggtcttgctctgttacccaggctggagtgcagtggtgtgatcatggctcactgcagccttgaattcctgggctcaagtgatcctcccatgtcagctttttgagtagctaggactacaggtgcacactgctgcacccagctaattaaaaaaaaaattttttgtagagatgaggtcttgctatgttgaccaggctggtctggaactcctggcctcaagtgatcctcctgccttggcctcccaaagtcctgggattacaggcatgagccaccctgcccagcagattattgttatataaatttccaatctattttattgtggtagagactgcttgacccaacacctgatgtatcttggtaagtgtgttgtcaaaagaaagaacaaaatgttgaacatattaagtcttaacctcaaaggcagtgatgcttgaatttattttttaaggggagagctcataaatctctttgagaatagtatggaagttagagtttttctctccagaaaaatatgtttacagatgcatttacttgctctgcataccatttcaagggctcacatattttatgaatgagaacaagatgggagttctcagtaccttacatcagaccactcttttaggaagtgatatttttaaagaatctctttaagttgaggtataacttaaatactgtgtaatgcagagatgattaggtatatatagttcaatgagttttgacaaatacatgcagacatccctctcaagatacaaagcatttccatcactccagagggttccccaggttctttcctcatcaatatccacacacccagaggcaaccacttttgaaggggtcttttagttcacattcatagtgtctgcatttcctgaagacaggtgttacagagataacattcccagaaagtggttacgtgataagaaacagtcaactgtttgtattatataaaaaaagaatgcaacagcatcccaaaagggtgtcctagaaacctcgttaatgatctatgctgtcacaagcccttaagcccttttcagatggcttgtagcatctcagaaaatagaaacatctttaggaagtgattgtgtccaacagaccctcagaaaaaaatcaacgtagcccaaagcatcttcctatcttttcttttacctgatcagcttctgaatctgaggggaccaccagcaccacatcacccctttgtaaggtaagttcatcagaatttgctgcctcaaaatcatgcagtgtttccacctgcagaagataagaatacataaaaatcaatttcccagccagatttcaagcagacactcttacaagtcactctccaacctggatgaaaagaggaagatatttgccatatcccaaggaggaagaaggcctctaaagccagaagggaagtcctattctctgatatgaggccattcatatgtatatttattaatagtaatgcaatgccctctacaacagggaaaagcactatattaatcaaattttaattcatcttatttttgttagagatttgcattttattatcgctgatgctttattactgtttgttgtttaactggaacccaaaatgtctaaagctcctctaaccccagcttctgtcaaataataataaggaaaaccaccacttgcaggttatacagtaattactactaaataaaactctgtgatcaattctgtgtaaatatatttccttccttccctatcctaccttatatacaatggcaaccagtttcttttcctttcccattttgaaaaagatttccttaaaattttattatagaaaaatattttaaagcagaagaaataacataatgaacccctatgcgtctgtcacccagtctgaatcactctactgtcatggctgattttatttttcccacctttccctcaactccacccctgagagtaaacattggcttttaaagtgtgtattttgccattgagcatattcatagaatcacaagctgtcagagctggaaatggattatgttatccctaaattaatttttctgattggaaaactgatacccagagagagggtctatatggggtgccttaggttattctacagttagtgaggaggccagaatgggcccagcaagctccagccgtgcttggcacaaggcttcttggactgcttgtgctccagttaaaacggaacctggcaggaaacaaccccttatctagaggtttagcttttcctccaaattaatttattcataaatccattatagccacccctgtccccacaagaggtagcaaggtagcagttactttctaatggagagagacaaagacagagagagagagagagagagagagagagagagagagagagagagagagagagagaatgatacaacattttacactttagaagaaaaagagctgatttttaaatgtaaaatcaaatttaaaaacttaaaattccttttcagattctatcaggaaacatctgagacaggaaacacttaggttaagccagtgtttttaggtatttactaagtttttttggtaagaaccctttggtttatgaaggctctaagtagcctgtctgagcaaaaccttcttcccattaacttagccgccttttttttctgccttttggtgcaagttcattcatacatgaatccattaatttaccaaatatttatgggctccctactctgtgtcatgcaccctacaaggtgccagagttgactgaaggattgctgcccgacccccaggggatatagccgagtcaggagctcttggtgattccaaggcctggtctgagccaggctccacagattcacaggcacctgggggagtagagaggagggagggctggaaaagactctcccattcattacccaggggcatactgtttgccctgtggtgaacttccctttaattattctttgttaaaacatgaaaatctattactgtagtcctggcttgtccaagtgatgttgtggtgaagggaaagcagttcacagaaataataattgcaaaaagtaaaagtaaaaactggaaaaccaaaggcttgagcaaaagggccttaaagcaaaaaaaggataaatgagacttaaaaaataagaataccttgtagagaaagccaggaggcaattcctgagaggcctcccttgcagatgctagctggtcagcagcccccatggctggtgcagaaggcgtgggctgagggtcctggataggcttctgctccgtagccagctccggtgtctcgctggtggggcccggaggagccgcgtcctcggtggtctccttgggctctgcacctatagttatttcgttttctccttcctcttcatggttggaggcaggctctatgaccaccgaaggaatgaccttctcctgggggaagaaaaaccgtggcgatgccggcagggcctggaaaacagaacctccttgtcctgcacaacctgccttagcccccagcccaaagctggggctgccacttccatacttccccactagccagactcaggtctgggccttccgctgtgccacacagcctccttctgttcctcctgaggcctaaacccttagtggaattaatttctggatccttgaatagccaggcagtttggtaagcatgaggtttcggtgggaattgggaggagggataggggatgggagacagagtcttgaagggtgagggaggccatcctgagagggattgcaggaggagtcaatgcaggccggcctggttctttttttttttttttttttttttttttgagacagagtcttgctctgtcgcccaggctggagtgcaatgacgcgatctcagcccactgcaaactctgcctcccgggttgacgccattctcctgcctcagcctcccgagtagctgggactacagacacctgccaccacgcccagctaatttttatatttttagtagagacggggtttcaccgtgtgagccaagatggtctagatctcctgacctcgtgatccgcccacctcggcctcccaaagtgctgggattacaggcgtgagccaccacgcccagccccgcaggccagcctggttcttgtcccacggaaccctaactcttgcggttggcagttcacctcctgtgagccccttcctcccctcccccagtcccaggaggcccccagtgcctgaaccatgcttgctgatgaagatccagccggggtttggagatcatccactagtccttcgcttgtgattatcattccagccccacactgctgtggccgctggagggaccacacctccacaatccactccaagtactctagtgtctgaaccaaaggattaggaccaccctttcatttgtttaacaaagatgagcatggaggggagtttcatcagcagaacgggagtctttctatattccctctgctatcagcagactagagcactaacattcgtcaacttggagagataataccgtctttccatgagtagaacaacatacacaaaaacactctgggcactgtgatgagaaaatctaaggggaaaaaggaatattcttttaagttccttctcccataacactgttatctgcctcagcccccagcccaaaaagggataatgaaagggataattcagtttcaagttttaagtaaccctggagaaatttttgaaaacttattgggagtaaaatcatcagaagaaaacaatgcataccattaagccctctcttaatgttgccttctagaataccgaagaaccagacaatggaggcaggccctggggttggaggccctcgcagtggtagagtatgtggctttgtggcctctcaatgctgctctgaggcagtgccgagcagggccccctcccgcctcatgcacggacctaatggccctggtccctttgtttcccttctcaaagtgccacccagtggtgggctcttggtaaaaggggcctgatggtgaatttggggcactctaatgataataataaccaccaaacagtaataagaataataagatctaaatactattgagttctccctgggctgagtgctcacttcatcacattctctttctcccggctccattctcatccttttcactgtcctgcttcattcctttctccacgtcaccccagtttcccattcccgtttccatgcttaggcccagtcagccacaggccctgagggcctatatgcaacattgcaatgctgatactgagcagctgggattagtctttctgagaatctgataataatgttgtttggtggagtcacaaaattgctacaaacctattatacatccaaagagttatcaccatgaaccaaccaacagagcacccagcccatgctacttcccaggagctcccctggctgcgacatgggacactcacctgaggcactgttgcttcgagctcctctgcttcaggttgggcactctctgcaccctcagtggtttcagttccaattttggcctcctctaaacttactccttccccggcagggacagtggccttctccgcctctgcttcctctcctggggccccctcagctgctgacaccaaggttccaacagctgcatcagcatcagctccaggtatgatctgcagggcagaaaccagcaggccacgtctgcatctccatgggcctctgccaggagtcaaactcaagcctatttctaatctcccctctgtggaggctattcagatttggaacattctttgcactcccaggatttaggtacagcagaatctgccatctattcatcaacactccgacttctcttctgctgagctcccaacaattctacactcctcagctttccctgctgtcaggtgtagcaaatgggattagaatggaagtgacatacaccattccaaagacatggcttttaaggtgtaggtggtcctctccacaagctatttccatttttattggctggaagcaacaaatgaggccttaggggagtgaaagaaataaaattgaatctcgggaccttaaacttaccatgccaaaggaaagctaagcttgggaacggagtcacacgaaaaccaccttccttttgttcccaaacacagggctgtaatttcacacacttccttcatcttatgtaacatgcagaactacagagcatgagatgaaggcatgagtgagtttgtccccactccctcttttcacatgtaaaatgtagattcactgagcgctaatcagagcctcacaagaatgtgacacttgcctcattgcctaaccaccctctttttaaaaaaattatttccttcttgcttgctatttcccctttaaatactgaagttctcaaaactctcttcagaaaaagcacacgtcacagatcctcctttgactcgtgtctctttttcctgggtgcatccttaaccttggctaaataagcctctccatgactaagacgtgccttggtcactttttgatttacatggcacatctgggtcacaggatggaagtggcctgggtcagagagaaaagccatatcagaaaagcatcctcatcacacaaagtcaaaatttagaaagagtgcattttagtataaactttcaaatctttgtgaggaaggttccagaagccaaatcactttcacaggaaaaaaaaatacataaggaagctttctcaatgaaaaccctcgagaatgaaggggaaatcatttttgtaatcaaatatgcatggtaatgctccaaatagctgtagagcctgttataggcaaaatgccaaaatcatagtttaggtccagtaaggagaagtgaaatagaaaaaagtcagaattttctttctaaggtagaaacacagaagaagagttttaagtactatttaaaatttgagataatgaaataaaggaaatgcaatcagaaattttagttttgaacaaatgggttggagtccaactctttaaacaggattctgacaacatcagcttggcagacttgatttgagaggttcacgtgagaaagactatgttagaagaatctcaggttgatcttatataatatatccgggacacatatttcaaaaatggctcttactatctgatgggattaggattaactattttttctttgttgaatacattctatccagttcaacatcttaagttaggaaggccctaatattgcaaatattaactttcaaactcagaaaacagaaaaggacaatgaagagtacctccgagtgagcatcagaaatcggagatgaagaacatgaaccacacatctacacttataacaaagcagttttaaaaacgtttctgctggctcaaaggtacaggtaatagtttaaataaaaatgcctgttacagaatatatacagtacatttttctataagataatattttatttgggaatgaaaaagaaatgttaacagctatactactcattatatgtccaagtatttactcatattcttagaaacttatttccctctcttatgagaatctcctattacgaggatgtggctctccaaatgtgcaatccctagccatgacatacttccttctttctgccctgtcatgaaagtacatgtgacatggtttggctctgtgtccccacccaaatctcatcttgtaggtcccataattcccatgtgttgtgggagggacttggtgggagatgattgaatcatgggggtgggtctttcccatgctgttctcatgatagtgactgggtctcaccagatttgatggttttaaaaatgggagtttccctgcacaagctctgtttttgcctgctgccatccatgtaagatgtgacttgctcctctttgccttccatcatgattgtgaggcctccccagctatgtggaactgtaagtccaataaacctctttcttttgcaaattgcccagtctcaggtatgtctttatcagcagcatgaaaatggactaatacaatatgggttcacaaaagtaatgatttctcatgaattgtaacagacacttatttaaagtgaattataaatgctgatcattattgaagtggggtaacaagtacatgagggtttatattttggcaaatggctgaaaattcctataataaaaagtttattttgaaatcgaatagactttcatcactgttttaaataagcaccgacctttttatggatgctattgttactgttgtcaagagaatagtaatcagaacataaattagtagggcatcttaatcctgagaagaacaaggagcaattgctcatagctttattgtcggagacattaacaggatttctctacgacactaaggacctaataaagtttcttctatgttaaaaactatactgaaagaaaatgtgcatgcaataaacttatgagctcaaatgtagaaaataagttgtgtcatgattacaagcttattctctccatctgtctggaaaatcacacctatgaatatcccactagtttcaacagcttggaagcagatggactctatctacatgcagacggtatggacaaacagagcagcagacaccaccactacacacacatgcagcagaggcactgctacagatgaaaaagcagacaggatgttattccatgggctactctcccaagtgattatgcataaatccttttatacatatatgttccaaccacacattattactaattggcttttagtctcagttgaattgatactacatctctgggagaggatatctttccatgacctatagatggtgttgccacaggtgattttttaaacttgttccatacgaacataatgtttattattaacctgtaacttgtctctagatatctatcaatttggttgtataagattttaccatcactaaatatacatgttatcacctttcctttgctagataatttaagcaggcaacgaaactggactcctatcttttgccatatacaaaaattaaataaaaatggattaaatacttaaatataagtcttcaaactatgaaactaccaaaaggaaacattgggaaagctctctaggacactggactgggtaaagatttcttgagtaatatcccaaaagcacaggcacacaaagcgaaaatggacaaatgggattacgtcaagttaaaaagcctctgcactgccaagggaacaatcaacaaagacaacctgcagaatgggagaaaatatttgtgaactacccatctgacaagggattaataaccagaatacataaggatctcaaacaactctatggggaaaaaatctaataattccaattaaaaaatgggcaaaagatctgaatagacagttcacaaaagaagacataaatagcaaacaagtatgtgaaaaggtgctcaacctcactgatcatcagagaaatgcaaatcgaaactacaatgagatctcatctcaccccagttaaaacggcttttatccaaaagacaggcaataacaaatgctggcgaggaagtagagaaaaaagaaacctcatatactgttggtggaaatgtaaattaatgcaactattatggtgaacagtttggaggttcctcaaaaaaaaaaaaaaacacaaaaactaaaagtagagataccatatgatccagcaatcccactgctaggtatatactcaaaaaaaaaaaaacaaaaaaaaaagggaaatcaatatatcaaggaggtatctgcactcacatgtttattgcagcactattcacaatagccaagatttggaagcaacctaagtatccatcaacagatgaatggataaagaaaatgtgatacatatatacaatggagtactattcagccatagaaaacaatgagatcttgtcatttgcaacaacatggatggaactggaggtcattatgttaagggaaaaaagccaggcacagaaagacaaactttgaatgttcttacttatttctaggtgctaaaaagtaaaacaattgaattcatggagacagagagtagaaggatgcttaccagaggctgggaagggtagtgaggaagtaggggggatggttaatgggcacaaacaataattagaaagaataaataagacctagtatttcataacacaaacagggtgactacagtcaacaataacttattgtacattttaaaataactaaaagaatattactggattataatgcaaaaaaaggataaatgcttaaggaggtgatagatatatttaccctgaggtaattactacatgtcatatatctgtatcaaaatatctcacgtacctcataaatatatccaccccctacgtacccacaaaagttaaaaataaacataaaataaaataataaaaaacaggtattagctgctgtgacaccaaccaccagcaggtggcggccaaaggctctgcctgactgctctgacgttcctgacgttgtaggagcaaatacctcagcctcagcacctcagctgtgatttttgtcacataaaaaagaactgcagcatgcagaaaacgaattttaagaatgataaataaatatcaggaaaataccgaaattaacaactctggcaaaggtaaggtgctaaggaattggcactttagactttaaagagaagccaaacaattttaatgatctacttggaaaacaaacaacactcctacaccctactttgagtccattagtaatgaattcccatttttccagctgctgtttacttaccacgttgattttacagggcttaaaaactacataaacagagaaggatcatccactatctgcgtatcctcatagctttctgtttctgacactagtctgatgatcagggggcatcagtcctccctttatgtctggaatctggtccagatgttttgctcttaccaaaatacttccaatgccgtatttactgaccgcaagaatagaacaacataaaaatacaatggaaaacaggaacccatttgttcagattaggtgttagctgtagataaaatcaaggaaagagtaaaaaggttttcatcaatgaaagttatacctcttattattattgttgttgtcatgcatttcaatttgttagctatttgtagagctataaaagaaaaaacattttctatgctctgcttgctacagtacatgttatacctgctaggaaaaaccacaatgataaatgactaccatttgctttttaaaaaatgttactcacaaagaccagggactgaatctgctgaaagtacttcaagcctttcatacccagtgctatcaaatgtttctcttcactctaaatgttcagaaaaacacaattatcctatcttctgcccaacctatactatctattggtcaaatatatttatgggggaaacagctattgcaaacagagactaaaaatgttctccttgaccttgggcacatatttactatatccatgaggtctatgaggtgcagaaactaggagtattgctaaaccgcctgtccatcacacagaaatcacagcgaccagcacaaaaccttctggagagagtaggtggtggctctctgcaccatacatacctcattgctttcttttttctttctttttcttttttgaaatgaagtctcactcttgttgcccaggctggagtgcaatggtgtgatcttggctcactgcaacctccgccccccaggttcaagcgattttcctgcctcagtctcccgagtagctgggattacaggcacctgccaccacacctggctaatttttttgtattttgagtggagacagggtttcaccatgttggccaggctggtcttgaattcctgacctcaggcaatccacctgccttggcctcccaaagtgctgggattacaggaatgagccaccgtgcccagcccctcattgctttctaatcttctgtctcaatcatctccttagtggaaagccacataattatggcattcatgccagggtcccctaaacaccagtttaaatttgctttagcaaaattttctggaaatgtaatgacatgaatgaaatgcaacaatagcctaggttatcaatcatgtaaaatagggaaacacaactgggtgacagaaactagccagtcctgctatgagatggtgctatgaaagcaggtcaacaaggaccaagacccccaaacatgtcagagtagtgataggctcaagagaacttgtcgtctctgaggtttatgtcatgcattcatacattcattcactcatttatttacttatttgcttgttttctttgtgatattagctctgaccaatgcctgaaagtagtgtgtcaatcacgcaactggtcgggatgagacaattgaagatactttcattatccttctgcccagcatgaaattccatacttatttataaagtaggttattgtaactgatcataggcatttttctaataaagcaattaaaaaatttttttctaacaaattttaaaataataaaagaaataatttatggtaacattttgatatatttagttgtattcattttctaatcatacaagggtttatcttacaaaacatgagtcatgtttctgagaaaagttatagtaatggatatataatactttattgcttattctatttatcaagttatttaacagttctattagcattaaacactagttggtttcatttttaaatgttactctaacactgtgagaaagatctttggtttgtaacccaacaattattaggttacacatttcaataatttaaatactaaacactgctctatttctttatgatgtctccattaaacatgttttgggggtttctgctcaacattataagaaatttttaaaaaatttcaaaaacatagaatcatacaatgaacttccaagtgcccaccacctaggatcctcaatagacatgtcaccacatttgctttatcacgtcttcccacctatctgccttgatttgagtcatcttccagtcaattgcaatatagcttcataaaatgctttttaggaattctatggaaagtctctagcaccttatgtaattggtaatgtctttctgctgctttcctacatgaccaactattgacttggggtagaattactgtattgtgtttctttgtgctcaaaatttgtatgttgttctaatagcttctgacctttagtactgatatggataagtcagagaacaacctaattgttgttcatttgtagtgctttcttatttccaacctagatgcttgcagaactttttttttaaactttaaactcaaatatttaaaagaatacatttcaatgtagtctctccccattaagtttgctttttttggtgatttcttatgatccacatgcaggaattccatcaactaggaaaacttcagtttgagcatgtttttttctattatactggccacttctgcttctgtaacattcttatagtctcttcttcaggatgaacttctacccatgagctgtatcttcactccttggtccctaaatctatcatctttgcttgtgcttctctttatgtgttgggagaactcctccagcttgtcctcatatcactaaatcgattctctatagtgttgcttctcgtctttaccacatctcatgcaaattttaattctaatattacatttcctccccttaaaatcttttctcatgttattgagttcccttttcatctgcctttcaaagtgactttcttttcttctcaatatggttgccttatcatctcacccttcatcttttgtttcacctatcgaggtcatcttgagttttactgacaacaaaaaggaaggcaattttcaaattttgtctttgtatgtcaggtaatttttgttattgttgcatgttctctaaagaaacttttaactctggcatgcaataattattttttcttttgtattgctctataggtgtttgctaatctaaaaatgtatttacttgcttagttttctcaaatcaggagaaatctctataggcttgatgtttacagtagacgtggaaacattttctttgttccattttactcgctatctggggactcttagatatccttttcagaacaggagctggagagggatttatcaagtcttgacatagaatcacctgctctgaatcccctaaatatatgtgtcaaaggatatacttctgtgagagtagcagcaggccccaaatggcctggatgcttcagaaaggaatcccatactcatggcggggtagatgcgagttgtctctgatcgagggtggagatggatgacactctcagatattttcccttgcctggctcaggtattatgcgtcaaggatccatttatactttgttttatggaaaattatcttgggtttagctaacatttctagaatatacttttgaaatgttgactttctttttctatatgctgggttttttctttaagagtaaaatcattaaaatgaaaacaaaaaaaactagtaatagtgaatctgattttttgagtgatttttaagtgttttcagctttctcgtgaatcttcttttacacatcccaatgataaatttcatttttttaaaaaaatgctccaaggtttttttgttgttgttgttgttttttccaagatggctgactggagacgtcagaagccagttctcttcagaaaggggatcaaagttacagacgagtggccatgatctgaatggaaagctgagagaagagagccaggacctgttggagttcccatggaaataagctggggtgtagaaaaaggaaagctacgagagtctggcagagactgactcttaaggaacttagaattcggcagaaagggtaggtgggggtgcttctctactcccctcccttctgtgacaaactgctgaccactaaattgtcagagagcacctctgcccttgtgaccttcggcaatgctgttggtggcaatctgagaacttcctgaggacagagcagcagtggccagctcctccaggtgcactcggactccccgcaggcctgcactgaaatggcaggtgccataccggctgtgcacccagtgtaggtcactgcctgcctgaagaacctgcctgtctgtgtcaccagacccctgcaaacataccttagaacccactctgacttggcaatgataggggactgatagggaggatgctgggaagctctgggtactccagagagctagctcttggcagaggccgccccgagggaagggggaatacggcctgccaaagtgccccttggaacaaaggaaatgcaggcatggtgctgatttctgaaaggggtagcaccagtggctgggaaagatcatggaaaagaggccatttcccacttcccccacccaccattgtggatgcagagcagacttcccctactggggccttgggcaagtgcacttggagaaagccttttcagtgcatttccagatggccgcacccccagtgaaagtgagcctatgccatttgggtttgcacaaagggcagagcccatcttcccctccctaaacagagtgggcagcatggtggcaacagaggacagacaagtcacagagctgtctgctctggattgggggaagaagctgtgccccaaggccattttgctgatagccaccagagaggtcctttcacagacctcagtcacactgcagactggagtcaaaggacagcatctatgtgaactgaaggtcacgagtcctgcaacaggaaagtgaatcacatccctgcctatctaggatgggaagctgctgcagccccctaacccttatccccaagagctcagcacatcctcctcctgtcacccttgtcagggcaggtgcctccattcatcatccagctacccaagggtaagccagctgtcatccttaagtgccacctactggactggagactgaagaccaaataaaaaacctgctgcagaagggcatagtgctaatgtatgagataaacttcttgagacctccacactcccagccccacagaagacagtgtatcagttcatacacccaatatactgctacaacaagcagtgtttgagaaagccaccacacaacagatatccataaccaaggaacccatgtagagccttggcctcctgaaagcacctagaaacaaagccaaacaatcatatacaacaaactccacagccatatcctcaagggaaaaaagagtaaaaatttaaatgtcccatccaaaggatgactaatttaaaaataagaagtgacagcttcttcacatgagaaagaatcagcagaagaactctggcaatacaaaaagacagagtgttttgacaccttcaaaggagtgcagtatgttccctcaaacatatttgagggaatgattcagaaaagttttcctgatcttgatagagaagtatttattcagatacaaaaaactcagagaacatctgggaggtactatatgagattaacatcatcaagaaatataatcaacagagtatccaagatcaacactaaagaaaaaatcttaaaggcagctagagagaagtgtcaaatttacctgcaaaggaaattccaacagactaacagtcaacttctcagcagaaaccttataagccagaaaagattcggggcctatttttagccttcttaaagaaaaaaaaaatgccagccaagaattttatatcttgtcaagctaagcttcataaacgaaggagaaataaagtctttcccagacaaacaaatgttaaaagaatttgtcaccactagactggtcatacaagaaatgctgaaaggagttctcaacatggaaggggaaggatgataccaccataaaagcacacataagtacaaagttcacacatcctataaagcaattacacaactgagattataatgcaactagctgataacactatgataggaacaaaacctcacatgtcaatattaaacttgagcataaatagccttaatgttccacttatagattagaaaattggattaaaaaaacaaaacccaaccatctgctgcatacaagacacccatctaacatgtaatgacacccacaggctccaagtaaaggggctggaaatgatatatgatgcaactggaaacaaaaagagcaggagttgctatccttatgtcagataaaacagactttaagccaataacattaaaaagacaaagacagcattatatcataacaagagttcaattcaacaagaagatttaactatcctatatatatatatgtagatatatagagagatacatatacatccaacaccagagcacccagatttataaaataaatgctactagacctgagaaaagagatagtcatcactacaataataatggaggacttcaataccccactgatagcatcagactgatcaccaaggcagaaaactaacacagaaactctggacataaatgtacttctaaccaaatggacttaatagacatctatagaacattccacccaacaactgcagaatatacaatcttttatctgcacatggaacattctccaaaatcaaccatatgcttagccataaagcaagtctcaataaattcaaagtcctgaaatcataccaagcatcttctcagaccacagtggaataaaattagaaataaataccaggagaaactctaaaaaccacacaaatacttgggaattaaacaacttgctcctgaataacttttgggtaaataagaaattaaggtaaaaataaaaaaatagaaacaaatgaaaatagagacacaacatatcaaaacttctgggatacagcaacagcaatgctaagaggaaagtttatactgttaaaatacttacatcaaaaagatataaagatctcaaattaacaatctaacgtcacacctcaaggaactagaaaaataagaacaaaccaaacctaaagctagcagaagaaaagacataacaaagatcagagcggaactaaatgaaattgaaaattaaaaaaaatcttacgaaggatcaacaaaacagaaagctggttatttaaaaggataaataaaatttatagactgctataataattaatattaggtgtcaacttgactggattgagggatgcctagatggttggtgaagtattgtttctaggtgtgtctgtgaggttggtgccagaggagactgacatttgagtcagtggactgggagaggaagacccctcctcaatgtgaatgggcaccatccaatcagctgccagcatggctggaacaccaagtagaagagggggataagcttgcttgctctgagttctctctcctctcctctctctctccctttccctctctctctctctctctctctctctctctctctctctctctctcgtgctggatgcctgctttctctcctactgcccaaaactcaaggttttgggacttaacaccagtggcctcttgggggttctcaggcctttggcatcacacagagcttcattgtcagcttccctggtttgaagctttcagacttaggctgagccttgctactggtttctctctgtccccagcttgcagatggccaatcgtgggactttgccttgtaattgcataagccaattttccctaatagactcctctctctctctctctctctctctctctatatatatatatatatatatatatatatgtgtgtgtgtgtgtgtgtgtgtgtgtgtgtgtgtgtgtataaatatatagacatagatagatagctatagagatatatctatctatatctatctatctagcatccagcaattactctctctccctctctctatatctatctatagatagatagatatagagatatatctgtatctaactatctatctatctagctagctagctttctatctatatagagagagagagagacagagagagaggaatctattagggaaaatctctctctctctctctttctccctataaaagtgagaacaccacatgttctcacttttgagtagaaactaaccagtggatacacattgacataaagatggaaataataggcattggagctccaaaagtggagacggagaggaggctgaaggttggaaaattatctattgggtataaagttcactatttgggtgatggtttaatagaagcccaaatcttaccattgcacaatataaccatataataaacctgcacatgtaccctctggatctaaaataaaatttaaaaattttaaattaaaaaaattcaaaaaattaaatatacactaaggtaaattatacaagccataagtacagaataaagacatatatattttaaattttagccaaatgatattcttccatggctatggaacactttatactacagttagagaacagccatcttcctggcatttgctcttacagagacatttgactacaggaccactgaattcaaggcttactgatttaccccaaagatggagaataataattctgattctgattcataagcaggtttctgcttgacagttttgatatatgcacattctgtagactgagggggaaatggatatttatcatgaatttacaattttccagactgtatctcaggtggtttacatttattacacattattcttccaacaaccctattaaatattcccccattttcaagaaaaattaactagtacttcaagtttaagtaactcacctagtcagtaaacaaggactgaaacagtttgtctaactctaaattctgtgttttctcacaccatcccataaccaagaagaccacacatctctcaagtaagggagttccacggaaattctgagacctcctaaataatctttggttcccaagtgatgtttgacaaagaatgtgagtgtattcttataaacagttgatacattcacttaaattgttggaatgctactctttaaagtgagatgcatagattataattttttttctttattcatgtacacatactatctgggcatcaaagcaaacatatcacaaaatgcctcttaatcaatagcaaattatacaataaaaagatatcaagaagagtttggtttgatagaatttctccacattacttaggccgggcgcagtggctcacgcttgtaatcccagcactttgggaggccgaggtgggtggatcacgaggtcaggagattgagaccatcctggctaacatggtcaaaccctgtctctactaaagatacaacggcgtggtggtgggtgcctgtagtcccagctactcagagaggctgaggcaggggaatggtgtgaactgggaggtggagcttgcagtgagccaagattgcgccactgcacttcagcctgggtgacagagcgagactccatcacaaaaaaaaaaaaaaaaaaagaatttctctacattacttttgcctactttattattctacattattttgtcctgtatttgttctatagatttcatttttgtcctgtggatttcatcgttaagttatgtacaggctggaaaagtggaaaagatgaccagttgatccattgcactacagaactacaactgagaacatttagaagtttcattgatagctatgttcacaagttagagattaatctgatcccatggctggaaggaccatagggcccaatgttctcattttagaagggaggaactattataaagtagaagcagcactagagacagactagagattgggttttagttttgactcttccactaatttgctatggagctggaggaagtccctttgggcctagctgtgtaaactcatggggaaaagtaacaaaggagaataaatacagcgggaattctggctgcagggcaccattgccttttcttgcccatctctaattctagatccaacttgagctcttgacttgtctgaagttccttggcattttaatgaaaatacagcattttcttcagaatccattttaaggaaaagcccaagaggtaggtagggtatccagatcctcattatggccccaaatagaagatgattggactatggcacaggctggtgactggtaaatctcttcacgtgaactatatttaaaacaattcaggtcataattttccttcagtgtgactgtaggggcaagctctctcatggtacccccggtccctagtagcgttcctttcaaagctggcacttgataccgcaaatttcatttgacacatttatgcgctttttttctaataaaggaatttagtggtgtccccctcacaaccttcagctcaatcatctttttcaatctgctctcctggtattgcctgcagtcctatcatgaaccctcagcagccgggtcccagagcaactcaactgcaggcagcactgttgccatggcaacgtctgttagaactagctccatcactttcttcaaaaattaaagtcttctacagagatcccaaagttaatgaatttttggttaatttggcctttaagtttgtgtcagtatatccaataataatacagatcagtatttaaagttttaattagtgatttatccgcaacgcataggggagaagtggataggaaaaggggacttatcttttaatgcaaacgtaaataccatgtattgttctctctcagagatgaggagataagcacatactagtttttggagcagccgccgtggacagcttcaatggggattgcaaatagtttgttaaagagattgcttaaggaagacacatttatggtacaataagcatttttctatggctggctatgtcatctttgaatgatatgtaaggtgcctgctgttacacctcaaactgccttctcctaagcaggcccaggctcaggttggcagaaggcagagggaaggctgccagacatacccagagactagactgagaaacagtgatctgcaaatcacctgaatgtcattacactttgttggcaaaactcccaaacctgaccctgtcaagcacgacatatatctcaccgtgcaacctgggacccaacccagatggcagtgtggggcctgaagcttgaggaggggcaggcagctgaaagtcacacttggaaggcctgactgccaacctctgagttcacagcctttgaactggccatggcattagtaagtaaaagccactccacaatgatatgtcatcccgatggcctagcaaacagaggctggaaaaaagccataaacacagggtgctcttgttactacaaagaattgttactacaaggaatttttaaagtaatacattttgattttgggggagcaggaagaggttatcatgtacaaccctcttaaaggaagaatgagaaaactggcacagagggtaaaatgatttccctaaggccacttcactggttgaccatgcagttagttccccatattcctaattcaaggtctttcaaatacatcccctttgaaatttgctttgccgccaaagtggaggattaggacacacattatctctgagaagctcaaggttgaggctgcacagagtttctgtttcatttcaactcctcagccacaaaccaggaacatccatcaagtctaagcattcgttgtgggaagtctttgtgtccacttggaccctaagttgtgaccctaacggctttagttagatgtgatatgagacgtgttgataaatatatttttataaaacctcctctttttaaaagcatctggagtagtcaggagatagacagctatggcttaaaataccaggatttgaatcacatgtcactactttctagatgtgtgatcttggttaatcaattaatctctttgtgtccgttttcttaatctgtaaaacgagggacctgatgcctaaataatcctatttcacgggactgctgtgagagaatgcatgacaatgctactgctccctagtatctcttatcacagtatggccttctttactatcaccttactctctttgatcatactccttcatttcaggacacacacagtagtcctcaaaggcagtatctgaactgcttgagcaccgatgctggaacacaaggcaacttgctggggaaaaggaagggatctctaatctcaaatcaagcactttttcctgatcatgtttaaggtccagctcatgtctgtggagggctagcaggagggattcatgcaagggcctttctatcgtgcaggtgagggatggacagaacaggaacaggcaagaagtgaatgagaactcagcacacatggtctagggggttggttccatattatccatggactaaacaaatcccaacactgccacctgtaggggaagaggagtgagccagtaagtagaacacatctgtaaggctcttgtaggtctaaattctgatttctggggtgggactgggcttcatattggggtggggctttattatctcaacagagttgtctttttaacatctgaatgggtctggtcttacataggctacccaattgtgttgatgaccaggaatggtttcaatgagggattatgaattgggcccaatacatattcagaagacagaataagagtttcttatcctgaagctaatgataactagtcatattaaatatatcaagctaaagctctagatttagtatgtgacaaaaagtatacaccaaggcagacacaaaaccatcttataatcatgtgttgtatgattccatttatatcagctctctagaatagataaatccatagcacattggcaggtaccaagggcctggggaggggaagatgggagtcactgcttaatggctatggggctgtgatttgaggtgatgaaaatgttttggaacgagatagaggtgatgactgtacaacactgtgaatgtactaagtgccagttaattgttacttgaaaatggttaattttattttatgtgaatttcacctcagaagaaaagtacatgccaaaagtaatacttaaaagtcactgggcatctatcacctaaaaatggctcctcaatagtggaagaacaacctgaatcttgagttcatgttcacatagatttataacaacactctgaataaacaatgacatttattaaaaagtctcacttggccctgtttgagatggggctttggaaatcacactccagaaggcagggaagatgccgctactagcagttggtaggtggttaatgaatacttaatatcagccacatctcaaaacagcagtggccccatatttcagagatggccacctacaaacccagatcaacctgctctgtgaggttgggggaactgatcactgtgttgttactttcactttattcttggctaattttatctcttccctatgacttcctgcaaagacagagagaaagatctaggttcagttacttgtatcagatttggatgtatcatgtttgtagatcatctgcccttctttttccttctacaaccacatggaaggaggacgcagctgagagggcactgccagttctctgaatactcacatctcctgggcaatgaagatagaaaaattccctattcattcactgagtatgaaggtgcctggaaaaggggaagtcttcttagaaaggacaaagaattttgatgggacacagcttgtttgggaaccacatggaaatttgtgttgatggagatctaacagggactgggtccattgccatttctgacatgaggcaacactggaagagggggctgttatctttgcctctgctgctttctcctccccagagtacatatttcacatgcttctgcttatttgcttctcaccaacttttcatgacgatgataacaataatgatatcaccaaactgtcattaactaataacctctgcacgacagatgttgaaactgacaacatgttttatttctaagccctcatgggaaacttttaaggtgattattattaactccattttatatttgaggtaagtggggcttaggtgtcacagagctgtggggcagaatgaaaaaactgacattgcttttgatcataataactggcttgcttttcctaaatataaaaaaagccaaagtatctgaatgaaaaaaaaaagagaaggaaaatgaccatatacatatttgtactttaagaaatcaaactgcagcccctttaaggaccccaagactgcactgtcaactaactaacaaatcaatgacttagaatttgatgggcatggattatgcactctgctgtgtgcttggtatcatgaacaagagagaaacagacacttatttagtttgaggggcattgaaaatgtaactatttgctaatgggaatacaatcaaactcagaaaataaccaattctgtgatttttttttctaagaaaggtaaacaggaacatccatctccaaggttctcataaaaaaaagaaaaatccatatgtatgtttcttgacatcttaaagcatgcttcagtgtaagcccttggagttggaagatcattctatgttaataagggcagacaataattcaagcttcctggcttcctctgatcttcaatgtcttcttctgacatactgagagatcacatctagaggcacaggggaaacgctagctctcatgtttactctgcaaaaggataaaacccaaatgctgtttcccgtgaacatgagtgtcactgaaggacacctcaacctctgtgtaacgtgcatctcaaccaccagtctgtggaaactaggaggcaggagccatatctatttaccacatctctgtattctccagatccagaacagagcctgacacctacagaggactcaaatatatctgtcaactgagtaaaagaggaagtgagcacatgcattctgttcagacagaaatattctagcaagatgaagttgatagactatagtctggcaattctgatatgtatatatttgttggtttaaattggtcttgacaagtttagtggtaaaatttttaaaaaacaaaacacagcaaaaaccaaagttgtccccagaataatgggtcaataatgtttcataatccaggattccccaacaattctaagaacgtctttaccacagtcttccttacatttatatgttctaaaaactatgctaactctaaatttaattacacggcattattttgaaaaaataataggcaaaaaagaacactggtataattcacatcatttaagcaaaatacaggcactgacagaaatttagagaaaattagaaggggcctctttagaaaaaaatggaataaatgtgggtaaaaatctaaccataattaattgtaaccaaataatacattatgaattggctctgtgctcatctttacctgctttacaacctgattctctaacacatattgaaacgaatattgaaatcatattgaatttttttttttttgagacagagtctcactctgtcgccctggttggagtgcaatggttaagatctcagctcactgcacctctgccttctgggttcaagtgattctcctgcctcagcctcccaagtagctgggattacaggcacctgccatcatgccaggctaatttttgtatttttgtagagatggggtttcatcatgttggccaggctggtcttgaactcctgacctcatgtgatttgcctgccttgccctcccaaagtgctgggattacaggcatgagccaccacacctggccccaaatcattttttttctaacaaatattttcattatttacataacatagaaacatctggaaaagtaaagacaagagtgttgtttttttaaatgcatcctgtagacataccagtaaaatttgatgttgttgggaaaaactgaagacaatactacctatatgagaaataaaacaacaaacaaaaatgtaataattaaacttttcttaaaagccctaggtttcttttggaaacaccgttaaaatttcccatgtttgaaattatacgtgcctctttacaaaaacaaaacaaaaaccaaacaaacaaaaaaaaccagaacaatcacaaacttcatctcaggtgaaatgcattctgtcaaaacttgaactaataattatggtgacatttcagtagtgaaagggattacctcaaaaggtcatgtcaactcaacgctgactgacgacaaccacagccagccaattaattaatgctagggacacaatgtggatttttgtttttacaactaaataccacgtatctagcaacctaatagacctttctccagagaaatataaccctaatattatgttagattattatgaccggaaggaagaagctataaatctactttaggaaacaaaaatacattttatctgattctattttcctaaggagaagggagaacgaggggaaaaattgatttcatccaagtatgtccatgttaaaaacatggaaggcagccactactgatgaccattaggcaaactaaattgctgtaaactgtctcctcttagttaacattgttactattatttttcagtccatatggagaaatgaacttgaattttttctctgtggaaagcgtggatcacactgtgagctctgcacctatgattcttgcatcacctatggatctcaggaagtgcctgaatccttcattagactgtaaattgccttatattttacaaggaatcaaaatttttgattctctacagttcacctgtgagcttcaggagaaaaggtattttcagaatgaagcattcttccaaacagctgcttacccaacatgagggaagctggtttgagtgatggttggtgcctgtgccacagggtgttgaatatttttcatattacccttagtttaaacaatgatcaaacatatgaatatatatatatatatatatatattagctattacatagtaggtacttaataattggtggccactaatattgtccactggaaaaccataaacctggattctgaaaaaaacaaaagcctacttagatcggtttgttgaaatgaggatgggtgtgggaggtatatgaacatgacactcttagaagggatcatagagaatcaacattcagccgtattgaacacagtagcttgtctattccacatttccaatctattgcacaacatccaatgctgcccctgctcatgggcatgatggcattaagccttacactgaatagtcttgggcataaaatcaatgaactagttttaaaacattggtgaagatgaagttggtgctgctgttcaaaatagggatttgatgagagctttttcagaatcaaaacaatttccctcaaaacctaaatcaatatctttttaactccctggcatcatccacattcctttaaaaataaattatcttcttaattataatagtaacgaaaaattaaactccatttttcccttcctttgttatttaaataatcttaaagctaaggtgagtagacagatcaccattggacaccaagtgaaaaagcactgtctgcatggacttgctgaaatctccagtgaatctgggagtggccctggacacagcactccctggtctaaagtccctgcaagcaatgcctctaggagagattcagtccagctttaagtattttccattactatcttgcactattatttatttttctacttgattaatgaactgttgatgtgacagatgacctaccattttccctgtaaaatgacttaaggcaccaacgacatgaagtaagactcatttctctaggtatctaatctagggaatgttatttttggtaatagagaaattgtttttcctatttgtacagtctatgaagggtaaatggtaccctgattgaaattgttggaagacatttttctgcatttcataaataaatgacttttcactcgccatgggtatttggtactctacactttcatgggtattacaatgtccaattctacttggtacatatcagagctcagcccagtttgcaatgtggtgttctttatggctgcatggattagggtaagagcaggtttccaggcagacaaatggatccccatcccagcacaaaaacaaaacatcctcaaggtccgtattattatgagtcatcagcagacttaattgtgagcaaatggtggtgcatataggaatccttacagattcatggagttgtgatatgggatttcaacacctcattggaccttaaccaacctatgaaactaatattgtaagtaatcaatatgtacacacaatgaacaaagttattattctgtttatcacatgcaagttccctaataaaggcacgtctccagctgtcacaggtagaacaaagcattaacaggtctgattactcgcaagttctacaacccttctactgtgctatacctgtggctatgtacagttttctttagatcataagatcagttatctggatatcttccttaataaaaaatgaaagagaacaggcatgaaggctatttgaacctgggagctacgacagatatggagcatgtttggcccaagtgaggcaaagatgagagcgatgcatatggtcatgagatgagcatggctgtggcagcgaggcagatggagggtgagagggaggtggtgctcaccactgcctcctccactggctcctcagcccgagtgtccattccaaggtccagaccaacggcaggtgtgacagcagccagaggctcctctgcttttggctctgtgggtggagcctgttcagattcagccttggagtgtttgttttgagggttagaggaaaaagattcaacaggtaaatagataacattacagaatactggacaattaagattttctttgtcatcccataggcaactagcttcatgaaatccgtgctggagaaaagcccccatttgccatcataggcttttagagaatggaaaagactagaaataaaatcttattaagcttctgctttaccatcatcaagactgtcatttcccttgaagtcaggcaagacttaccattttacctacccattttacttacttgcaacattttgactacccacttacctatgatagctataagaggttctgctattttccagagagagagagacagagacagagagagagagagagacagagatagagacagagacggaggcagagacagagagaaaggattctaggaggacccacaattacttgccagtgggaaggagtaaggaagaaatcgcagggcacacagttccagggcctttcagttttatgaatatgcattgcaccaaaaaaatcaaagagtcattctaatagtcagactaaaatgcattcatttgacccaacaggtcaccatgaagctagtgttccacttccaaggctgggaagaacagaatcagctacctggctatttgctactacaatcatagatactttactgccttgttgtaaattcctgttcagtccctttttccctttctccctccaacaaaatccttagtaatgcatttatttcatataatagttgtttaaagaaccacagggcagtattctccatggtttcaattataccccctgaattgtgtaggcagggtgaggtctttttgtcccaacaagacatataaacatcatcctgatttcaattacatatatgctgaatcaggcttctggcatctcttagatcaaggcctttttagttttaaaattagcaatataaactaacagcaagccattaaaagcaccacagccaatgcatgttactacaaatactgaaaatattccttctttttccattcttattaatataaataaacatatttatctagtatgattctttcactaaatgaatggccattagagggctcataagatccttttctatcaccagaacacttaaactaaaaaaagtttaaaagtgatttcccagtggagtaagaagtctctaattaatgctgtgattggagaaatcagtaacttctatccaactcaccataagcaatcaaaacacacctctatttgtcctgtacatttatctgagtcagtgcacatggcaagttccacagagaagtgctggaaaagttatgctgagataatacaaaatgaatatgaatagcctagtgttggacaaatacacaaagtatttgtcttatgtttcccaccaaatcattccatttttatgcatgccaggatcacacgactattcttttcaaaaggacataataaattcaagggactggtagacaagtgtgcagacatttgatttttatgggcttttttcagctttaagaggtggcctgacataatttttaaggaagaatgagataaaattcacactaatatgctctcaagagtcctttatggaaaaatacttcacttttattgtttgaaaagaattatcttcatagtggaacaagttttcataacagcaaatagatactgtaagtgctcagggaatgatcttaccatttgggaagtcaaggtgatttgctatgacagcctggtatcaaatgaccttcacaatgaaggataaaagggtaatttgagaaaacaccaagaaatccacgagcagatgctgttcactgcaaactgagtctactctatggaagaagtaagatcgaagccagatgagaagccaagagatgttttaaaacatgagccaaagaaatataacatcatatattttataaaatgcaaagatatcttaaaatgcaaaaaatatttgcaccagagtctgggtttcttagaagtctgaagaaattctgacattttttataaggcaagaataaatagctagggtgattttataaatgagcccaattgcatttgcttgttgaaatttgacagtgcagctgtggtctagtataaagagaacataggattgcttatgttccccacaagtcacaagatgtttcacatacgacaataacacatgaaattttacaatatggcattacaacttaacctaaattccaggaggatagtatagctcactaaatgatgagtaacaatgaagcatggttatatataaaatcagctacccaaatttagaaatagaggccacctttctattccaagataatgtaaaattctaagtattttgtcaagaaagagggaaaagcaaagataaaatgtgagcaaccgcttgtggagagatttaatatagtcctgtgggaattgtgccctaccttcactgtttttcctacaagatgcctcccttgaaagacattgcaaatgggttgatcccatgccacacctattttggagtgctgagaatgatttcctattgtttgcttcagtagcagtcattacacactcagagaagaggtacatcctttacagatattggtggcagcagatgccacaatggtttaactctgaggaccataaaccaattattcctttagaataaaatgaggagtgtagccttgcagcaccttttctggtatcctttgtgataagatgaaaggcgggtcaatacagaggaagaggagatgggttgggacagcaggggcagaagtctagtcacatccaatgtggccttgtatccagtttctccaatcctgagagaactaatttagtgagaactccaaagggctttagaggcaaccctgagccccgagcaagagttactgattcaaaagggtttaaacctgtactcaaaagatgtcctgcggggctgtatgatgcaggctgggagatgtacagctgattaccaacttcaccccctacctcgctcagaatagtcaatgagccaaacactggggcgttttcttgctcctgggaagatcgtgtacaatcacgactcactgggagacatcagttcactgtgatttcctagatcagagggcaggaccaaggttagcagcatttgcaatgctgaacatgacaaagctaagttccccatggaaagaaggggcaagatgtctgcttcagagaatacatacaaacagaagagaaagacaagcatggaagctcctaggaccagccatggatgacagggaaaggttcactgaaacttaaaaaccactgaattctagacctgaatcttttgcatccgtgtagtaggtgtgagtttaattataaccaattgcctttccttttatactggtatttctccatttctcataaaccattcatgattgataattaaaaattccgttctccatcttcatcactcagctggagaatcaccaatgaacatgaagaatgagcttcactggctccattactaacacaagtataatttgtatttgaaacatttaaatatttatttgcaggccagagagactctgcctttcagctggttgcccaaaaggcaaaagtgtgacaatctattgacaaggtatgagagacacacctgtctttgcaaatatatcaaaccagccttgaagacaaactttccagaagagaattccttacttaaaatagtttaaaagaaatcattctatttaatctcaattccaagcatccaatatgaaaggcaggagctaggataagtatgcactattcccatgagaaaaccatagtgctacaaataaccctcatgaactagtcctcaaagagcccaaatcctctgaagtgtagcaatgacatgctcaaaagtgatatctcttaaggtctcttcattcatctttactagtaagctttaagctgttgctaaaaatgtttcccatcataactgcaacactgatcttttaagaatcttctctaacgccaggagtaactatttctatttcttactcatcccctaactaagcttttctctctcttctcatttggtatcaaattaggaatcacaactctactatgcattactgctttctacctctcacaaagtggagggatgagatgataaatggggtagtttcacgttcaagaaacaaacaaggatttattttgaagcatgaattcttgagacaatttcactttaaatactggaacttaagttatattcacatggaaatatacatgtctttaatggattcactgtgttctgctggggttcatcattaggagactagtttttgctggaatcactgtgcctgtgtgaatagaaataaccaaatgcaaagtcacactgaggttttacagacacattctctcctgttttctagaaaagtacaggatccagaaaccacattctggatattcaaactctagacagcctagaatgatcagctttagaacattcagtgataactaacaacttcctgagagcacaaacccaaatcaacttaccaagttgcagatcatactctggtctgtctgcattgtgaataatgaagtatcctggggctgaaaatcaaggataaaaatagaagatgttttttaaagatatttaaatcagctaccatcaattgtgtctgcctacgtatctatctatctatctatctatctatctatctatctatctatctatccatctatctatcgacactctatctatctaatttttttttgagaaagggtctcctctgttccccaggctggagtatagtggtatgatcatgctcaccgcattctccacctccctgggctcaggcgatctacctcagcctcctgagtagctagaagtacaggcgcacatcaccacgcctggctaatttttgcatttttttgtatagacagcgtttcatcatgttgcccaagctggtctcgaatttctgggctcaagcaaactgccgagcttggcctcccagagtgctaggattacaggtgggagccaccatgcctggcctcaataaatattatttgaaacatgttcaagtccccttttattttaaatcattaagtcaaaacatgcaaaagtaagttttaataatagttattctaaatataagtctctgctagcagaatactatgagagtcattaaacagaggccactggcttcaggggcatctttagtccacagcttctcttctggccgttgatatcaaatcagaagttagtggttgaagctccaaaatttaaactttttaaatgttgtgaattcaatctcactatattacttaagtgttccttctatgggttatgtatgaaccatatgttaacatttcataaaatatgttcattgacctaaacaaatcaagctggaggaaatctaaaggaaaagtaatctctaaaggaaacttcatctctcattacattggtagccaggcttgcaccctccaaacaggagacccaggtgtctttcctgggaaatctgccagctcaaggaaaaaaacaaaatgcctgaagaaattgacatcaggggatgcctaacggaaaagatgagccagtgccttttggttgaagatggtgttttgaacacatgcagttgcctctgttacctcctgaatccaaactaaacaacaataaagggatttttaaggcatcaacctataagaatgaaaagaatgagaagaaagatagaaacaacaaaatgttgaaattggaaagcagatgaaagagtagtaacttggtagatcaaagaaatctgtatcctaaggtgatgctagaaatgctgcaaatcagtccgatttgttccttagaactcccagtggtgaaaaattagaagcataaagagccacaggaaacaggagtgagggtggtggtaacaacagaagaatagtaaaagtctattacaaagtcatcagacctcaagatattcttacctactaagaacaccaagcaacatccttgcctaccctagcagaagacttgagattaattatatagaggctgaaacagggtccctggactggggaacacacaggcacatcaggaaggtagaagcactgagtacttacataataaatattgagaccatgcacccctctctcgccactctgctcccattttttccccaatcacctccattacactagtagtcagacttgaacttcacagacaggagacaaaataaatcttccctgggaaatctggccagcccaaaggaaaaaaaatgcctaaagaatctgacttcagtggctccccaacagaaaagataagccagaaagtcctgcaacaatgcccacagtcaatgaactctatctacctgtacaaggttccagtcagcttttcagcatcccacttttaaatatgaatattcagtcaagatcaccaaacatttgagaagtctcaaatataaaagagagatggaatagaaagggttaagcaagaggaagaaacaaagattttgcaaaaataattcaaaatgattattaataccttcagagatataatggaagagaatcattcatgacacaagaagaagatgctattggaaaataaatatgcagtaaacaaaaagagttattggaaattgaaaaaattatagggtgaaaaacctgttagaatagttggcagagaaagtagagaaagacaacagagaaaaggaaacagcaaagaaacaataatagaatactagtcaggaagttaaaatatgaaaaagagaagtgttatggaatgagagaacaaaggaaaaaaaaagataaagccatgaaatatttttttaaaattctcccaaaccaaaacccataaattttgagattaaaaaggcttatacagtggatgaaaagagactcagaccatagcccatcattgaaacatttcagaaacactgaagtaaaaagaagatgctacaaagttccagagagaaagagagaaaaggaagatgaaagaggtaggaggagggagatagagagaaagaatgaggagaggaagcaggtttcttacaaaatatcaagaatcaaaatgacagtttcttgaaggcaacactaggtggtaggattgagtggagcgatggctgtaaaattataagggaaaatgatttacagcttcgaatataatacccaaactagcagtccagtatattaatatatatgtaggacatgttcagatgtgtaacgtcacaaatatacaccttctgtgtatgcacttttttcagaaagctactggaggttgtgctccacccaaatgaatgattaaaccacaaatgagaaaacttgcatcagaaaacagtggaaggacaggaaagagaggtgaaggcagtccccatgaccaacaggatggaagagccagtgagaacagctctacagcaagtcacagtcatagagtacccagttcagcccacagcagcccaggagaggaggacagataggcaatttcttcaagaagatgaaactgattgaatgtctagtgttttcagcaaaataggagatttgtataactatagagtatggggttgaatatgtgataagtacctagaaaactaagcatatcaatcaaaaggcaaataaattagacccacaatttttttataattaccacaaaggaaaacaaaaagttggcatgaaacaaaatgtgaaattcatgacttggctgttaatagcattttcatcactattacattaccacagattgcctggatggctttgatggaactctatcagaggaagggcaggaagcagaagagggggcgaattgggtgggtaggaggtggaaaatactttaagtcttcaccttccagagagatgagtcaatagataatactttagaaatcaagaagcagcattataagaaacccatgcacacatatagggcggaaacagagaatttgttgaaggaagtgaaactatttacctctaagaaacaggaaatgaagggagtgtatggtggtctgaagttttaaaataaaagcccttataaaagttgttacttttaaaattatgtgcattaataactctgatggaaatacaaacctgaaaagaatgagaaattgatgacagagcctatcataacctttcaaaggaattttctgaagatggaagagatgcattaacgtctctttgtatttgtgtgtatctgtatttggatgtgggaatatcagtgggtttttatctttttacaggtaacatgggaaaataatgaaacctttaaatacagaattctatttatgaatatattatgaatatatatttagagaattataaatgctaaattattagaaactgtgcatgtctgacattctgagacaaagcaggcatcacagacaagcctgtctgaggtctccattgaagaggttgtcagaactgatccaggagcctgagagccatgtggccggccttttacacaggttacacctgcctacctgttgggacatacacatacactgtcctaatgggacagttcatcttgtggtttctctttcacagactctcaagaaaaatactgccttattggacacaaccagcctatggtttctgatcttccaacagctccttcctggagaactgctgaagaggtaaggctctgtgcagtgtggctcctataggaatctctagaaggaagctcctaaaaccctctcacattttctaaagatccatctcattagttcaaaacaatcctagctcttctttagaacagctgaatccagtggatctctcagatcagaacaacttctaatttctagtagaggaatcggtagaaggtagaagcccatggtatagctaatcatattaataaaagctaaactaaagtcagggagaacttagtgtgtgctagcctgctgggctaaacactctgttgcatagctcatttaatcttcacaataatcatacaatgttgctactattctgtttccattactcagtctgtaagtagtggggtccaattttgtgctgatattcttaatcattacgctatactagtggcacagagaaccaaaccacattgaaaaaaatgtgcatcattctcagcagatggatcttgtaagaaaacagattccttacctgtgtgaatccattaaatgaaccaccagaagcctaaacagaaacgaaaatcagattgtgttattatttttcattatcattttgtaggaccagtaaatatccattagacaagttggaaagtaaagactatcacaagttttaaaataatacaaaaggttgctgtgcatgaaagaacttaggaaatgcaaaggccacactgtatgattttaaataggctgacaaaaaaaaaaagaaaggttaattttacaattattgctgctgcattattgcttggtgccaaccaaaacccactttctctataatgagaagatgattccagaaaagggccattaggagttaaattgcttgtttttcaggccattgatagaatctagaagaaacttctccagtgtttctacaatgcatcattttgatgaacagcaattatgatattttacagtttcagtgggcctgggttgaaacatttcgtgtgttctttttggagtggaaccacttcaggaacagtaaattagtctgtgctgctcttggtttagcacatttttagtacctgcatagtaaaagtgaaagtagggagaataaactcagaaaatgagatggtaacatagactgtcattaattcccaacacaatcattccgctttgtgtgtatgtgtctatgttgttgggttctttttgttgttgttgttgatgctgctgcttttttttttttttggtcaacctatttgtgtttggtttgcacagatttcaagaagtacatgacaatctgttagagagatcaggcctcctagaagatagtgatggataatgaagtaggtgacagacatgaggaaaaacagagcctacagaagtctttggctagtctatgctacagaccagggtaagtacctcgtctttgtcagcctctatttcttggtacaacaatccatatctctggttagcaatttcatcttcagataaatctgagttgttgatgtcctggtctcgggaactagcagaactctcagtgctagcattccaggaggtccccaaaatcaatggtcttgctatctcctggctttgttcccagcagctagcaatggcttgttccctacaatcacctgctagtaagtccaccttcagttcttccttgtgctcaactacatctgaatgtgtccagctattatctaagccttctgtatctctgataggccagtggttaatagaatccagacaactggcaaatccacttgcttggccatctggtataccagagaatcctgttatatccaaattattcattgctgaatccaagcttggctgccagatttgacctggatctgttccccaagagtctatctctgcaattcttggcaagttaacagtatgactacagttctcagttactgttctttcagacccttctattagtgaactttctgccttacatgaacataaatctcttctgtttgcatctcttcccagagaataattaaggtcagtcctagactgagcttctacttcaagttttattgataaaacagcctgatttttatccctgtcacctacaagagcatttaacacagtctcacactgaatttcttcagcatctgtactgtcttgtgctgggtaaaatatcatatcatggttgggagtgtctattgcatttttctttatgtcttttctagtcaaatcccatccctcagggctgccatcttcaatattagatacagagtaggtctggagagatggattcaagatatctgggtgattggcaggtttggctccaaagccttctatcattccacaattattgattaccttttgaattccatcatgtagaccttggtctctgtcactaagttcttttgccatatctcctccttccatgtccttttctaataggtcagttttctcaaaataattttcattggcgtttgtactttccttataccctgctcttagatcttttctagtttccacttcattaatttttaaggtcttatggtcttcctttcctatggtattaagaagttctaccactctgtttcctgtcctttcacatgctttctcttcaaattcctctgtaccttctagtgtcttgatatcaatagctccagtgtctaccttttgacacgcctccacacctgcccacagagaatcttccatcttctgtttctcttcctcttcatctgacttcttcatatcttcatgactttctttgaacaggccagctgtgtccatggctggcatgtctgagtcaagtgggtcatacagctgctccatctccacacaagcagcaatggcaactccagcctccggcgcaggctttgggggcagttgttcatttccacctggaaaggctggccccggggcatgctcactctcttcagctacagtgggccagtcagcagacgaaagcaggctggtggataatcttatgtcttgctctgtttcggagggacatgcagagtcttctccaaacccacctgaggtaacttcttggctgaccctgtctgtactagcgtcagggccccaagtaaatgcacctatatcattttgagatctttgaatttcttcggccaacccactgtctggagtttcctccatgatcaggttacacaaggaaagactttctgaagagtcagtctttaaagtatgcagaagagcaaaggaaaaaaaacaaaaacaaaagatgaaacagaacatggtaagatttgatgagaaacacaaagctcttcaggcgagtagcaccagtaaaaccaaactggaaagtgattacattcattggcttaaggtttaaatctatgactagcaatgccatggggaaacagttcattctagaaaatatactatgtatgtaatgcatatcaaataccaaaaaaatccagaatgatctggatatttacctaccggctgtaccaaatcagtgcttgtctgtatgggtaaagaaaatagtaacaataaggcgagagagaaaattcactaacacaataaaatcctatgctgtctagagtcaacattctgctgaaggctatagcttttactggtttaggaacaaattttacaacttgttttgtgataggaatgatttttgttccaaaattgtttaagaccaccatagaaaaggcacaaatgaaacacaaagaaagcctctttcactttctagcatcagcaaggatgttttatggctagtatatgacttctgctttagcagactctgaaatgctaagtttcaaacacataagcaagtttgagaacatcggaataagatcaagcactagaggtcaagaaattacacagtagcacacactttgacacagtatcagaagaaaatattccccaaactcatcctatacttggctctgtctttgagatgggtgtttagatggagaatggtctgatattaaccagtctgactgcctgcagagttctcttgatgtcattcccccaaattagcagccattttctccacataatgaaaaaatcttgcaaagttgagaagattaatagctgtgagcaactatgttcagaaagctgttgttttgcattttgatatcgctaccattcctagcaagtttgtcctctgaaacgttcaaaagctctttttagacgataccttcaccctctccataccctcccagcgagggaaggaaaatgtgttacagttccactaaagatataaaatattggaataacaaaaaatagcattgtctttttaatctccaaggaaattaacacagagttgaagttagaattcaaatgactcgaacatcaatccatgcatgcctttttgtgaatatatgagtaaaacttttcactagaaaagatataacttagtcattggtggtttcaatagacatttttaatctctcttcttgagcacttcccttgatgctccaaggatcttaaagagtgcagtatgagccctgcaactgcagaaggaagggacagacatctttttgttttgaagggagaaagaaagtggcaatgtcaattcagaagtggcattgcccatgaatagctagatctatcgaactttcctttttctgcctcacaataaaagaagaaaacatacaacttaagttgagttcttaagaccacatcaccagggcttttctaaaacaaagaccctgctccaagggatatgaggctgtagaggtgtgtgaccaatcacctaatttcacagcaccaatgagaccaccacaaagctctgtttgtgacactttcccaagtctaaattatggagtagttatccttacacatcagattagctgaaaaaacatcagtaataacatctaccttttattgatacacaccagacaccatgctacatactttacaattatcttatttaaacctcacacaaccttccgaggtaggcatcattacccttattttataaatgagaaaaaaatgatgcttagagagttttagaaattgctcaggctggccgcagtggctcacacctgtaatcccagcactttgggaggccgaggcgggcagatcacaaggtcagcagatcgagaccatcctggctaacacggtgaaaccccatctctactaaaaatacaaaaattagttgggcgcggtggcgggtgcctgtagtcccagctacttgggaggctgaggcaggagaagggtgtgaacccgggaggcggagcttgcagtgagccgagacagtgccattgcactccagcactcaatgaaacagcgagactccgtcttaaaaaaaaaaaaaaaaaaaagtaattgctcaaagtctcaaggttatgagtagtagagtttggactaaaatccagggctatctggctctaaaactcaagttcttattaacccaagcttcattgaatacaatcacttttttttaaaatggtaccatgtgccaagtagcccatctcttccattttctcattcacactttccttgtcttctatttaagtgtgtgtgtccttcactgcaacagctccttttgccaccaaccaccacagaaagaaacaaagggccaaactcttgaccattattcaaattattgaccattattcacccaggagtctggtccactgtactcttccttcaccatcatcttccggttctgataatgctcaagactttcagtggcctaatgatcattctaggggactatatcatcattaaatgtatgtgtcttctttctgttgcaaatgaaataaaatataacaaggtttccaaatttctggggatcaagatacatgaaaaaacagagttattagtggcttaccgtccataggtcccagggcaatgtctgaaagcaaataaacaaaaatactgttagttatacaaatctaaaacataaaaaaatgctgaggtgacaaaagttcttgaaatcataagcattttttaagcattttgtacagtactgttcaataaaactttttttggtgaaggaaatgatccatatctgtgcttatccagtatggtagccaccagtcacatgtggctattgagcacttgaaatgtgctagggtaacaaaaccacattttaaattttacataattgtattatacttaatataagcttaaatggcacttagctttggatagcacaggtctaatcaatctcaactttcactatgtgagtagaaaactatatttgaaacacaaatgaggttattttaatacacacacacacacacacacacacacacacacacacctcattaaaatgaagtaaacaaggtgtccaaattttagagcttgtcacatctttgaggaaatgcaggccctaatcactgctaatgctatttccttcccatctcattcaagaggatgtaggatgaccagcttaatggtaaatgagccccagaaaaatagttcttcaatatgttaaattagatgataacacactgctcaatgaattggtaatcatacaaattggcagagcaccccctaagacatgaatgaattacacttactactggtattttaattataaagcttatgaatcccggggagtgaggccagatggttcaaatggcttccactatgggtgaggggagcagggaagacttctctttcttatttcctttatgattgagaattgctgctaaagccacatccgattatgcccatgtctttgtgactagaatggatccacgtttatgcacttattttgaactactaaatgtcaacagcaaactagagagcctggcattgccaccttaaaaatatgatggttttcggttgagattgcagaggcctcatttgggctccgtattatagaaagcaggccctgtggttctgatacccacccacctggttgggtcccattctaaccgttctgcatggcctgccttgcatctccatgcagcctgcctggtctcttgcttagcattttctcgtaggatgactaagacaggagagaacagctccatggaaagccacagttttttgtacatggatctaatatatgttttctgattatctagatgattctcatttcattgcttcatagccacttaagaatcaaagatcatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcctgccactgcactccagcctgggcaacagagcgagactccgtctcaaaaaaaaaaaaaaaaaaaaaagaatcaaagatcataaaagctagtgcatgtctctgtataatgcacacatcaccagttattttctttaaaaggaaggcaggaaatatgaaatgtcatgtttatcagtcctcaggatcatgaaaggatgcgttagcgtgcacagatactgcagagatcacaagatgaggtgttctgctagcagcaagaacaccacttgaaaacatggggtcaggtgatgggtaaaggaggtcattttgagtgaagaggaaagaaaccaggcagacctaacagtgctatgctttttttgtcattcagtcaagacttttgttcttagcaaaagaggagaggtatgatcaaagctggactgcaggacaactatagtgtaatgactcagttatggccaccaggaggctagagggttttattacctggccctgaggaagagcacagggacacacacagcttgccgtcactgcggtgatatatgtccttcagaactaaaacttttgaagattaaaccaaggtcatttttgtttaattttgaagaatctcttagtcataaggccacacacagtttcatgatttatggattaatgtaatcatgaattaacataaaagaggtttctctcctgattcaaacttgtagacagaaatgctatgaaatctcacccactaatcattccagcatccactgcagaaactttgcatctgccacaaaagaaatgaagcatgggccgggcatggtggctcatgcctgtaatcccagcactttgggaggccgaggtgggcagatcacgcggtcaggagatcgagaccatcctggcaaacatggtgaaaccccacctctactaaaaatacaaaaaattagccagtcgtggtggcaggcgcctgtagtcccaactactcgggaggctgaggcaggagaatggcgtgaaccagggaggtgaagcttgcagtgagccaagatcgcaccactgcactccagcctgggcatcagagtaagactccatctcaaagaaaaaaaaaaaaaaagaagcatggagagtaaggcagaggaaatcctgtgaattctgcaggctgtctatataatgagaaatctctgagaaggaagtatattcaattatatgtacattcactttgtacttttcttggtcaccaaggtggaaccctcaaacttgttgacaatactttagcatttctcaaaatattgttttagagaacattccaatgaatattaagaaaagtgtagttaacatagatttctgtggtcaaacaaatttgggaaactctaagttaaacaaatataaacagtttttttaaattgcagaacttctcagcctttaatattctaatgcacatcatgaatcttctagaagagagttaatacaggaggcttcctggaactttcacctaagagacccttttgttttttgcaaagcatcttcaaggctagtgtttagactattaatttcttactttattaacaccttggacatttattgttcatattgcacaacaggaaagcctttagaagcccaatcacattctagaaaaaagcatggactagacataatccttatttattaaggttcatattgagccatttattccctagcagtttactgtgatataccaagaaggcttcaaggccagggaatcaagctaggtcttaattcctaggttgaatgttacaatattcttgtactaattcatttgaagcatactctagcaactttggatttgcctaaattcatatgtggggctccaaccatatgcaaagtacttatataaacagtttctgttttgtcaaattttgagttaacttccttctattagcacagacagttgtaaactaactatatttcagaggacctacccacaggtcattatggcacctaccaccagtatcctctgacagagaatgtaatgacagttactataagaaaggaagaaatatggagtgtgagggagtggtgagcaaaaaggcttggggaagcaaggcgactctccatcaaaccataaccatgatcacaggaggggagcttcttcaatggggaggatgaacacagcatcatcaagttcagaacgatcaacactgaaaacggcttctgctggcccgtgctttcatggtcattgcaaacacactttaacttgcaaagtatgaggaagggaagtagagaaaagagcaagaagagtaaacccaaaaccaaaagaaagagcttcatccagggaaaccataaaatgtatcctgtaaacctgaacagttctgagtgcaacgtgggcactggtaacaattactctgggggagaaaacaggaatgtatggttatgccagctctatgggtagagaaagctgatggcatgggagtcttagaataactgatatagataaggtcccctttctacccctctttcctattaggaaatatctgtcaaccaaaaataaaaatagatagtagtcatgaaaggtatagggatcattggttaccacactgagcttactgaggtttatgaaatatctccaaacatccaaaaagcacctgatacctgagacatgggtgagtgggtcactccagcagaacctgcaggtgtcacctcgggcttgaaaggatcaaagtccagatccagcaaagtctcctctttcttcacctcagggacttcattctgttaaagcaaacaacaaaacaaaataaaacatgtattagcttgaatctgataagaccatgatatagcccatgtatactctctctaatattattattgagtatctccaaaacacacttttataagcatggtggctcacccatatgcacccagtcactcagctaaatgcagtgagaaggaaataactaactctggccaagtataacctaagttgccctggaatgtgtcccaggctctagctcttgtcctttgtctagctccaagtccagtcaacagagagaatgttccaaggatgtatcctaatataccaagatgcaaggagtctcctctgtcagctcagagaacttggatcaagaaattacagatgacccaatcgataaaatgggccaagatctggactcattatagcaatactgctgatgttcttctgggaagctaaaattttaaaaggaaggtgccattgtgtactgctgaccacatcccaacggcctcattccctcactggtaccctaccccttgatttggttatcatttgatccagtcttcatccatagcattgttagtttcaattgtgtatgtgtatgagtgagggtgaacgggagggagagaggagagagacagccatgcctcccaacatttgctgcaaaatgagctcccattaataatatttttggattagaaagaaggtaagccaaataagacacaggacgaaagtcctgctttgataatacaaaaaaatctataatactaaacattatcatttgttcatttatttgtggtatcataatacatgaaaacaatgtgggcttgaagtcagcataacccaggctcaagttacacagtaaagggccaggctaagacaaagtcccataaagtacatcacagaaaagggagttggggtcagttttcatacaatttaaattacatgtgtttagcattcaatataaaattctttttaaaaaaactttgttgcctagaaattgaaacgtcaaaccaatgggtaaagtatacataaaaacagatttttggagacagatttttgaagaataggagttattctaattaatattcatcacagacattaaaaactgagaaatgtatgaaaagtgagggccagacacagtggctcatgcctgtaatcccagcactttgggaggccgaggtgggcagatcaggaggtgaagagattgagaccatcctggctaacatggtgaaaccctgtctctactaaaaatacaaaaaaaaaaaaaaaaaagaaaagaaaaattagttgggcatggtggtgcatgaccgtagtcccagctacttgggaggctgaggcaggagaatcgcttgaacctgggagacgaaggttgcagtgagctgagatcatgccactgcactccagcctgggtgatggaccaaggctccattcccccccaaaaataaaaaaaataaaaataaagaaaagcgaggtggtataacctaaatactttccttagcatatccgtactcattgcagaagaaagctgctaatatgtcatgctattagccttgcattttctattctgcagcacagtaactccccatatatactttttaaaaatttcacaaggataatgcccttctgagagctctactttctttactaattacaatcacaaaactatcaaccgattccctattcaaaatctgcataagctttgtttttccccaacttttatgtaggtaaaaattatatttttaaaatgtagtaaacatattatacttggagtatgataggcactgttcgaagaactttacacatatgaacattacctcatgttaacacactttggtgcaatctaatgttgacaacactttattgcctttaaagcatttatcttgccatgttctccagactgcattgtacctgccttttcaaatataatccttacaaaaaattgagggagagatggcagcaattctccatttgggagaatgaagagaattggctgaatggtgatctattgtcatggcccccagctgccatgtagcagaggtaagactgtagttggtacctctgactccaatgcctgccaggctgtcaactgatgccccagacccaagtttcttaattaggaaccccaaaaatctgcagaggaattctcaaagttctgcaagttctccataaaattttaggtcatgggaatatattcattatttccttttaagcataatgaatccccttaaggaagctcaaatgggaatttagagatgaaggatgaaatgaggcatcagactataatgggctatgctcagactttgattgagatcaatctgtggttataccccaattttaccacttgctagctgtctctccctggccaattaattgagcttctttgagcctcggtttcttcatgaataaaatgggattaataagacctaataggattaccatgagtagtaaagatgataaatgcacatgtacgtaatgtctaggaaatactcaaaatggaaatggaagctaatgttattaattaccattagcaacaatgcatacatgtgattatagtttggctctgtgtccccactcaaatatcattcagattgtaatccccatgtttggtcaagggaggaacctggtgagaggtgactggatcatgggggtagtttccccaatgctgttctcacaatagtgaatgagttctcatgagagttgatggttttaaagtgtggcacttcccccctgctgtctctctcctgccaccatttaagatgtgccttgcttccccataaccttctgccatgattgaaagtttccagaggcctccctagtcatgtggaactgtgagtcaatgaaacctttttttctttataaatgactcagtctcaggcaattctttatagcagtgtgaaaatggactaatacaacatgtgaatatgtaaaattactgtcatcaaatatccataatgccaattggactgccttcaaaatatgtggctggttttttcaggctcaacttctacttagctttgccctcttaatcttgagaattatcccttaaggtactcatgtcaaagaatattctggtaaagctacaaacatagcaaaaggattttgccagcttatatagtattcctttttaaaagggcaggaacgtactcacaactctgtcaccacatgttgaaacacagaaaagtgtaattttccttaacaagacaaatgaatcctgtacaccttcatcacaattagagtacacatggtatggtctcaacattcttagctttttgggaacttgattgtaagtactgctttaccatcagaaatctacaaggggtgacttggaatgtgctcctaagaaaggagaccagctgtggaaaccacagtgggagaaaatcttccaataggaaaacattgccaattataatcatctgtactatgtttcatgaggtgtcttctacttgggacatctaagtttatcagtaaagtaccggacctcttccagtgcagatgtgcaatttgagcataatcggcatgcctagccttgccacggcttcgtgatagatggattttacttccccatcccttacgtggggttgaccatatgtcatgctttagctaatggatattagttaatgtaatgcaaacaaaggctggaaatgtgcttgcatgtttggttggttggtttgtattccgccattcaccgtgaaaagtagagccttgcatagctgctagtccaaaaagaatgagagacacatgaagcacatgtggaccaatcataatctaattttctaatcagtgttaaagataaattcataaaaagaaccagagaaaagaagacatttcactaacagaggaacaacatgaaggtagcagtagatttctcaccagaaataatgaagcaaaaagacagtgaggcaaagtactgagaaaaagaaactgccaacttataattatatgccccttgaaaatactttctaaaataaaaattcaatgaagattttcagacaaacaaaatcagaaagaatacatcaccctcatatacacactacaactaatgtggaagatatctttcaggcaagggaaaaatgataacagaactatgcatctacacaaaggaggagaaccagaaatagtaactgcctaggtaactatatgtgagtttttattatttaaatcttttaaaaagataattggctgcttatacaaaaataataacaaaataatgtgaagtttaaaacgtagataaactaaaatcaatgacaaaaattgcataaaaaacagaagtggagaaatgtgagtatattatcattagatttttatactgtaccttaaatgacatcatataattgaaagttagactgtgataaattaaaatgtacactaaaaccctaaagtaacaactaaaatgacaaaacaatgttatagctaataagtaaataaagaaaattaaagagaataaaaaatgttcaattaatacaaaagaaagcagaaatggaagggttaaatgaacagagagacaatggaaaacaagtgatcaatgtgctagatttaaacttcaccatatgaataataaccttaaatgaaaatagtctaaatcatgcaattaaaaggcagagattatctaattgtacaaaaaagcaagacccaactagatactgtctataagaaactaacttgaagtatgtagacacaaataggttcaaagtaaaaggatataaaggatgcaccatgccaatctaacaaaaagaaagctgtagtaattacattaacaataaaaaaagtagatctcaaatcaaagaatattgtcatggataaagaggatcattgcctaaacatttatgcactcaattagagagcttcaacataaagcaaaaaccaagaaagctgtaaagaaaaataaaaaagcacacacacttttataggaaagacttcaatattcctcattcaataattgaaagaacaaatggagagaaaataagcaatggtataaaagatttagataacactgtgactaaatttgacctaatttacacttataacattctatccaacaacagcagaatatatattcttttcaagtgcacatggaaatgtaacatgataagcagtattctgggtcatcaaataggtctcaactaattcttttttaaaggtcctatctgagattttatttccaaaaacaaacaaacaaatgaacaaataaacacaatggaacctctttcttgcacagacaccagagacaatgctaaagttcccagtataactctattataaagacacatgcatttgtgcgtttgtcgcagcaatattcacaacagcaaagacatggaatcaacataactacctatcaatgaaggcctggataaagaaaatgatatatatgacagatatatcatatatatatcatatatatgatatatatcatatatctgtcatatatatcatatatatatcatatatatcatatatcatatatatcatatatcatatatatcatatatatcatatatatcatatatatatcatatacatacacacacacacacgccatggaatactatgcagccataaaaagaatgagatcatgttctttgcaaggacatggatggaactggaggccattgtccttagcaaactaacacaggaacagcaaaccaaataccacatgttctcacaagtgagagctaaaggttgagaacacatggacacataaagggaaacaacacacactggggcctattggaagtggaaggtaggagaagggagaggatcagaaaaaatagctaatgggtactaggcttaatacttgggtgaggaagtgatctgtacaacaaacgcccatgacacaagtttatcttatgcaacaaacctacacttgtacccctgaacttaaaagtttaataaaaacttgccctgttaaagagtacagcatgaaggtggctgccatatgcttactcagtccactcttgtcctagtggcttcatcaagtgagatacagccttcctcctctccctggtagtctatcctttgttttaagaccccatgtgtcccagctggaaaaaactgtcactgaatcacttctgccttcaactaatttaaaaacattcaagccacataaagtatggtctctgactacactggaattaaattggaaattgttaacagaatggtctctagaaaatccacaaatattttaatcatccaaaatgatctctgcaaaatccacaaataatactcttctaaataattcaatgagtcaaaaaagaaatcaaagtggaaattggaaacctgaatggaaatgaaaacaatatatcaaaatgtatgggatgctgctaaagcagtacttacggaaaatttatagcactaaactcccatataagaaaacaaaaaggtccgaaattattaacctcaccttctttttaccctgaatataaaaaaaaaacataaacagagcaataaaacccaaagtagaaactggaaattatacagattagagtggaaatcagtgaaacagaaaacaaaagacagagtgagaacaagaaaaagagagaatcaataagaccacaggctagttatttgagacgatcaataaaattaatcaacatttagccagtctaattggagtaaaaagagagagtgaacaaggatgcagattaccaatattaggaatgagagagggaaacatcatcatagatattagagatatcaaaaaataatagtaaatatgatgaaccactgtactccaaatacatttggcaatttagatgaaatggacagatttcatgagaaacacaaactacaaatacaaaaatctcactcaagaaaaatagataccctgaactgctctatatctattatatagaaatatatcaaaacaaaagaaaacacaacaaaacagagcccagatgagttctccgatgaattctatcaaacctttaagcaacaaataataccaacacaaacttaaccagcaattgattttcagttcaattcattcaataccattaccctagtattaaatcataaaaacccttttcttaaaaaaaacctataaattaatattccccatgaacaggaatgtaaaaattctagaccgagctttagcaagctgactaaaagatacacagataaaaaggataacatatcatcaccaaatggggttcatcctaggacttcatggatggtttaccattggaaaaccaataagtataattcaccatattaacaaactataaagaaaactcatatgatcatcttaacagatgcagcagagcatttgagaaaatccacattaattcctgtttaaaactctttaagtaggaataaaaggctacttcctcaatctgataaaagccatctaataaaacctacaagtaacaaacaccatgtttaaaagtgaaatactacatgctcttcctctaagatcaagacaagggtgactgctttactacttttactcaatattattctggtggtacaagaatgaaataaggtaggaaaaataaataaaaggcaccgagattgcaaagagagaagtaaactttctttattcataaaagatatgataatatatatagaaaaatccaataaaatctacaaaaaagctatagaaactaataattcagtttagcaaagctgcagacacagcatcaatatacaaaaaccagttgtacttatagacaatagtgtgaacaaccagaaaaaacaaatttaaaaacatgatttataataacaatataaaatacttatggataaatccaacaaaagatgtataatgtctgtacattgcaaactgtaaaacatggcagagagaaattagagaagaccattaataaagggagagatatactgcgtctatgcgtcagatgactcacatatcattgatctatagactcggtgcaacatgattcaatatctgtactgctttgaatagtattttcccccaccccccaaatttcatgcctatctggaacctgtaagtgtgtccttaactgacaacagggtctgaaccaatgtaataaaataaagattttgattagagtgggtcctaatccaatgactggtggccctgtaagaagaggaaaatttggatatgtagacgcaaggagaatgccatgtgaagacacagagcccacagacacacagggaaaatgccatgtgatgaccaaggtgcatattggagtactggagtgatgtatctgcaagccaaggaaccccaaggactttcagcaaccaccagaggctaggagagaagaaaggattgattctcccctagagccttcagagagagcatgtccctactgacaccttgatctcagacatctagcagccaaaactgttagagaatttttttgtggggggttttgtatttaagccactcagttgtggtacagcagcccaggaaataatacaatatcaacttacagttgattctgaagttcatatggaaattcaaaggacctagaatagccaaaacaactctgaaaaagaacaaagttgaaagactaaccctactgaccctgatttcaagatatcataaaatgacaataatcaatatagcatgctactggcacaaaggtaagctaaaagatcaatggataatcacatggtccagaaatatatccatatatatacatatatatatatatatatatacacacacacacacggtatatacatatatatacatatatagatggtatatacatatatatatacacatatatacatggtatatacatatatattagatagatagataattggttgtctgattttccacaaaggtacaactaattttccacaaaggtacaaaggcaatttagtagagtaagaatacttttcaacaatggaatattcatttctaaagaaatgaattccaacacacactttgtaccacataaaaaaattaactccaaattggtcacaggcctaaatgtaacacctgaaaataaaacttctaaaaaatattaagagaaaaccttgcgatttttatcttgggttaggcaaagaccttttagatgttacatgaaatatataatccagaaaaaaatggataaattggatttcatcaaataaaacatttctactctccaaattacactgccaagagaatgaaaagaaagccacatgctgggagacagtatttgcaaatcttatctaatgagggagttgtatacagaatggataaagaggtcccaaaactcagttaaaaaataaatacacgagaaaaagtttttaacaggcacttcaccaaagaagatatatgggtgttaaataagtacatgaaaaaatacttaacaccactagtcatttgggaaatgcaaattaaatcaaaatgaaataccactatcacttactagaatagctaaaattaaaaacactaaccgatacggtttggatttgtgtccccactcaaatctcatgtcaacttgttatcccagtgttagaggtagggtctggtgggagatgactggatcatgggggcggagttttcatgaatggtttagcaccatcctcccttggtactgtatagtgagtgagtgtcaagagatctggttgtttaaaagtgtgttacacctccctcctctctctcttcctcctgctcctgccatgttagacacctgctcttgctttgcctttgccatgaataaaagctcgctgaggcctccccagaagcaaatgctgccatgcttcctgtaaagcttgcagaaccataagccaattaaatctcttctctttataaattacccagtctcaggtatttctttatagccatgtgagaatggcctaatacattaaccatgccaactgttggcaaagatgtggaagaactagaactcttatgcgatgctgatgaaaatagaaaatggtacaaacacttcagaaaatctgtcaattttttaaaaaattaaatttattcctaacatatgatctagctagtttatccctaggtattcgcccaagagaaatgaaagcatgcatgcacacaaatatttgtatacaagtgcttatagtgcctttgtttataatagtcaaaaattggaaacaactcaaacatccatcagataacttgtgatatatccatacaatggaatactactcaataaggaggaatgatatgtgctacaacattaatgaatttcgtaatccaaaaactatgctttctgatactatatgattccatttatataaaattctagaaaatgcaaactaatgtatagcaacagaaagatgagtgtttgcctagagatgctggcgccaatggggaggagcaagagaaattaaaaagtggctcagaaaacttctaaacttcttggggtgacatatattcattatcttgattctggtaatggtttaatagtatatacatatgtgcaaactcatcaaatatgtgcatatgtaaacatgtacagtttattgtagatcaatcacacatcaatagagcttactaataacattaaaaaaaatctaatagtgggagatgggttaaacctaccatagcacattctcttaacacagtgctctgctgctatttaaaataataaaataaatactaaattgacatggaaatacttttgttatatttgtactaaaaatcataaattaaaaacctgacatagaatgatcacatttccaaaaatatacattttggttactattttttttttttgtttgtttgagacggagtttcactcttgttgcccaggttggagtgcaatggcacaatcttggctcactgcaacctccgcctcctgggttcaagcgattctcctgcctccgcctctcaagtagctgggattacaggcatgtgccaccatgcccagtcaattttgtatttttagtagagacagaatttctccatgttagccaggttggtcttgaactcccaatctcaggtgatccgctcaccttggcctcccaaagtgctgggagtacaggcatgagctaccacgcccggccacatttcagttactatttaaatggaaaaaagtggcattttacacacaaaattagtaaaagtgagttttgctggggaatagacttttacttttgaagttttactttttgcttctctgtaatttactatttttttacattaactatgcatccttttgggcatcatttttataagcatatcaggtaaaagagatttcaatatataactatagccataaaacatttagtagtgatgcatctgtaggtagtttgcaagtatttgattgacccagaaatctagcctccagagcacacacacaacacattttctgaggatcttaacctttagaatttgaataaaatgtataaaatctgtaaacacctcaaaaaaaccacttagaagtaaaacatatagtctccaaatcatcctcatggctgcatgcaaacagacagataaacacacacacacacacacacacacacacccatacacaaaatttctttaatcataacacagtattatagtaagccagattaccatgagggcatagagattttcatcttttcttcttctagagattttcatcttttattctttcattaaacatattttgaaaacctttactatatcctaagtattgtgctggacacttgtgacttcccaatgaggcaaaagaggtagagtaggaagcttaagacagagaggttaaataaaatctttaggaacaaggccaatcagaagttatcttttatgtaatagaaatacctttcatgtaaaagtcacaatttacaatttctaacagtgagtaaagttttagcatttcatcaacaattacaatgaagcagtggcctaggaaagtttaccttcgtggttagaagcttataacaagattgctccagatgggtacattacagttaatgtgagtcatatagcacatggacagggttcaagtgctttatattgcagtcttagaatggaaaatcgttcagtcatttaaaatgatgttgccaagtatttgttccacaaagtttattgtagtatactagtccttccttatttggaggagttatgttccaagatccccaggggatgcctgaaaccacaaatggtacagatagtactgaaccctatacacactatgttttttcctatacatacatacctatgataaagttgaagttatcaattaggcatagtaagagattgatgacaacagctaacagtaaaatagaacaatgataacaatatactgtaataaaggtgaatgtagtgtgaatgtgaatatagtctctcgctcgcttgctctctccaaatatcttactgttatgtagtatttttggatcatggttgaccatgggtaactgaaaccatggaaagtgaaactgtggataaggggagactgctgaacagagaattaaaaggatagtataatgcagatccctttactcacaatctagacctatcgattgttctctcacatttgctttatgtgcatacctatatttacataatcctgaaatgctctaggaatgagttgacacacaataaactagaccttctaggaaattgttttcctactttgttttgttttgactttgttttttattagaacaagttggtaggctgcaaaatcattcctagtgtagcacgtgggttttgttcattgcttttacatatattatgactaattgtataaaggctgacagtcatgagaatagagtcagcaaggaagagggatagggcctatgcttataatgaggttctactctgactagtggaaagacagatgactaaactggttgagtaaaggccctcctaccactatatcatggtatttaccaataatgcactgatatgtaacaacctgaagaactttgctaatatcaacactcaaacgagttctagagaacctgcatcctggatactaaggatagaaagagtgatatcgatttgttcatttactgaatgcccggtactgctctctttcgggtgcttacaatgctgtcacacatagcctacagcattctgctttccacttctgcactaggagaggcaaggttcagcagaaagacggcaggtttgctcttctagaaagtaggactaatgacatgtaaatcacaggattgatgtcaaggttaaactgaatgagaccttgcagaaagatatttagtagctttccctgttctgtagacagaaaaagcctaggcactgttagcagctctggagtcagaaccttgaaagatagtgaagcctaatgacccaatgattttaaaacattttcagaataccagatgatacataaactgcactgcttggttactcctgctcaaggaatggaacaatgatgttggtaatccaccagggcaatgaactgactaaatttgggcttgaaatgcactgtgtggtttttcttccttctaattttcatcttactaattctttctgtcttaaaataatgttaacatgtttactttgaaaaatagcaagagaaagaagaggcagctggtccagaaatatgttatgttgaaaagccagtgtggtatttagaaccaggttacagatacccagtaagtgagagatgcatatgttcataactgcaggctggcctctcaggattacatgggtgaaaaaaccatttcatggactgattctgcaagttgaattctatttcagttcaattggctagggaaaacagcatgatttaatgaacttaacaagtaagatgcagtattaggctggaaaacagagacataagggtagaaaagccaatggtgctcaattggtcccaacactcaggattgaaaggctgtgctcatgtctgcatgggagcatggtaggcattcctatggcgtgataagcagggcttggagaaataagcttggatgttcaagggataattcctctggatttgtaaaggggaaatctttgatcagagaaaatatgcaatatcatagttggagaaagatttaggaaaaatagttgggggtatctgctatgaaaaaatcctgagacaggcaatattttcttcctctctgccactggacacaaagatagactctggcaaagagggaccctgccccaagccctgaatctaaggggaccgtcatgcttttgagcacctttcttacagtttcctaagtcttcctctggcagaagggaccagctgcagctgcagtgccatctggtcagggcatcctgagagcctgtaccaggactgggctttggttgccatatctccccttcggagcactccccaacactactccatgtgtacggtcgattatatgcttctggaactctagggctcctatccacaaaggtgttgtgagcatgaagatggggcctgtttccaggagggtgagtggtaagatggtgagactgttctttttggtcagcttggcatttcacttatggaaacccctgagactggccatcagaatgttgctgataagcttatttcaagtgactccaactttttatatggaagaggtccccagcaaaaaatatttgctcagggccataatcctaaagggagggtgaacattggatttaaaatccagtcatcaagttagaagaaaagccaatccaaaacactttcttttttttttttttgagacagggtctcgctcttgtcacctaggctggaatgcagtactgtgatcatagctcactgtaacctcgacctcctgggctcaagagatccacctgcctctcagccttctgagcagctgggactacagacacatactgccatgcccagctatttttttttttttttgtagagacagggtctcactgtgttgcctagactggtcccaaacacctggcctcaagcaatcctcctgctttggcctcccaaagtgttgagattacagatgtgagtcaccatgtctggccccaaaacattttctgaggacaagaattgaaaaagagagagaaataaccttgcacatacacacatatttatgtgtgcatatacatgtatatatacacatgcacacatatatacgtgtgtatatacacatatatacacatgtatatatacatatatacgttatatacacgtatatatatgtgtatatacacatgtatatatacatatacgtgtgtatatacacacatacatgattgctttattttttgtcttgatctcttgttagaatcatatttatatggaatagatttgatttccagggacaaaatatcttttaaatctttatttcttaaagtgttttaccaaacacccatttcctaggaaagcatattttgggggtgaaggagagactgagaaattcttccctaaacaaagttgaatggaactttgttacagaacttttcagagccttaaacatgccgatgtaaactgtgaaaaatcaaaagggatgtagcccctcagtctcatgtaaacagagactcccttttcaaagcatctaatgatactagttttcctcataaacatgctttggaaaatgctgttttaaaagaataatgtagggacacaaacacacaaagaggaagggaaagaaaaagagagagaatggatttctaagttcttaggatggaaaaatagggaacaattttttggacctttggaagatctgtttttgtaaacacaaaaccagaaaagcaagtaaaccattgggtcataaccacggggcatctccctacaagcagataagaacatttaccagaaaaaattctatgctacatttaaagtttgggccattagagggctctccagatctaatggatttctgtcttcaatcccaggacacactcaggagagaatcatcaccgtgatggtgcttggtggaggagacaaacaaatccatctgagactgggtacatttcagtcattacattttgagcttctgggcaggaataacacaaatgcttttcttcccccattaagtgcatgataaaaatagcaagctggggacatagatcaatcttctaaatgtaaatgactcatttaaaaaaattaaaataaatgtagacggatcatcctatattgctatatgtgtcagagaaaaccttttcaggtacatcaaagctgtctagttttcaatgctgtacttccttgcagttagcatctcatttttcccaggtattgttatttattctcttttatctatttatctgtagattatcaaatacattattgtctggatgatacagttcattcacttataatacgtagctcgacctataatctgatcaacacatctaaggttataagcactcatgtgtatgtgtatgtgtccaactaccctaaatatggaagactttgagtcacactagttttgaagggagcagttatgaatggtcagtcatagcacacacttgactcagctgggtatttctctggaataaatctattaattcactgtggtgctttgttaatggtcactgattagtgccatgtggaatcctgataactttaaacagtggctcccacagtgtggtgccaacaccagcagcattagcagcattttcctcagaaatgcagattcctgacctcatcccagacctgccaaatcagaaactgctggatgggctgaagtaacataaaatggctatttatagctacagaggaacaagccactgaagaaactgccaagatgcttcagggagagacagcatctgtatatttttaattaaagccagattatgtcactcaataaaccagaaagcagacagaaatataaatccctgtttcactcccgcttttgacatcttgacatgagacaaatggtcatttaatccatggaaacactccaagtcatactctgtggtccagctgctagagccatgtcgcttttcagatttagaaaaatggcagaaacccctttctgactcctccccagattagaagaaaacaatataaataaggctgtgcccccgaaaatgcactcctataatgtctctggtgcttagttcttccaaaattgcctggaagactgaaggatgtgacacacagccagtgagatataagaggtattgatggagagacactgaaagctcccacattcctttcccagcagccttggggttatgcataaagcactagcaaagcctaggcaagcagacccgggaatagtgtcctcacaggagctgcagctggaacatgcttctgtttggaaaggcacttcctctgccccagttcttaacttttcccatcactctcactcaacagtaccagcaaaagcgaatgctcttttaagtacttaggggactctcctggcatctgtaattttcaaaagtgctttgatcctttttccccccaccatcaagtgtccttacctatgagccagcaaattacaaatacaaagaaaaaacatttaaaaagaaagaacacttctgaacctcatctttacttcacaatgagtctgcatgtcatgttgtctctacttcagttgccttgtctaccaaatggggatgtcctcagctaagcacacaaggcttctaggtgaccaaagtctctatttgtgatggaactgagaggatgctcttggagggtccaggtcaaagcaactgagtaagggtattgttgccttaaaacactcccagttcgaaaattcatgtagcgaacaaagagaatgaagctgggcagtagcaaatgcaaagggactgtacaactttggaaattagaattgctcaagtttgtcccaggacaactgggagatgctgggtaagatcctttggcactaagacagctatccctggcggcatctcggtatccacagacatacaatctggccatgcaccgataaacaccattctcaaaggagctgctaaatcacatctcaagccccagttaattttatcaaactcagcatcttatgcatacaacagaagaaagaaaacaatagctcaaagcattttgcctattgataagtgtgcttgaaaagaatgaaaaatcatgatttgccactgcattgtgtctgagtttttattttctgaggtccctattattatcaatacaccatctctgctattattaatatgatgtgattataatcggcatattacgcatagtgtagtgattgatgtactcagtaattatagtactgcattagcacctcttgtaaaatgtaaatattattccagaccctgagaacactgagaagaaatagtatcaccatgacttctgtatggtcttttacttgtagaaaaaagagatagtttcagtgacactagaggcagctctggaagtcatgataattcttgagtcaattaaaaaaaaaaacacaaaaaacagccactagcaggaacaggcctgcaagtagctgcggtgggatatgtgaacccaggtatattcaaaatcagtaggaacactgactttcatttgccaattcatgtaaataatatgcccctgttgaaggacaaaagacttaaaattattcacctctttcaatttcatttcctatctctactaagaatcaatagaagacataaacatgaaataatatataaagagatgtttatcgaagtgctggtgaagcaacaaaaaagttggaagcaacttgtggccaataatcaggggttggtacaaccaactgagagaatactatgggcaaatatgtttttgcaaacacaatattatgacatgaaaatatgctcaataaaattaagtagaaaggtcagaaatacatgatagtacagtctcaattttatagtgcaaaattgatatatactcagtgatttgggaagactaaaagaagacagaccaaagggcactagtggtcatgtcagagtggtatgatttaagtgattattaaaattcttttttttttttcctgagatggagttttgctctcgttgcccaggctggagtgcaacggcacaatcttggttcaccgcaacctccgcctcccacctcctcctgcctcagccttccgagtagctgggattacaggcatgcaccaccatgcccggctaatttttgtatttttagtagcgacagggtttccccttgttggtcagacttgtctcgaactcctgacttcaggtgatctgcccgccttggcctcccaaaatgctgggattacaggtgtgagccactgcgcccagcctacaattctttattctgggagattctcaagatggccgactaaagaaaactagtacatgcttcttccacagagcggaagcaaaatagcaagtagatgttcacactgtgaatagatcacctaagagagaacactgggattcaacagagaagtgatgggaagcactgaaagcaagcaaggagagggcagcaaggctttcctcagctgggatccaggagaagctcccagatgtgaggaaaagataagtgagaattcccaggactccacatacccaccaccatctttttacaaccctagctatgggagaacccctcaactgatatgggcttcaagatttacatgggtagctgcctagggaccacacagagacattgttccagagagagaactcacaaggagccccataggcaaccatgtcctgagtggctgcagcttgtaggcattctgagctaagcccccaaaaggactgcattctgctctggggcagatactgccactgtcatggccaggccaagaagggagaggagaggcctcgcactttcatgtactgctaggagaaatcctatgcacctctgagggctgctgtggaaccaagaaatgagaaaactgcactccccacagacccacagctacctgcctatactacaccaccttagaggggcccccaccttccccagttgcagtgggtgccattctgaaagcctagcttccaaaggtctgcatccctccctggggccaaggctgatgctactgctgctaccaccaggccaaagagggagaggggaagccaggcacttgcagacactttgtggacaaatcccactgctgctgctgcaggttgcagcgggaccaaggcacaaggaaactacgtgtcccacagctacctccctacactgctcccaccatgagaggctttgacctccctaatagcaggtccgcagggcagtgtggtgcctcctacacctgaacattttgtcagcaggctggaaaccaccctacccagcatgtcacaaccagtgtcaatgtagcttgacctcaggacaagctattggatcaatcttgtcaccccagtgcttcagcatgctgttcaggggcctggaaatctcccagcccagtctaccactgttggcacctgaatattcctcctgggtctgagattgggccagcccaacctgccaaagctaccacaggtggcacccaccagaatgcaccagcagcaggccaagggactggcacaccccacctgtcatagctatcaccaacaccagagtggaccacttgggttcccgtgggttactccaccaccgctactgacatcacccacatcacagcagctgcccagagatttgagaacctgaccacacactcaacctactgctgccactaccaatatctgagcaagccacctggagcccaagaatcagcctgtctggactcactaacactggagctagtgtaacccacattggagccaagcacaagcaatgctcagtctaccactgcctccactggggcccaaagactggtcaacctggcatccttgtcctcagcaaaactttaccctggccccctgctagcaaatgcaccctaagtcattgaggaaatcacaagtacaactgacactatttacagccaaataaattatacaaagatcacactactacatgtggccaaaatcaaagccaaaatgtccgacccaaccaacaacatatatacatcttcagagaaaagccctcccctacaaaaaccaatttcaaagaattggaagaagcaaccagattggaaattggaagttataccagatgcacagatatcaacacaatgaaacagaatcataaaacagcaaggaaatatgacacttccaaagaaacaagataaagaattcaaaatattgcttttaaagaagctcagtgagatacaagaaaattttgaaaaacaaagaaatcagaaaaacattttaggatatgaatgaaaaatttaccaaagagatattttttaaaagaaacaaatagaaattctggaactgaagaatttgttgactgaaatacaaaacacatttggaagtttcaaccagaggctagatcaaacagatgaaagcatctcagaactttaagacaggtctttgaaataacccagtgagacaaaaataaataaaaaagaatggacaaagccttcctgatatttgggacaatataatgcaatgaaatatttgaattattcgtgtccttgagggccaagagagaacaaatgggctagaaaatctatttaatgaagtattaggttgaaaacatcccaagtctagcaagagacctagccatccagatataagaagcccaaatatccttaaacagatacaatgcaaaaaggtcttctcaatgctatattacagtcagactatgtactaaggcaaaaataaaagacagaatcctaagaacagcaagagaaaagcatctgtttatttagtcagtttatcttttaatttaatctgttttctttcaaggctattactaatatgtgaagttttgtgactgtcataatgttaattgttttctggtcattttgtatgtgtgtgtgtatatatgtcacatatatatgtcatacaatgacatatatgtcaccatggtttggtagtatactgcagtagtaccacttgagtcattcctcttcctcatttgtgtgtttggtctcacaaaaagattgcggagggatggagggaggtgggcaaaggtaaaatactacctactagggactatgttcactatctgggtgatgagatcattagaagctcaaacctcagcatcacgcaatatctccatgttacaaaactccacatgtatcccctgaatctataataaaataaaaataaagaagtctcccaacaaacagaagcctagaattagttgaattcacagcccaaccctatcaataccagtcctcctgaaactattccaaaaaactgaagaggaaagaactctccctaactcattctacaaggccagcactatcttaataccaaaaccaaacaaaaacaccaacaacaaaaagaaaactataagcaaatattcatgataaacataaatgcaaaaatccttaacaaaatactagcaaaccaaatccaacagcacatcaaacagatgacacaccacgaccaagtgggatttatatcagggatctaaggatagtttaacttatgcaaaacaataaacctaatatatcacatcaacagaattaagcacaaatctacatgattatctcaatagattgagaaaaagcatttgataaaattcaacactgcttcatgatgaaaactctcaaccaactaggaaatagaaggaactgacctcaaaataacaaaggccatatatgacaaaagcacaggtagcatcatagtgaatgggagaaaagctgaaagcctttcttctatgaacaagataaggaacaagataaggatgcccactttcacctctcccattcaatatagcactggaagtcctagccagagcaatcaggcaagataaagaaataaaaggcattcaaattggataagaagaagccaaattgttcctctttgctgatagtatgaccttatagctagaaaaaatgaaagaatccacccaaaaaaaacctcctaaatttgataaataagttcagtaaagttgcaggatatgtaaaaaaaatcaacatacaaaaatcggtagcatttctgtacaccaataaagagccagaagggaaagaaatcaatatggcaataccatttacaacagctacaacaaaataaaatacctaggaagaaatttagccaaggaagtgaaagatctgtatgaggaaaactacaaaatactgatgaaagaaaattaaaaggacaaggatcagaaaaattaatattgtaaaaataaccataatgcccaaagcaatctacagatacaatgcaacgcctaccaaaataccaacaacattttcagcagaattagaaaaaatcataaaatttgtatgaaaccaaaaaaagagccaaaatagccaaagcaattctgagctacaagaacaaagctggaggcatcacattacctgacttctaaacatattacaagtctatagtaaccaaaacagcatgacattggtataaaaatagacacgtagaccaatggaacaaaatacaaagcccagtaataaatccacattttgacagccaactcattttcagtaaaggtatcaagaacatatactggggaaaggacaccttcaataaatagtgctgggaaaattggatatctatatgcagaaaaataaaactggatccctgtctctcctgatatataaaaatcaacttaagatgaattaaaggcttagacataagacccaaaactataaaacaactagaaaaggacatagggaaacacctcaagacatcagtttaaggaaaattgcatgggtaagacctcaaaagcacagataactataataataatagaaaaaatgaggctatattaaactaaatggcatctgcacacaaaggaaacaataaatagggtgaaaagacaacctgttgaatgggagaaaatatttacagacagacattcaacaagggaataatattcagaatgtacaaggaactcaactcaataattaaaaaaacaaataatcccatgaaaaagtgggctaaggacataaatagacatttctcaaaagaaaacatacaaatggccaacagatatataaaaacatgcttagcatcactaagtatcagagaaatccaaatcaaaaccaaattgagatgtcatcgtaccccagttagaatggctattattaaaagaacaaaacataatagatgctggcaaggatatggagaaaaaggaactcttatacagtgttggtgggaatagaattggtgcaactagtacagaaaacagtagggagattcctcaaaaaaactaaaaatagaactaccataagatccagcaatcccattattgggtacttatccaaaagaaaagaaatgtgtatatcaaaggaatacctgcacttgcatggttatcacagcactattgataacagtaaagatagagaatcaacctaagtgtccattgatgggcaaatggatatagaaaatgtggtatagacacacaatggtatagacacacacacactactgaatcaaaaaagaatgaaataatgttgtttgcaataacatggatggagctggaggtcattatgttaagtgaaataagccaggcacagaaaagacagatgccacaaattaataatatatgggagcttagaaacaatcgatctcatggagatagaggatagaataatagataccagaggctgagaaggatgtgtgggtggaaggaggagataaagagaggttggttagtggatgcaaacatacagttagattgaacaaataagccccaatattcaatagcagattagggtgactgtagtcagcaacactgtattaggtatttcaaagtagctagaagagacgacttgaaatgttaccaatgcatagaaatgataaatgctcaaggtgatagataccccaaataccctaactcgatcattccacatcctatgcatataacaaatacatgtgtcccataaatatgtaaaatatttggtatcaataaaacaatttttaaaaataagataaattattcattttacacttttcaatatttttccaattttctataagtatatactacccttaattaaaaaaaagataattttcaaataccgtacatctcccatgtaagaatgcttcagactaaccaagtaattaaaacaagcctgaatgacaattaaaattatgttgttggttctggaaccgccactttctttagggctagcccctgagagtccttccaccatgggactttcatggacataccagccctgaaccaggcacttacctgggaaggtgttgtcacactgatttctggaacaaagttgtcctcaaagaaactgatgatgttctcctgctgcagttcctttgtcggggtgactttaggtagaggtgggacaggaggccctttccttgtctaggaagcattaaatacaaacattaatccagccaaagacaatgtgtcagacacgaagaaaggtcacatgaacagagctacatggacagattgagctctgattgaaacttgtatctgcatatagcagcaagcctatctgatacaggtaaagaatgctgtctacttgtgaggctctctgagccctgataagccatggttcaaggcaaaaacaaaactgaggctataagagtccattcatctcaactcaagtacaatacacagagctgtagggccaggcacatatactttaaaggttaaactagggcaataccctcttctgaactaaactgaaaataatttctcattttggaaataaattaaaatttcaaaactaaagcagcttttcatttgaattggtgagacctactataggcagcttacatttcactttccattcaaggattttgaaaagtagaaaactttaaaggtctgtttaatgcatgtatcttcccaagactttccttagttcaactacatatagatggtcctcaacttatgatggttcaatctatgatttttttggactttaggaaagtgtaaaagcaataggcattcagcagaatgtgtgaaaacactctctcatgaggcggggcagtggcagtgaaccacacttcccagttagccctgtgatcacgagggtaaatgactgctattatgttctacagtgtactatagtcagtaaattacacaagatattcaacacggttataaaataggctttgtgttacataactttgtctaactgtaggctaatgttaagcgttctcggcgcgtttaaggtaggctgggctaagtcatgatgctcaacaggttaggtgtatttaatgcattttaacttgcaatattttctacttacgatgggtttatcaggacacaacccctttgtaaggcaagcagcatctgtacaagaaagcttgaactggactggggactataaatttttctacagaaatttcattttcacccaacatagggagaataaaggtggtagtttctctctacagttacctttgcccagcccttattgtttctcttcaattatttcttcaattcaattttattaagtggccactcatatgcaagtgtgtgtactaaaaaatgtccaggtgtaccaaaaaatgtgagatgacatataaacataaccgcttttcttggcagtacctgccaactctaaaccactaggagagggaaggtttcatgcagaggtaggatttaaatggagcattgaaagaaaagagttttgtagcaagagataggagaagagagagcatgctcgcctgagcatgccgagaacgtggtaagaagtcccaaaaaacttgaatatagggcatgtgaggaaatatcaagtcaaataagaaaagcaggtggataccttcatgacaatcacaatgcctaaagcctcacatctcagtctccctaactggaaacttctcttaaagccccggcaccgtgggattatcctagatggggccaccttcatctcatcatgagctctatcccccaatatatttgacctcttcctacctgtgaaggtgaccgaggccgtgctggtgcgggagacgcaggtgctaatgtatgatttggacttgctgtcgggctcgggaggggtgaaggctcctcaggcggtgatggtgtctttgcaatgcggagaggacccgaatcactagaggaacacaggggattgggcaaggggccttctcaagaacagtattcatctaatcaggggttttccatttcagagaaacccagaagcctaacaggtactgtctgttgtcctgctctccccttccaggttaattctggttaattgcaacagtgatggtgataactggtaccatttatttgcactacagagacctcattcatgtattatcttttgtcttcacagtagccatgttttattgtccccactttacaagtagtaaagtggggcatagataggttaaaaataaaaactctaaaatcacccagccatttagtgaatctgaattcaggtcttagtaatgcaagccctctgttctttcaaacaagttctgcaagaatcttccaaacataagctgaattgattttactcgtttcactttctatttacaagagaatcttgccatgtcacaatctataaaaaactatgaaaattgtaacttttatattaaaaggtaaccttaggatagtgttagtaaggattttgtagaagtgctttctaataacatttggaaataaactcactaattatttctctttctagaccttataaataactactcaactcaggcatcttgaaatgtgcaacaaaatcagacaagattcagtttcgtttactaagaacccaccatgttcctggcatgcggccagacgctcgggaacagcccaaatgtgatgactaagaagcactcaggacacatcctactctctaagaatttctaaagtctacagctcgaagaaacagagtctgtaccccaaaataaaagagcatgtacacagcagcatggtctacatattcaaagggctgaggaaactgggtcctttagcgagaacacagacatgccacatgattggggtcatatgccagcaatcatggcctcagatggaaacatagccccaatctaagcttaatagagatgccactgagctcactcaccacctcattctgcagaggaatgttgaaaaaaagtgaaaggaacattcattaagtggtcatggccccgctttttcttcactgtatctcatttggcaacattacaattttcagatgaatttgtccctttcatttccatgtaagggaacaaccctaaattttttcatgcacttcatttttaaaacactcaaatatcattctgatattcccattccaattcttccttcgtgcctagccccatactgaaataaccatactgaaaacagtaactctgcctctcttatgtattctttcaggcaatattctttcccttagaaagagaagatatactactgcttacatagtatagaaaccatagcagaacctataagtagggctaatccaaagagcagggaataagaaaattaacaatctctagagggatccaaacattaacatatgtagaagttggttcatgtgtatgactatgtgtgttttcataaatgtatgcaaataagtgtttgtattaaaatggcaaatatagaatgtcaggactgtatattaccttggaaaccatgtagttcaatagtatctttttttttctattgaattaaaaaaaatgagacctctaaccagagaggttttgaacttactcaaggaaggcaaagcaagttaactgcaaaatcagaaaaccgaaagctgggtcttctgactcccagctcactagccttcaatctctgagtacgtaaagtctacgaaggatggaataaaaaggattccagaatcactggagaaagctggtgtgcagccgaaccctggcaaggtagacaggtcacctatggatcattggggctccggggtatttgactggcatactcataatgcaacgtgcaataaaacaaaaacagcacagtgttcaccagatcaagagtcaggaggtaagaggaagatgagatctcacctacttcctctttcctttcccaaaatggattcatgaaagacgtcagcatcaatgataacaatcaagacaaactgtcataaactttgggaattcctttcttctccggagaaaatattaagtgcataacaaattatatattacaacaagcatatacattatatattaaaatttcacactgttgctatcaggcctcatggaaagcagagagaggcagagaggcagaaagtcaatgctgttgtgacaagaagaagaatcctagttgggtcactgaaggccagacataaatgtaaaagcacaaaaataaaattagtgtcagcttctagggtgaaaaggctcctgtgggacttttgtaggataaataaaatagtacaggctggtccacagattgaagaaattttagcaagcaggacattacaggtgctccaatgagcaggggcctacctgggcgctccttggatggtgaaggccttgtcggcgtgctggtcacccagttttgtcatcacttcatacagtttgtggcaaagctaaggggacagaggccacttgtctattagtcacatgtcattctggtgccaattcaggctattctccccaagaaagaaattgcttattgagaagctataaattttatgatagcttggatggcctcaggataactgaaattctgtatacggttcaaatttaaaatctatgtcaaaactgaaacaaacgaaacacgagtaaactaaatatatatgtatatatttattaaccagagtacagggcagaaaacaaaagcttactgtttacattgactccacccttttgaacaacaacaacaaaaagcaatcaacaacagagttgattatctaaatactttgagagcaatttttcattagcctaaaataccactgggaattccaactttataaactgcctggtaaaagaaacaacactgtaaaactgtggcaaaatcttcaaaagatacaaagaactatgtgatcactatgaaaaaccgtagaaatgttatcgagggtaataacacactgctaaaagaaacatacaaaagggtgaattctttggataattctatcccatttcatttgcttccaaaataaaccttcctttactttatattccatatgcaaaaattatcgtcatgactcaccaccgcaatttccttatgaaacttggcttcaaggctggagacgtttttgaaagtattaacataaaatccaactcgtctgccatgtggaaacacaaagaggaaagaagagagagggaaagaccagtcagtaaaaataattttaatagcaatgaaatgtatgaaaacccaggtttcttttacaccattttgaataactttggactaaataaaatactgaacccaaagcaagcccaacatttcctcatctgttaatgaacaaaaacaagtatcttttggcatagagcatgacctctcctaaaattcagtgccttaagacagtgattctcaaactttagtgtgcatgagaaccacctgaagggtgtgtttctgatctagtaggtctgaacatgaagactgagaatttgtatttctgatgagtttctaggtgataactgatgctgctgattcagagacaacgcttatggaacccccgccctgagaacttatttatattttagttactgtttcttgctttcaagatttgagaagttcattattaacttttataaactataaatggtctagttattattatgtgtttggactctgaaatttgtttcatagaaggaaatacaaaacccgtaaattaattctaactgctcatcaaaaataagagcgtgtcatcactgagtaaatgaaaacataagctgccccttcataatagcaatgagattaacttcttctatggcttatctttacttaaatccctaacatatttgacttaatcttaaatttctatacctacagtgatcatgtgaccctgacttcatatatttttcttttaattgattttaaaagatcatatacttattcataaatacatgtgcatatacctattcatatgcatacaaatacacatgcatatagacatctattcattaataaagaaaatcctccacagtgtgtttgggaaatggtaagcccccaggaagatcagaccagagcctgggagaggaaagcctagtgaggaagcagatggttctctggggcagaggtccttgccagaccacgaagcacaatatttattggcaggcagtgggcaaaccctagatgtgtctgagatagggcaaaggagaacacttgcacctgtatttgaggaagctaattaaggcagcagcttgacaggcaaggagagaccctacaggctacctatacattatgcagagggaccccactcgcagtgtttgcagagaagtcttctggggtactttgagtggcaactcatgaccccttctccaaggccccaatcaactgggacagtaattcttaacacttttcttccttcaattacttccttcaattactcaacaaaggacctatccaactctgggtacatgcacagtggtaggtgaacatgtctctaggaacgtacaatccagttagagaagcatccagaggggctgctctatttatacttacaatggaaatatgtgtgtgtgtgtgtgtgtgtgtgtaagagaaataagcagattttatatatatgtgtatatatatatattagaaataagcagcttataaaaccacatgggaatgttaagttacaacaagaaggcatacatgattacatatcaaaagtgagtggatatgggcagaaacagagaaactgagaagagaggagagcaatgggccctgtgacagctgcaaacatctgcttaagaggacaaacttgggctgcagaaagaagtgtccaatttaaatagaaggtgggtacagatggaagaggtgtgtaagctgaacttcactggagagtattattttatttttattaatttttttctatggtaaataaaaccctaatgaatatctatgattaaggttttgtacacagcttattcatttccttaggacagatttcttgaaggtatttgctggtaaaaggagtgaaccaaataagcactgatgttcaccgtcagactgctcaactggtcgcactagactgggccacttatagtcccttacattaccttacatacaacctttataaatatgatagccaaaagttagcatctcactgactttgaagtttatatttcttcaattaaagttaacactttcattcatttatttattgctcatttgtattccttcttttgtgaatcacctattcaaatttttttatttcttagtattgtttttcttatcaatatgtaatggcacttctattaaacatatttaactttggatgcattaggcaaaaacaaaaaagaagtcccattcttctatatttcaattttgttttctgatatacagcatatcttaagttgtcaaatcaattattatcctgagaaaatggtatagtatcagaaatatcttatttagaataactaaacatctatttctaatattttgttttttaatttagaaattaactagcatgtatttaattaggataaagtgtccaacatttttgatacaactgatagtgattttctccaatttatgaagtcagagatcctgcaaagaggggaatgcctttaactagttcactattacagccctagcacctagtacacggcaagcatgagtaaatgaataaattccataaatgaacaaacaagccagtgaatgaagaaacttggcactcattccactataagagcatattccgatgtgaccctggcttgtaaaaacttaatgtaaccagcagtagaacatacagacggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgcctcaaaaaaaaaaaaaaaaaaaaaaaaaaaaaaaaaaagaacatacagacacagagtaccagcataccaggctcttgattctgatattatctgcttaaaagtttcattttgcacagggactctgagacatcaccatttccccaaatgtggcatcctcaggacacttcttattagctgtcaaaaccaacttaatttctttattaagatgtttctttgttctcagaaataaaggaaaaattaagttgagcttatcacagctacagattgcagacctgagcactctccccttcgcaatgccctaaggaaatctgcctccctggaggggagtgtcagtgcttcctgcagaccctcttgcagtggaggaggcaacccttgctgtccttcacttactatggagatggagtatgaggaagagttttttcctagctctcttctgatcctctaagctcatttacactccatttcaggattaatggcactcatattaaacctcttcaaagcttaatatcaacctctcagcaagactcctcaaccccaaccacaatccacaatggcatgcctcatggtttcccctctctccctcaccaaatcctaacactaacacagtagatctcaacaaccctatgactatccagccaaaacatgagccctctaactagggaccccagcattctatttatacacattctgcattggcctctgacatcttggatcttgccatgactcacaactatttcacctctgaaatggggcagattagtggcccacccactaacctaatttcctgggccatgagctccctcattcattcatttccattccacctgcttctttcaaaacctctgtgagatcaatgcacttttcttccaggccactacccttgatcaggttgaacatcctgctttatcaagcttgggccctgtggtatacccctcaacactctctggtcagtcctatcaacacccttcctccttgtcctgatcccctgtttgccccacatatcttcagtcctaaattattccacctttaccacaactatgccatcttctcaaaatgacaaaagttatttttagaaagctccccttgccctctaatttccctataccagctgccacaattcctcaggcccatcatagttagaatcctcaaaataacagacactgttgctgcttcctcatctccaatggagtctccaatgcctataatcaagcttctgatcccaacatctactgaaacccctctggacgtttaccaaaggtgatgcctctttagtcctcatctgcttgatacctctattgtaaatgatagtcctggcactcctcatttttaaaattctctccattcttgcctttttgagatatccctctgtcatggctccttctacatctctgattaatttttggaaggcttttccacagtcccctcttcttttgcacattccataaaatattagtgctctcaaaggttctgctttgatcctcatcttgccatttgatctatccgaccatctaattcatcaactctcatggcatcattaccacccatatggtaatgactcccaaacctctcttcaagctttagacttagcttaatagacatatctttttgaatttcctaatgattcttcaactcaacatatataagccagactcaatcttcccaaaatttccttttctttacatattgtctatctgtttgagggacaacttccctaaacatccaaactatagtctgagttacaccatctcatgtcactctctactaaattatcgttttttaaaattttttctgcattgaacttattgtctgatatcttatttttcatttcttttaaagataactgcctttccctgtccttcaatataagctccaagcaaacaaaaactttcagtacagaatctttaacatctaacagagttcttcacacacagtaggtggtcaataaatatttgttgaatgcatgataaatgtatctgatccctatctttctcctgcttcatcaccacaagcccctcctagacactatcactctgaccctgagttacattagactaaagttccatgaacccagatatctgcttcaacccacaggcctttattcatactctatgtcagcctagaatatccttttcactaaatggtggttttacttattttacaagatttacctcaagaattctctttagagtccttccttcttggtgataccactctatcatctctatctatataatctataagctcctttacaacctgcaatcatattctagtatttccttttttaaaattgaacctgcatccccctctaagcagtagttccatttctccctcatgaactactaatctttgaagatcagtttaaatccaaaaatttgaaagttttctacacttggcagtaatggaggaatagagaaacaaaaaagacataaggcacacgaagcaattaccaaaatagtagacagaaaagcctacattttggtaactatataaaggtaaatggactgagcacagcaatcgaaaggcagaggctggcagaatggataaaacacacaccatgtgcacacacaaatgatccaactaaatactgcctacaagagacacaatttaaattcaagataggtagaaagtttaaaaatggaaaaaataatattccatgcaaagagtaatgaaaagagagcttgaatggctatagtaatatcagacaaaatagtcaaaattattagagacaaagaaggacagtttataaagaaaaaacagtcaatccatcaagaagatatacaagttataaacatatatacacctaacaaaagagccctaaaatacattaagcaaaagctgacagaaatgaagacagaaataagcccaataatggtgggagacttcaatatctcactttcaacaaggcagaagatagtaaggaaatagaaaacttgaacaacatatagtcaacctgaacctcacaggcatatatagaacattccactcaacattctgaaggattataaatagtttgatgcattaataactaacatgtaatatgtttattacttcatacccagtattatgcatttcctcataggaggcaaagaagatacaaaatactaatttcaatttcaaggttgagtaatatggcttgttaaagaacatatgtatttatggaataacttgaaaaattatgactaaatgcaatctcattttagataaagagaggccctagataaaagcagcaggattcacatgaaaacaaaacaaaacaccaaagtgtttttaaatgctacctttaggatttacaagcttaacaacctaaggtaaggtatttaattaatatgatctttagcttctcatctgtgaaatggagagatctgtaattgtaatgattagaggttatacatgtaaagtacataaaatgacagctagcaaatagaaagtattccaaaaaatgatctttggtatacagcatacacaatgcacacaattattatggttgagtaatctggatttcattaagaaatatgctacatagaaaggaaggcctaagtcaggttttgatcgaaaggcaggatctggattgaaaaactagttttgactgatgttatttcctaagtgccagagtgagacattagattgatttcaaaagcattgaaacatttatactgcgtatgaccagaaaaggggaaaggtttctttccaaaattatccctcagatattccctttgtttttaagtccctacaaagtctttcacgctacgagacactccaacaattactttactttgaataaccaaatacaacttaggaagggcacaaaagactgaaataacatcaatgctagttttggatgtagtagagatcactagaaaaaccttagttatatacccaatacatattaaggcaaataataaatatctgtctcttggcaattctggcaatttccccaaagtttcataattggcactggcaatttcccaggggtattatctcataattgaaagccttgaacactgtggtacccaagactttttgaagatcagtttaaaaagcgattaagcaattacattagaaatcataaaaaattcctttacaggggaaataaaaagtataactgtcttaattgtatgtaaatgacaacctgtgtttggaactaaatagctgttgaagatgatgataagctctggagaactactagttgagatgatgagtatcttaagtaaggacaaaaacaagtgatgctaaagatatatgtaaagattttggataaaagtattccatgaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaagtattccatgaaatgtaagagcaaaaaagtaatatctgtattttttaaaaaaaagccatagcatcatataatttgtgattttaaataaatgtgaataactaaataaattcaaatcataaatagatatttgttttatctctatccctaaaagttgtatatattcaggttgtttaaatcctctctgggggagagaagaggtcttctttaggcacatacagtgaggtcctaagcaggccacagagatgtcaaggtggagcttctgaaagaaaaggtgtacagcaagaggtcaaagaaagaaatgtaagggcaagactaccatcataatacacaacaggatgacgagggttagggtggggacagtgggaccagagaaagggagagtgatccagaagcccacaccaaaaaatgatagattgattattttgatggctctttggtttcctgtaggtaacaattgcaaagctttgaggtttcggaacccagaaataatggcaccaaaaaaataaaataaaataaaataaaatgaaataaataaaaagaaaaagaaatgcagatgtagagagaatgagtaaattcagatgaacaatgacataatttcacatgttggactttgggtgatggctggacactgaggtaaaaactagccaaaatttcatccagatatttcagttcagagagaaacacagagtgccttttattggcaaaaattaaaaacactagcgatgaacacaaaaatgggcaaactttagtatagaccctcaaaatgcttacaattttggtgggtaaatagaagctctagaatttgtatataggaaggctttagaggcaaatccatctagttggaagttaagaaatagaggacctgatttaaaataacgtggcattattttaagcacaactctggctaatttggggtgggagcatgaggatgctgacagagattaaggatcataaggtcctatttcatccaacaacttctttgttctaccactgagtaggaaaaacagaacaactatttcaaaatgcacgtaattccacgagaaatgcagagtaacgtgtaagtaagaatatctggtgcttaaaatacaaatacagttcagatttaaaagtcagggcttaaagtagaggcttaccatctaagccagatgactagatgagctcttggaataaaggaagttcctccaagaactgaaaggatattattgttaagtttcaagatgaagggcagtcctcctaatgcctctaattgagatttaggtctccacttgagaaatagatcaaggtctaaaattgtgtcatcctatatggcagctactagccacaggtggttatttaaatataaataaattagaacaaaataaattaagtttaaaatttagttcctcctttttaatcctagccatattccaagcaatcaatacccactggtgacaagtagctaccatactggaaagcgcagataaagaacactttcactggacagtgttgaaatgtcacagtaataataaagacaagataagggatattcactgatcttgaatttctaaaaggaacatgtgcaacccatagagaaacatttttaccttgaccataatgatggtaactcttcttgtaagtcaacgttaaactcttcaaacactttctgtgctttctgaaattcttcttctgcctaggaatgaaacataacatgtgtttacactaagaaagaccatttctatacacaacagcatcatttaatgtaaaataagaatagtcttatggcatcttggaaatattttgagaaggagagtatttggttaaaagcatatccttgtttttcaattaaacatgaaacactaagactccctaaaactggaaaccggattgattacaatggttgctcttgcagtttctggctgattcatttattctacaaaaatgtgttagctgcctgccatgtagacagctctgctatggatactgaacatgaatgcatccccaggaaattcccagcctagtggaaagtctaaataattacattacaggatgtatttacaaaagggacttacaatgtgttatagagcatgctatatggaaggtggtgcagagaagagagaaggtaattttttaactgaatcctaaagaatcagaaaatgtttgctaaaggagggggtaagaaagacattacaatacataaaggtggaaagccttgaaatggaattccagcttaccatgtgaacttgtcagactgctttaccactgtgtacctcacaggttgttttgagtattaaggaaagttaatgtagatgaagtgttgaacagagtgcctggtatccaggaggcctctcatgaagggcatttgttattgtgaactgctcagaaactgatgtgtagttctggctcatggtatgtttatggaagaaggcgaggaggggaaaggagacttgaaagttgatcaggatggacaggtgagttacagccaaattgtgaggatcttttatgctgtactaagaaataaagtattttttgtagaggcaatagaaaccattaaaagacttaagcagttgagaaacatatctcgatgtagaaagaccattcaggcagctgtgtgtaggcacataggaaaaggcatgactggaagaagagggtatagttaggaggtgacttcagttagtcggcatctgtaacttgctgacatacatggtgaaagctactaaaaaatgttttctaacagaaaatttgttttatgcaaatccacacatccgtactctcagacaatcaaaagtcacctctgagaatttcagcttggtgtcccatctgcatctgcatttcagcactgagggtggaccacaaccatctaaggaagtgcagacacactactttctttgatcccgcaacattgtaggtcaaagtttattctgatcaaaatgtgtgagtcagtatcccccatatgaactgtacaatataatgaaaagccttattttaattaaaaataataaaaagcactatgtttcagtttaaattctgttcagattccaatctccttttatagaggaggcatttaattttaaaaagtaaagctgcaacaggtcataaaatacggagagtggtattcaccatgggctcaatccctaccttagagattcgactctcatccttcctcttggagctctgcagagcttccagatggtggcgggcactgtcatagtccactagcttcctgctgcgcttggcgatgcgattctgtcaacaggaaatgcactcactaagaaagaagcatggacataagagtctccctttgacagccaggtgccaaaatgctttccttggccagagctgctgaggatcttgactggagatcaagatgggctggagtttcactagctaagtgactcctgaaaatcagatgaacacctccaatcctttgtgttgaagccattagataaatatcttcccttttgataataattaggctaatcacaagcagctgagggcagagtttgcagtcaaagaccagaaaataatccagaattggtcagggagagaaggcaaaactatactcattattctctagtcgaaatctttaaatgttctattctgaagatagtgggaaactatgttagatttggttttataattctgataacactcacaccaacagcaattctataaaaacagatttacttcccaagaaatctcttttcctacaagtgattctcaatactttgttcattagaatcccctggactaatgtgtcatttggaatagctggtggccaaagacacagggccaaaggcacagattgtgctaatgggcaagctctttcccatgggtcaacattggaagccatgagaaagtctgagaacaagacattcccttgcagtgtggatgagaatgaggtgatatatggctgctaggggataggcgtaaagccctgctcatttctatggaacatttcctcttaacaacaacaacaacaacaaccacaaaaacaaaaagctttaagccgcttgaggagggggcaccaaacccttctacccacaggtgcaagcaaagatctactgcttctcggggagcaataaaagtaaaaccaatgtggctctggtagagatggagagccttctgacctctagattttaggcaaaaataattgctgtaggcaaaagggtaaaagaaaaagtctcaaggggcataaaagcttcctaggcccaagacctgactcctacaacaagtagtggactgctccaacttgggcagggaaggaaactctcgctcaaatccaaccacagatatgaggctgactttgcctaaaacaaggccgggaaaggatttaaaacaaacaaacaaacaaacaaacaaacaaaacaacaacaacaaaaacagccctaactccactacaagctataacactaaaaaacaagcaatagtggcctaccactggaggaggacagtgcaaggagagagaccccttctgcagaggggtctctacaggcatacaaagacaactaaaatctaataagcagcagccacactgagagaaaccctccagcacctaagggcccccaagtcaggcttcaacctaagaatttgaaaatattacagatattaaaatataagtacaaggcattagcagtccaattctggaggaatttgaaagctgcggtgcactgaagtaacaatagcaaaaataaagacccaatgcagctcaggtcctgattaattgattccaactctcacattaacggcctgacaaaaaggctggccaatttccagacataaatattatttcagtactcactatcctatacatgatgtctggcattcaatcaaaaattacaaaatacacaaaaacaaaaaaacaacaatccatgagaaaaggtaaagcaaacaacagagacagactcagacatgactcagatgttggaagtaacaaacaggaattttaaaatgactacgactaatatgttaaagtatctagtttgaaaaagtcaacaacaaagataatcagatggggaatttcagaagagatatagaaacgttaatggtcaaatagaaatcaaatggaaacactagaaattttaaaaatgttatcagagaggaaaaattgattcagtgggcccattactaaactcgaaaaagctgaggaaataaatagtgtacttgaagacaggtcacaataaattatttccattaaaacacaaaaaggaaaaagaattgaagaaaacagagaattgagcatctaagacctacaatgtaatataaaatggtctaacataatataattgaggtctcaaaaagagatgagagaataataagcaatatttcaagagataatggctgaaaattttttttaaataatgaagacatcaaagtatagatgcaagaaactcagagaataccaaaaaggaaaaataccaaacaatacacatctaaatacatcatagtcaaactacttaacatcaagaataaaagaaaagcatacaataaaaaggtaagaattacgggatgctaatcttcagaaaccatgcaaaccagaacacattggatgatatatttacagtactgaaaaataaaagttaaaagaaatctgccaactcagaattccacacccaatgaaaatatttacaaaagtgaagatgaaatattttttttcagacaaacaaaggctgagggaattcattgccagcataagaattttaatatgaagtggagctacacagaaaaatgagtaccagaaatgataaaaatcaatgtaaaatataaaagattttgttttcctacttttaattgcttgaaaaggtaactgatcattcagagcaaaaaaacataactaatgtattgtggggtttataacatgtaaaagaaaaatgtatgacaataacagtgcaaaggaaaggaggtgggaactgaaagtgtactgttgtactgttcttaaataatacatgaagtaatacatcatttcaagttaaacctaatatgttaaagatgtatattatacattataaggcagcaactaagaaataaattaataaagaagtatctacgtgccccataaatatgaacaattattatatgccaattaaataaattgttatacatcaaataaatgagaaaaatgtaaaaataagtagaacgaataaggaagtatcataaaatatattgactcctgagccctacactaagagattctgatttaattagactgaggcaagccctagatatctacagtttaaaaaaaatcttccccgtagtccagttatgcccagctatttgaaaaataagaactaacccaggaggagatgctttaaaaaatttgatatggtaggaaaaagaaaaaaaaaacacaataatataaatggttatggcttacaaggcattgtcacatctgatggatccttctagcaacctacagaatgagtgtttcagggattatctccattttacttttaggaaatgtggagctgcatgagataacctctaatttgtccgaaattgctcagcaagtctgtggcaaaagtgaactgaattagaagttggccccagtgaccagcgccaggagtagggtgaggcaggtgagacagggcacaaaatttaagaaggccccttactctcagggtcatgtgagtgcagggttagcaacttcctccctctaatttgcaccacgggttctttgctcacctcatccaatctcatccctgcttctcagtctcggttagtgcttcttccaacagctcccaccatttctctgacagactttatgagtcaactacaacctgtcactctatgctattcttctacacacccttcaggactggtgagaggtgggttggggcagttaacctctttggctatttctaattgctttcattttccctgcacctaccacttacaactagtatactagcagaaagcatggagatacacacccagtcactcaaagtatgcaatgagttagcctaggcagagtagagtggaaacccttcaattaggtatggtgaacaccatgtgcctataaggtgacaaggctcattacttttagcaaaaatgtgttaccttcaaaggaggctatcccttgaagcagtggcctacgtaactatatgcaaactcttataaagctcttccttatggacttgccttctagcctggggcattcctttaatatcttccaagtagcaaatcttgattctctgaagatgaatttgatttttgaaagcatctatgaatcaataacttttaagtcttagaataagatggaagagtgcactgggtaatcttatttttgttcaaaaacaagaagcaaagtaaataatgtgactcattttcttatgtaatttttaagtcaattacaaggatagcttaccatggtagaaatgactattttgaagaatatcactcattttgatgcatacattttggggttagaaaagataaatcaatcttatttccttacctatctgatatttgggaaacttggggggaaaacccaaatctcctaaataagggtaaggttgacacacattagctttttttaatggaaaattatataattctcttatttaaccatccaataggaaacttaattaaattacattataaatttaacttacatttcttgaaaagagaaaaagaagttgttgagatttctcattgtgcactgaacctctatagttaaaaaataagttattatacattttttaaacttccataataatcccaaattggaattcattttggtacactgcagtaaatacatgcttagttgctcatgcatggctgccaagatagaatccaaactatattttacaataactgctcacagctgtaagcctgcctgggttggtgacaagcaggctcttattataacagtgatttcagatgtcaatgctgcataacagaaaccataacgcagggtatcccgccaatcacagctggaaaagttaaacatcatcccctcatgaatggtccttcatagccctcactgatgggctcaagtaaatatttggaaatttgcctgaggttttaactgcacatggcctgttgatttcaataggaggcaaggaagtcaactgtgttccatgctttaaaaattctccactgagtatttttgtaaaatactccaccgagtattctactaataattactttaaatgtaagttgattaatcttcctttccatcatagctcattcattacataatcactcaacactatttttataaagtgatggagtctatatctacttctaacttcccttcactgaataaaggcagacagaataacttaagtccattttcacagaaaaacttctttcaaatattaaatacagctatcttctcactttccaattccaaattatctcctttccaagttaatagcatagctattacaagttaatagcattttgatttcctcaactgttacttgtgttatatggcttcacaattatctatcttggttgatagcctctatgtatgctccagtttcctaaatgtggcttgagggagacagagagagagagattcagcctctttccatgatacatagaaaaccttaacgtatatttaccttaccttcagggcatccagcaaaagatctagatgatattgtttccaaatctctacatggttcagaaactgcaggatcatctttgtatatgacctcaaccatggacctcaataaaagaattgctcaaggaaaagttatattgagctcttcatctttctgacatggaataaactgagaagaccagccaatataatctgtcataattttattttaatctttctgtgtttcaataaacgtaattctgtatgtgcttgtattctgaaattacatgctcctagacagtgtggccaatttctaaatatagtacaataactaagatcttcccattttattaatgatactaagtttttgttcctgaaactcaaaaaactttcagatgtttgcttctctagttagtcacagcctttatttgcttagctaagtcatactatgaacatatatcatatgaataatttgaacaagttgtaagctgctttggaattttcaggtaggaagacacaatttaacctcttctgatttcttaagtattgcttttaaggagattaaattaccatgcaataaaggtgatggtagcaagatggaagaataggaagccctggactctccttccccacaaacatacagatttaataccaacacaggaatcaatttttgtttgtaagacacccagaaactcgttgaatagctccttaacccttggcaagtgcaaatccagccacattgaaacaagcaggaaaaggggagctacattcttgctatccctagcacagtgccatataatgaagagggaacctccagctacctacttctcagtgaagagtgaagaaataggacagcacatctagcatcccaacttttctgacttctacccaagggagtgccttctacttgcctgtctgggatagctgtcaggtccagcatacactagtccctggggtctacagagaataaacagaggtttgaacatgaatgcaggcacttgccatggctcctctccctaggttagtgtagagcaagcaggaggaaacaaataagcaaataaaaacacacttctaagtagtatggcctaccatacaactagttgccacagcccctcccctcaactgagggataaaacaaacaaacagtaaaaaacacccagtttcctgcttctatctatgcagggaaagagttgaacaagcatccaacgatacaacctttgggggcttcccaagaaaatggcttccaaagaaaatgagtcttgcttgtctcagagcactgaaatgacccagcattctctagatgcctagggggtgctaagaacaaagaaaactgtcagaatagtcaaaagtttgagaggcttccaaaatctatgactgggatgattggtgaaggtcttctcctatatggagctagtccacaaagattaaaagaggtggctgttttgtctaatatgaagatatcaacatagagaaccaaggtaaatttaaaaacagggaaatatgtttcaaacaaagaaacaaaataaatttacaaatatcaaccctaatgaaatggagatatatgatgtgcctgacagagaattcaaagtaactgtcactcagatcaggaaaataatgtatccgcaaagtgagaaattaaacaaagtgatatagaaaatatcaaacagaaatgacagaactgaaaaatacaataagtgaactgaaaaattcactgggggggcgttcagtagaatattagatcaagcagaaaaaaggatcaataaactcagacaggtcattaagaatcatttggtcagaggaacaaaaagaaaaacaaatgcaaaatagtgaaaacagtttaagggatttatgggacaccattacataaaccaatttatgcattatgggagtcccagaaggagaagacaaaaataatcagaaagctattgaaagaaataatgactgaaaacctcccaaaactgggaaagaaaatgttcattcaaattcaggaagcccaaaaactccaaataaaatgaacccctaaaagtctacacagggacacattataatcaattgtcaaagacaaatatggaatttcaaagtagcaagagaaaagtgacttgctcacatacaagggaatctctgtaatactattagtggatttttagcagaagcaggccagaagggcgtcagatgacgtatttaaagtgatgaaagaacgaaaaaactgtgaaacaagaatacttgtttcttgcattcttaaagaagagataaagacattgctagacaaaccaaagctgaaggaggtcatcaccattaggcctaccttataaaaaatgctaaacagatttctttaacatgaaattaaaggacactaaacagcaaacaatagcataaaaaagtataacatttgttggtaaatgtaaatatatagacaaatacagaatactttattactgtaacagtggtgggtaaatcactttcaattctagtataaaagtcaaaaagacaaaaacgctaagcataactataactaaaaaatatatttatggaaacacaatataaatatatgcaaattttgacaatataaagtatacatgtggtgaaaataaaagtatagagtttttataggtgattgatgttaatttagttcttagcttaaaatagactgttataaaatattttatctaaattctgtaataaccacaaaaatgcatatggaagttacacgaaagtaaaacaaaaaaatcaaagcatatcaatacaaagaaacaacaaaatacaacagaaattagcaagagaggaaaagaggaacaaatgaacaataagacaaacagaaaacaatgaacaaaatggtaacagtaaatcctttcctactaataattactttaaatgtaagttaattaaattcccagtcaaaagacatagagtggctaaatgaatttaaataaaaaaagatccaactatttattgtctacaagagatttactttagattatagaacacacttggctgaaaataaagagatgcaaaaagatattccatgcaaatggtaaccagaaaagattagggatggctgtccttatcagacaaaataaatctaaattccaaaactgtcacaagagaaatggaaggacatgtaatgataaaaaggtcagtccctcaggaagatacagcaattataaatataaagcatctatatatgtaaagcaaaatgacaaactgaagaaagaaacagacggcaatataataataatacaaaaccttaatacccctctttcaattatagatagaaccacaatttcaattacaatttcaattatagacacaatatcaacaaagaaacagtagacctgagcaactatcaaatggacctaacagacatatacagaatattcaatccaacaacagcagaatacacatatttcttaagttgcacatggaagatttttcagtatagaaagtatgaagggtcacaaaacaagtcttaacaaatttaagaagactgaaattataccaggtatcttttccaaccacaataaaataaactagaaatcaatagcagaaagaaaactgaaaaactcacaaatgtgtggaaattaaacaacacaattttgaacgaccaatgggtccaaaaagatatcaaaatggatattaaaaagtatctcagcacaaatgaaaactaaaacaagtagcagaaaaagctgtactaagtggaaagttttagtgataaacgcatacattaaaaggaaagatctcaaataaacaacctaactctacatctcaaggaactaagaaaagaacaaatgaaaccccaaattggcaaaagaaaggaaagataaagattagagtggaaataagtgaaataaagattagaaaaacaacaggaaaaatcaaggtaactatgagttttttttttttttgagcagataaaattaacaaacttttatctaaactaaataagatagaagactcacataaataaaatcagaaatgaaaggtgatatattacaactgatgccatagaaataaaaaggttaagagactaatatgaacagtatatactggcaaactgaataatatagaagagacagataaattactagatacatacaacctaggaagactgaatcatgaagaaatggaaggtttgaacacatctttaagtagtaaggagatttaataggcaaccaaatacctcccaacaacaacaaaaccaagaccagatagcttcattggcaaattctaccaaacatttaaaaaagaattaatgccaattcttctcaagctcttccaaaaagattgcaggggagagaacacttcaaacctcattttctaagtccctgatatcaaagtcagacaaagacaccacaagaaaagaaaactacagaccagtttcgtgattaacatagatgcaaaaaaccgctacaaaataccagcaaactgaattcgacagcagatcaaaaggatcacccatcatgaccaagtaggattcattcctgggatgcaagaatggtttaacatatgagaatcaattaatgtgatacaccacattaatagaatgaaagataagaatcgcataatcctttcagtagatgtagaaaatgcatttgataaaattcattatcctttcacgataaaatgctcagcaaactagaaatagagggaaagtaccccaacatatcaaaggccatatatgaaaagcttacagttaacatcatatccagtagtgaaaaagtgaaagctttccactgacatcagaaacaagacaaggatgcccaccctcaccacttcttttcaaacgaaaaaattaggcaagaaagagaaataaaattcatccagattggaaaggaagaagtaaaattgtacctgttggcagatactatgaggttctacatggaaaacccgaaaggctctacaaaaaaactgccagaactactaaacaaataagaatagttgcaggatacaaaatcaacataaagtaattagttgtctttcatcatactacctgacttcaaactatactacaaggctactgtaaccaaaacagcattgtaccggtaccaaaagagatatatagaccaatggaacagaacagaggcctcagaaataatgccatacatctacaaccatctgatctttgacaaatctgacaaaaacaagcaatgaggaaaggattccctatttaataaatagtgttgggaaaactggctagctatatgcagaaaactgaaactggaccccttctttataccttatacaaaaattaactcaagatagattaaagacttaaacataagacctaaaactataaaaaccctagaagaaaacctaggcaataccattcaggacataggcatgggcaaagactgcacgactaaaacaccaaaagcaattgcaacaaaagccaaaattgacgaatggggtctaattaaactaaagagcttctgcacagcaaaagaaactatcatcagagtaaacagacaacctacagaataggagaaaaattttgcaatctatctatctgacaaagggctaatatccagaatctacaaagaacttaaacaaatttacaagaagaaaccaaacgaccccatcaaaaagtgggcaaaggctatgaacagacacttctcaaaagaagacatttatgcagccaacaaacatatgaaaaaaagctcatcatcattggtcattagagaaatgcaaatcaaaaccacaatgagataccatctcatgccagttagaatggcgatcaataaaaagtcaggaaacaacagatgctggagaggatgtggagaaataggaacgcttttacactgttggtgggagtgtaaattcgttcaaccattctggaagacagtgtggcaattcctcaaggatctagaaccagaaataccatttgatgcagcaatcccattactgggtatatacccaaaggattataactcattctacaataaagacacatgcacacgtatgtttattgcagtgctattcacaacagcaaagacttggaaccaacccaaatgcccatcaatgatagactggataaagaaaatgtggcacatatacaccatggaatactatgaagccataaaaaaggatgagttcatgtcctttgcagggacatggatgaagctggaaaccaacattctcagccaactaacacaggaacagaaaactgaacacctcatgttctcactcataagtgggggctgaacaatgaaaacatggacacggagtggaacatcacacaccggggcctgtcggggggtggggggctaggggagggatagccttaggagaaatacctaatgcagatgatgcgttgatgggtgcggcaaaccaccatggcacacgtatacctatgtaacaaacctgcacattctgcacatgcatcccagaacttaaaatataataaaaaaattattagttgcctttctatacactggtaacaacctgagaaagaagttacgagagcaataccaattacaatagcatccaagatactaaaatacttaagaataaacctaactgtggaagtgaaaggatttatacactgaaaactatacaatattcaaaaataaattaaagaaggcacaaacaaatggaatggcatcctgggtgcacagactgaaagacttactattgttaaaatacccatactacccaaagtgatctacagattcaatgcaatccctatcaaaatcttaatggaatttttaacagaaagttttttttaattctaaaattcacatggaagcacaaaagatcccaaatagccaaaacaactttgaagaagaaggataaagctagaggcattacacttcttatttcaaaatttgttacaaacctcagtaattaaaacagcattgtcctggcataaagacagttatacagacctctgaaacagaatataaagcccagaagtaaatccacaaatattcagtcaactgatcttcaaaaagggtgccaagaatacagaactgggaacaggcagtctcctcaataaatggtgctgggaaaactggatatttacatgccaaaaaattaaattggacctttatcttataccatacacaaaaatcaactaaaaatggattaaagacctgaattgtaagctctgaaactgtaaaactcctagaagaaaagttgagggggggggaagcttcattttctaaatgaagatgttttaaaataaacattggtgttagcaatgatttcttggacttgacaccaaaaagataggcaacaaaagcaaaaatagacaagaggaactgcatcaaagtaaaaagcttctgctcagcaaaagaaacaatcaagagtaaaatgcaagctatagaaatggagaaaagatctgcaaaccacatgtttgatgaggagttaatttccaaaatatacaaaggaacacccagagctcaatagaaaaaataactaataatctgacttaaaaatcggcaatggactagaatagacatttctccaaagacctacaaacaacctcagagaagcaaagaatacatagaatgatggttgccaagggctagagagagttggaaaatgacagttgctaattaatgggtataaaatttcagttacgtaagatgaataggttctagagatctgctgtgcctacagataacaatactgtattgtgcagttcaaaatctgtcaaagggtatatctcatgtcatatgttcttaccgcaataaagtacaaaatataaattaaataaaataattttgaaaataatttgccatgcaataaacagtactctgaagtgattactattgtgagactgtctgctccacaaacattacaaatcccaaggcaaaaattgagtgactaatcaaaattatctgaagatgtctcaaaacatgttccctggtgcacatggtcttacagaatttttaacaatttaaatttttaatttctcagagaatttttaaaacccaattcacacctgttaattaggttgcatttgcccaactacttagtaaagcactttgctgcctaatatggtaacatcatcgaaaatctactgtttggatttgctctatgtggcattttgtcaataggtctaacacatttagtcagatccatttagtttcatttaccatataccaaccctgatagtttaaaagccatctttacctccagagtcaattccaaatctacaatattcaatccttcacttgtccatttacctctgtaatagattcaagggtcaaataagatcaatgtttcagacacaatatttttaggtccagatgcaaatgtatttaaaatgcttatatcttaacactttaacttcaacctgaaaatttcagtgagagaaaaactatccaggttcactataaatgcatgcaaaatagacagtaaagaaggaaagatcaggttttgctctcatatttacaatgaaatttctcacttccttgtgaccactggttattctaatggaaatccctgtcaaatgctatataataaaagttttgattataaagaagattggaacttttggtagctctggtttatgattttatatctataggtttaaaaagacttctgtagaataataaaagctgaagcagttcactaaaagcgaaatgtgatttctgtaatgacgtttcttttcaaactgataggaacaacataaaaatcccacgcttaaataaatgaaaagttaccaactatctttgatgtcagtttgaggacttgtaataattcttctcttgcccatgtttcaataactacatgaccccactcaatccttccctttatagacacagagtaaaatacctttatgtcaggaaattgccccaggtaggtatccagtgttagcaaggacccatccacgagtttttgatggaagtcttcccacagcacatcacatttctaaaagaaataaagagaccactgctgaattattttaattggatacctttcaccaaacttctaaaaaaatctgaaactataaaattagacaagtaatactttcccagatatgagatgctaggggaaaaatgagaatcatttaataatgcaataaaattttaaggcaatttggccactggttctagttaacaaaacaggctagctcagagctcagctcattaaaactgtatttctgattctaaattactaaagaatgcagaaacttcaaaagatccccataaccctatagatggactttggggctaagagactgagaataattccactaagacagtttgcttttgacgcactccatgaaatcagaaaaaaatccaccactgaaacaaacaacaaatcatttctgaagcctccccagggaaaacagaaaagttacagtcatattgggaaaggtcttaccatttatggagtatcaattatgttaaacgtacaatgaatattaggtattactattattacaactagtattcctactgtcactatgttaaggcattctcaaaaattgttttatgagaaaagactttgttatttccacaatacagaagaggacactgaagcccagagatgtcacataacttggccaaggttataaagttgataaatgacagacacaggcttcaactcagatttgtctccttgaactcaaagccatgatatgaaagtcaggaaatgactatcacaccaggctgcctcaccagaggactttttatcccagctgtgtgactttggggaactagacctccctgaatttcaattcccccagttatatgagttggcaatgtaaagtgcttcacagaatttcaggcaaatagcaggtactcaagaatgtcatcttcacatttctctcactagcacattccaggtctcttgacacagtctgctatttgtcaccaatctctaccctttcttccttcctactaactgaacctcccattttagctcggcccttggccacctaggataaagactccacttcccagactcctttgcaaccaggtgtggtcatgtggctgtgttctagacaatgggatgtactttcaggaagtgtcctgaaaaagagggaaggagtgggctgtcttccagacttcatcctccttgctaactggcatgcagaaatgagagctgatggccagtgctcagagagtcaccttgcccgtgaaggcatgctaaaaatggcaaacttgggcccctcatacttgtggggccaatatgcaacacctggactgccgacctttaaattcctctatgtgacacataagttttcatcttgttaaaacacacacacacacttttaaaatttgcttttgtttctttctcacactttgaaaagtagtcctaatttttacaaatctcaattcaagaatttcatgcaaaccaaaacatttaaatccactgtttagaaaggctcaactgctgacgtgagtagaccctctgaacatgcagtattcagtttcttcatcatcacaagagcctatgtttgcatgtgcaactgaggattccaaaaaaccgggcagctgcaagaaccaaggtaggataacagtcatttcctttaaaaaagaaatggcaatagtgacctttgccacacatagaaggtaacatggtgttctgaaaagttattaacacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatctacatcctgaaagtttttgaaagatgtaaaggagccaacaaatgctttcctcataaataaatctctgttagcatctcagttataagaagattatgaagctcaatgtcagggtgtcagaatatccatggagcagcctaggactccactgttaacgcaggttttccaaggctgcacagacattcagtgcatcacctatcagaccttcccctgagctctggctgccacatcaaatttaggtcgtctgtgcctaaatgagctgcaataactcacctggagtagaggacatgacaaacaactgctcttcgttttaacaaagaacttggatgtgagacaatctgtgactggcagttgtctcacatcagtaatcataatatgtaccaaacactgagtaggtagaggacatccacacaaaggcaataagtgtcttattagtagatacattttttttttattttgtagatgaggaaactaaagcctaagaagatcaaagaactggtccaacgtcacacagcgctactcagtctctggtccattctgctttccagagaacaaaacccacttgctcactcctgtcagccagaagcctgatttcaagtgttaagacatgtctagggccaaagccttcctgaagtcaaattccttttcacagtctgactttgtgcttgtcttcgtgaagtgaagatttgtgaacggactagctggtattaaagtggaatggatgctcttctgaactcctgtccctgcatttggggaggcatagtcaatagggggattgagatgaacgggtgaagttgggacaacacaaatcacaccatgatccatgtctgctagaaatgggctgttaaggcttgtagtgaggacagaaaaatgatattgttattttgcaaaaaggaatcttaaaacactgctctctacccaagtggttttatgatcatcttcacttttcttttattttcttcgagatggagtcttgctctgttgcccaggctggagtacagtggtgcgatcttggctcactgcaacctccacctcctgggtccaagcaattctcctgcctcagcttcctgagtagctgagattacaggcgtgtgccaccatgcccggctaatttttttgtatttttagtggagacgaggtttcactattttggccaggctgatcttgaactcctgacctcaggcaattcacccgcctcgtcctcccaaagtgttgggattacaggcatgagccaccgcacctggcccatcttcacttttcactctaagtttggaatcatcaggcagcagaactgcacagtgccttctgagcacactgtcttgcctcatgattaagactgtgaagtggaaagagcaagtcaggggacaggtggactgagcaagggtcgtgggagcctcatggaagccaccccagctcttacctcaccaaccattttcacatcttcccgcccataccagtcaggctcatagacttcatgcagcgactctgtgagcttcatggaggcctcctgcatgcctagtgttggagagaaacaactcccgttacacagaaatgagtgaggattctcttctcccttcctccactttcttaagtgagagaaaaatattgtacttgctaaacatttaaggaaaaactataaaggcacaactgctgcttgtatctgctgttgtatctttctttgagggtctctaagacttatcacattgcacattttctattattcacttgataatgatagatatggggtctcgggaaagatcaacaagtatcctactctgaaaactacaataatcatagtgtgtcctattacgtgtgctatcacttgccaagtggtatcagatgctaagaacactggtccataaaactgcagagttctcaaactaaaattagtcctaaatgaatttaaatacatggcataaagcatttttagaagggactagaagtaaaaatcaataggattatagggcataacagtcaaaagtggttaagtggcctaaaatggtaaacacggttaaagtggttaaatggttaagttttaagtggcctaaaatttttacaaagaacaaagaaaaaaagtttgtcattttccagtatagtaagtccttacttaatgtcatctataggttcttgcaaagtgtgactttaattgatacgatgaataatgaaaccaattttacccaaggctaattcatataaataagagttaagttaccaggacatatttttcgtcacagacacatcacaaaacttctaactaaatgtcaaaacacttctaatattgaacattgaaataaatgagagcagtacacacatttaaggaagattaataaaaacaagtaagataattatttacttacttactccagtttagggtcatgggtgaccagatcctctcctagaggctcagagcacaagatgggaaccagccctggacaagatgcatatcatcgcagggtgcacttacaaacccacactcactgacatgccagtaaacttcacctgtatatctttgggacgtgggaggaagtcaaagtaccgagagaaaactcagtgtacaaattccatacggacagtggccctggctgagattttttttttttttctcatcattattgtaacaaaatgatgttgaatgaaacaatgctatttgaagatctgctgtattatttaaaactatgaatgaagttttaaatcaaaactcttagaaattttagggttcctaagcctttgggtctgaattttcattagggatacatttgatatgttgcaaaactatggtttgcaacattaaagaatagcattaaagatatatgcttctgagcacaacatggtgacataaagtatcacccagtccttttagtctctcccaaggaccccctgcacaaaggttaatgaatgtactgaaaagccacgaagacagctcatggctgagagcaaaacaaggggccaggaagagctggggacttggagatgcgcctccggcagaagactctccccgacagccggaaggtgggacctggccacattgatgtcttggcctttgtcactacgggggataaaagggggctggaaacagggagaggagaggaaaatcagagcactgtcatgagaaataaaaaacacatcctgtaaacttaaggtcagtgaatcctaagataaaaatcatttgttaaactgaaaactcaacattcttgctggattggaggtagctaattctgggttcaactgtgagagaaaaggacaaactaaaagatgtctgaaatgacagaagtacatccttgaggagtatgtataaaagtccacatgtaacttggtgtttcatagcacttgtgctctctttagacacagccaacatctcccttccctcagagcatcgctgggcacattccacgaagcccttgacaatgaggtgtcctgcctacatgagctgaagagacttgaccaccatcggacgaagcccttgcagagtctggggtaggaaaaaaacagtatgactcaagactctggggactctgatgaaacagagtcgtgcaggtgaagggacagcaaataggagacaaaacctgaatccaacccatcgcactctgaatccaagcaaggggggatgcgttctctcatgatatggtcaacactgaggtggaagctacattatgccaagtgtccaaattcaccctcacccaagtacaagcaaatctctatcaagaaatatacccctcaaattcataacaagcgttagtcactagtggacccccttctataatccagatgccaaaaaacttctggcattttctttaaatctttgtcttaagtctgatggaaactatacacaactgtgtagataggtttttaacaatgtcttaagagaagaaaaagaaatttggcactgtagaccaaataatctttgtgatgaaaaataaaatcatgaatataaccttaaaataaaattatataagattttaatcatcaagactaaaagcatgatgttgcagtaaatatgtctattagcagccaaaagaactactaattacagggtggataagtggtgatggatcatttggacagaagccattttgacatggaaattgttttgagaacatctactccataggatgcactttgatggatacacaggtgaaaggcttcaagcctagctccagactggcagagcttttagggatttagggattactcttctgacagagtatgatgggcgaaaaaagctaaaatacaagttctcttcagagtaatttggaacatcaaagcagaaaaggtgctaaatgctacctccgagattgaataatatacaatatccaaaattttcttaaaagattagtgatttctaaaactgtaagacaaatgcccagcatcatatacagaagaattattattattttactactggatgggaaccacttcactcttttcaaaattttggaccttctccaagacatttcatataacattgtctattcccatttgcagccaaatttgtgagcttctattttcatcctttaagacttgttgcatagattgcactactttataagtactccttgcttaaatagcctgagagtatgtgttttagttaaaaataacatcagttaaaataaattacgatgataacaagcagcagcgataaaccattaaaagaacgtctaaaatactgcaagtatctagcagctttgtcccattgcttagacgagagctgtgtaaaaagacagcagctgcctcaaaggaaagcaagagtgggcatctttttcttagattcttaaggagagcaaggatgggaacaagagttggaataaaataggcagttggtgaggtagctcaagaatagtcaaccctaccccttagtcatgcctacacataagacacataaatgaagaactattaatgacaccacgtgcactgtgctccatttagagaaagatctggcatgttcatcatccctgtgtctggcctctgctgcacctgcatgccagtgactcccaattctaaattcctactggacatctccacttggatgtcttactaatacctcaaacttcacatgtcaaaaacaaactcttaattttcttgtccaaacctgcttcaactccttttctcagttctcatgaatgccatccagttgccccagttcaaaaactagaagttatcccagattcatcctcccaaagctgagtcaccaattccacctgattcttaaatctagccccttccttccctgcccactgcccttccctggattagatactcatcacctacgatttagattagataacctaatccacataacacgatttagcaaagtagttggcacaagcaaatgtccaactgtcagccatcacaatacaaaatatttttggaggcaacataacaaaataattaagactattatttgcaattaatcagcctttgttaaaagcttggttccattacatgtgattcatgtgattttaggcaaattattaatcatctataacctcagttttccaagaggtaaaatactaataaataaacctgccacaaggttgtagggaaaattacataaactgagacatgtcaatgcttatctcagtgcctagcatataagtgctcaataaatgttagctaatagtattattgaactattggactaaacttctactaaatctccatgcaatttcacttcttctagcctgaattccacacaatcacaataactatttttctaaaatgctaatctgatcatgggacgttttcccttgtctacaataactctaacaatgactctcctgtctattgatagaataaaatccccatatgatatgatacatgaagcacttctttatataaatgctgctgcctttccatgtttcatccagctcagttttctgcttgcatctcactgctctgtttgttccctcaagaacccgtgcttccttctgcttcctggcccagttgtttcttccacctgcaatgtccctctgaaatctatctttctctagaaaacctaatgacttgatggccacctatgaccccacttcttgggttcattcaagtgtaagttccttggaacaaccattcctgccccagtctcttgcctctcctaaggtgtgaatctgtcctctgttatgatggcactcaatgcacgtatctattaaaatacatattactatgcctatctggcctttttatttaagtgtcttctcactctgctgtgagctccttgcaagcaggcactatgtcttgttcatctctgcatctccctctcctagaacagtgtcaggtgcacaaatggagctccagagatgtttgctgctaaaatgaatgcaagcataagatctgcctcacaaagcctaagcatcagcagaaatcataaagacccatagaggggaagccacccagagatcagtcacaataaaatgattagaattcatttaacccaacttcacagaatcccagttttggggcctttaggggcttctgagagaactgaaacatttaatagatgaggaacccaaagcaactaagaggctcaatgattttcccacaattgccccaggacccatgaccctccagggccaaatatcactttctcctatgctgccctgatgctacctgtgttatagcaggattagtgagccagagttgtccttgggaaaacaagaaaaattgcccatgaaagcctttgaaaatgtaaattatgatctacttaaggcattgatatggtttggctctgtttccttacccaaatcccatcttgaactgtaataatctccatgtgttgtgggagggacctggtgggaagtaactgatcatgcgggcgggtttctcccgtgctgttctcgtgatagtgaataagtctcatgagatctgatggtttgataaaggggagttcccctgtacatactctcccttgcctgctgccacgcaagacatgcctttgctcctcctttgcctttgccatgattgtgaggcctctgcagccatgtggaactgtgagtccattaaccctctttttctttataaattacccagtctgggggcatgactttattagcagcgtgagaacggactaacacaggcatataccttgttttcaagtttggtcccaaaacccaaaatgtgttcccaggaacaatattcattcttcacgaggctttgagaagagagaagggtcctgcagtcaaataacttggaattcctgcctgtcccacaggacttctgagttgactttagcatattaagggctctgagaaactcagtagtagcctgtttaaaaattcattccaatcagctgtggacaaagtaatttaagcagagatctcttttttggagcatcgcttgttaacatagtcaatcagcaaacccaagatggggaaaagctgatagaattcctttctccgtcatatggagctgtggccactagccctggagtgcaggtgccgtctgccagaaaggcttatctgatgcttcacccagcttttctctggagctcaagcctcatcctcagggaattcttctagatcacattaaggaaaagaattatgccagtctctataagcagcacgctccacaccaaagaggcagcatagaccaaatcaaatagacttgggaaagagaactcactctttcattcaacaaacttatccacattttcaaaaaaatcaactaacccagaaaaagtcctgtgcttgaaatgacttccgtgttcaaatcctaaatcaataataaaagaaatacctagagtggcttctattttctgactgaactgttacaaatacttaaggttgatttgggagtaattaatgatgagctccatcaaactgtggaagttaaattctctgagacttacttctttgcaaatgtaaaatcaagttaatgacattgataatatggctatgttgggaagttagaaacaggtaatatgcctaaaatgcttagcacagactctaacacatagtaagtgctcatgaaaaagtaatagtagtaggttgccattattccattgtatagatgaactctgacttgtgaaaccaatgccttaccattggtcacgtagttcaaaggcagtaaaagacagtagataaaaccagggctctggagaaacacagaacgaaatatgcaatctggccctgttgtttccttggcatgcaaccttggatgagctatttaaactctattttaaaaaatcactttttcttttcctttttttgaacagggtctcactctttcacccaggctggagtgcagtggcatgatctccactcactgcaaccttcacctcccgggttcaagcaattctcctgcctaagcctcctgagtagctgggactacaggcatgcgccaccacacctgactaatttttgtattttcagtagggttttgccatgttgcccaggctcatcttgaactcctggcctaaagtgatccactcgcctcagcctcccaaagtgctcggattaaaggtggtgtgagccactgtgcctggctgtaactcactttcttatctataaaatgaagataataaaactacctgccttatagagctgccatgagaattaaaatgatatgcctggactataaaattcataaatatcttttagtttaaaaatcaattttgctaatttttattattttggccatttttaaattattgatatttttattatttcattatttaataacatgtttatattcagttctatacatccacattaaaactgtgagaataaattcttagaatgaaactggtatgttaaaaagcataccaaataaataaataaataaataaataaataaataaataaaagattttaccaaatgctctccagaaaagctatcctcccagcaatacatgaatggagtccacttcccagagctttaccaattctaaatatgacagtattttatttgtaatgtgtttgaacatttggaggaaaaatgataaaatcttcttttcaatgctacttaatattatttgattattcatgaggataaggcttttttgcgtttatcatccatctatagttctactttggctaattttcccttagagttttctgcccatttttaatttaaccaactgaccttcatttagtttactcactgagctctttatatcttgatttactttcactatgttgtcaaaatggtgtttttaaaaaacatattaagttttacatacttacgacatcaaatctcttcatctttatggagagatttatgggtttctgccttgcaagtaacccttataaagaccttctctacagcctagagactaaatttactgtattttattctagtactttagcacatttctttgcacagcgatgcatagcagacacacctgacagtgataacttaggcatcccctgagaatcaccctgtatggtagatgcacctgaatatgtgctcagagttctgagctaaggaatctgggagtggccaaccgagagattaattccttgtctacaaggaacacctgagccctgagcctgtcccattgaaggtgagtcatacaggggattgaggccatgtgttttgggttaaacgaaggttgccaggtggaggttgttaggtagaggatgctaagcaaaaatgttacagaaactgcattgctttttgcaaacggatgtagttctcctgcccagcctgccaccacttggctgtgcaatactcctgcccagccctgccatgactgggcccactctgtatgtaagtttcccactaataaaaccctgtgtcttgtttgctgactctgggtcccttcttcggccccttgaacctggtgccatccctactgaagttaatagagtccagtacaacaacatatttacatctttactatatctggaattaggaaggagggagtaaagcgtgaggttgagaatttcactctgttttctaagtgtttggccagttttcccaataccccttgtcagatgatccattctttccccacaaaatctgccttatgatacatcatatccgtgggcacacttggctgtgactcagggcaggcagcgtgatgatggatagcaggcacaggctgagccacctccctattgctctcttctccctcctccagtggcctcatttccttgccttacatggctgagtccagaaactcatgctagggcctctccatgcctgtgcattgcacgtcggtagggatgcaagcgctgctaatccacacaagtcaaagccagtccagggccatgtttgctgatcatcttccacctacctttgccaccatgtcttgccccttccagtgagagggcttaggtgcgtgtctgtgagtgctccactcttggcatgtggtctccctcaggaggtaagccggctgcagcttttcttaaacaaggtctcaagctcactctaagaaattttcctggaaatctctggcatgtgggtggcatttatttctagtttccagcataagggcacacatattttttccttatatattctgattatcatttcaatgggaatttggggcgggggggtgggtggtggaatggaacacctgtgttcaagcatccatcttgccaggaagccaaatggctttgtaattaacactcaatcctgtcactcatgaattccaagaacaacctgtgctaagtaacatgcagtaaacaactcatacacattacctttgattgctgctaaatatcctcggagttctcgctgaagtctggtaccctctgcctaaaaaacacaagcacagatgctaaatatctagtctatattctgcatgaaaacatgtaagaagtgctaagtctcaaagttactattgccagaagctcattcttggaaaaaaacataaatatgtggacacagactaaacaaggcaataatgtccatcagtctagatatttatagaaattttgttccacttcaaagagcaaaaggagaaggcaagattttgctaatagataatacaattcattacacatcttctaattcaagagctatcaaatttctagattttgacacatgggttataatagcagggaagtgatcaccattatctaacatggtagccacaagccacatatggctgttgagtacttgcaattgagatgtactgtaagggtattttccatttacagtgtaactgtattttatacaacatattttagagactgagtaccagaaaaacctcattaattttatatagattacatgttaaaacaataatattttgggtatattgagttaaactacattattaaaatttcatctctttcttttcactttaaggatgtagccactagaaaattctaaactatgtagtttgcattatatttttattggactgcattgaaatagagaaactgttaaattgtaaatgttgacatatgaatgcctgttttggtttggatacttttttagaaactccgagactctctgaaactaggatgagactgcaaatagtttaatttggagttagtcaaagaaatgccaataggagagtagagaagtgaggcagagaagggaagatagctgatacagacagcgttatcaagcaagttaccactgtgggcaactggacctcagttccactcgggaactctggaagacagtgtcaatgaaacaccctatagataccctaactgaaaggcgaggaagctgaggcgtttatccaatatctcctgtcagctatgtttctagagctgctcctaggggacattaattccccaatatatctatatagaagcagagagggctccagaaaccagagaagccctcaggcaaagagttgccaatgctggcacgtcagtcttgtgggctcagaaaaaggtactaggggcatatgtctgagcaccaacagtagctgctatgactctacaactgaaagtcgatttaaaacatgcatgcattttaattgcatagtcatttaacaaaattgcagagagctagcatacaggactccaccttgagctcaataataggacagcaacttcaatagccatgttcaatttaacaaacattgttagtatttgcccaaaagagtggtggtggggggaccctctttcctcattataatctagtgggggagctaaaatatataagcaaaaaacaaaacaattgcactgcaaggcatattacatttagcattgcaacagccattcaaagtgttgaagtacaaaaacaaaatgtccatcacatttaaagataatgattaatacaaataaactgacaagaaataattaagactatgcttgacggcaaaagggattctgaattaggatattttccatataacacttgcattgtgcaggtatagtggcattatttccttgaaatctatgtaacactcaggtgaggtattctgtatttgagttaagctcaggttatttttgcagctctataaacccggttactaccagacaaaagcttaggatgagtccatttgctggcacgtatgaacttcaaacagaatggttctattcagaatggcaaagcagaaatcaaagtgctaaacaattgactccctttctagtgtctcaacatggttttaaatcaaaactcaaggtttctattcccttgttgaaacatgcagaaagtttgtgtgatggcaaacttccatcagctagagaaaataaagcaaatcatggtggggttccaaacagcaaagtgtagtagaaaactatttccagagagaggaagaggagaataaagagaaaatgctgatgataaacacttgagtaaaagcagtcgatgaagaggacccagagaagtcaggatgaagttctcaataccaccaagaaaagcatattgcaacaaaagaagtgggtctttcccctactaaatatccattatatgagagcattgtgtcacattctgagtacataaatagtggaaaaaatatggctttggtagattttattgtcaatctatgctgcaactccctaccagatctgtcattggagaaagatcatacttcctgcctcagcgacatcaggcttggctgtaggactgtagacaatgaaacttaagtggaagtaacatgtgctactttcaagctgaagctataaaagccatcacatgctcctgccatttctttcctctccccatacagaatttgtttcttcaatctggatcccagagtgaagggaccacagagcacagccaccacctgcattttcatgagtgagaaactaacctctgttgttgaaagccactgagatgttgctaccatggcataacctagcccaaactgcccagtaaaatgattcaccatcaacagaggaaatgctgaaatgtggagagaggctgaaatctaaccacaacaataaaaagcccaatagaattagtgaacagaaaagaaataaaagcatttacagaaacatttcagaaaaatcaaactggaaagatgaaggacaaactgaacggttcacaaatggaagcccaagtggtggtcaagcaacggaaagagatagaatggaactgagagagaagcaagctccagaatcatttgtcccatcagatttcagataatttaagagagaataatatctgaaatttacctggacaaatatagacccaaaccaatctaaagcctaaaagccctaaaaggtacaattaggagggcttgaatccattaaggccacatttctcaaactagataattgtagaatctgggggcatttagtggtttgtctagggcacatacatccacaaaacaaagctaaaagatctgtctggaacatcaatttattgaggtgaagggaaagaaatggaagagaaaccattattttacaaccactaagccacctcttaagaagtcggataaaaaaatagcatggggatgaaacacagaacttcacagatttctgctgctttcagctgtctgctttaggattctgctgtaccagtcatggtccttccatggaaatgtgtgagggacaccgagttaagcaaggctcacttctcacccagaaggatgtgttccctcagttatacagagccggccatgaaaagggatggttatgagtcaccaggattgctcagaatatccagaaatagcaaaaaagtagcagggaagggcattcttttctcaaatgttcaaggaacaaagttatgtgaaattaaccccacaattaactaattgccttttccttcagtagaaataaagtgaaataattcaggctccaatccatatactggattcatcttgtcgaagggaaacactgcagagtttttttttaaatgaaataagaaatctagaagagattttttatataagagtggaacaaagttcaaaattgtacaataattgcttaataaatgagttcaaattaagcagataaactaaaggctgatttaaatgactttcttcttttccaattattaaaattcttaattttccccatgagtatttcggtttcatgaatcactcagtaatagccacactgaatttcatctaaaattctaccttaatcaaaaaggtaaaaagctctggagaaaaatcctccacctacaatatgccataaagtagtttctcctgtacaaaacttattgcacaataaaatttccttaagattgttattctgcaggaatagcagatgtttgaaattaaacaaattcttataacattgctcagatttcactgaatttgaagctgattccaaatccctttgtaaagtatcattttagtaattcagccgtgaattatgtattgcacatgtgtgtgcagaaaacaaagttctacacccttgagattatatgcctgtattttcccttcttgtttctttatatcattttctacaagacatcaggaaattattgttctatgtcctggtcacagggatcatggcaacaggagggcaggggagtctattataattaagttgtctgaattgcctagtaatactccttcttagagaagatccaactgcatgaaggtgcaacgggtgtgggaaattattgagtcaagctgttttttgtttagatacactaaattctgaagcgctgcaatatattaatattagtaaatacatatgccaagacttcaagagtctttaaaaaggtataattttgttagtttacctttaactcagttatttctgcccagaagaaaggagccatagttgaggcattaatttaatttagttgtggacaaaattcatagaatgaattaatgatttctaaggaactaaacttagggcagcagcaaccactgcacaatttaggggcaccattcccatgtactacctactaccatgtgcatgacaccccggggcaggggtgtgcatcactatggccccaaatgcacaagaaaaaacaaaccctgtggattttattattaaggttaagcaggtctggaaaatatctcaaagcaataggagtttaatacctgttaaataggcaatggcctgttgaattggcttgttaatatatggtcagtgtagcactaacttatgtttataagtaacttttgttataaaaagaaaaagaaagacaagaggaagaaaatatcacacacggtatggaaaaatttttcattaagttgcctctccaactcagaaactgtaagctgacattttgaaaagggctcaggtggaaagccagcagtactaacatctgcatgaaaggtggatcttaggagacataacttcataaagttgcaattttacaaaggtgagtcctgtcatctcatctgtgatcataagcctatagacattcccagagttacattattatttttggcctttgatgacatttttctcttgaaaatggctgaagtaacatatcaaaattaaaactggctcaatttctcagagttcagacaggttaactcaatcttgaaagcaatgataataaacttgctgatcatttttgaagcttagaagaaaattagattatcaaggagatgagatttaatgaggccataatcagcaccttgattaacagatgactaataacataatatttgaatccacttatgatcaaagacattaggccactgagcactacaggcactcctggcttactaagaaatagagctctccctatgaaaagttcaggtgctgttaaatgggaagatgtaaaagcgcccagggtctctgaaatttacatttctgtttccttgctttgagctctgtgcactattggagctgtctgtcattaagaacccagcactgacttcataaaacaattcctcttcttttatttctttttttcacagatattaatgcagaagatacaagataaagatgaaataagactggatatttgcagtcatattcctgggatgatgaggcagggagtgcatggaaggaagagaaatgtcaaagagaacatctcagtttccacagttttatccaagattcgtggcccaatttccaactatccctgtcaccaattccaggaatatctacgatctgaagactgatgatcacatactttctagcttcaacaaaacaaagttagaaatctagctaataatcatatgtacaatctctccatttatttcccttaagccaactaacttttttgagtttatacagatctccattcggatcttctggaaaagctaacccatagtgtgttaaaccgccatcaaatcatcacagcatgcagactggatacagctggaagatctgctttattgccttgaatttgtgacccttgaaaaaccactcagttgtttttctctctgtgtgtgaggagacttgacttataaggtgcatcatgggcattatttaaaatcttttcagcctttaccttaatagctagagcacagtatttaatatactggtaggggagaagcacggagagctgacccaaaaatcaagggcgactttaaaggagccccacttccagtagcaactcctcctgtgacttgctgttcggtgtctcctgctgtgggtatagatgctagctctatctataacattctatcgtgaccaaatcagacagcacgtacaaggactagaaaaacaactgctgtgtcaaggcacagagatgcactgatggtagagaaggaagggccttagctatcattactccaggcctaatcaacagccagaatgtttctgaaactgccatttatgatgtctgtattagtttgcttgggctgccacaacacaaaaccacagaccaagtggctttctcacagttctggaggctgaaagtccaagatcaaggtgttggtaggtgcagtttccccccgtggcctctctccttggcttgcagatgaccaccttcttgctgtgtcctcgtgtggctttttgtctgtgtgcgtgcgtccctgttgcctctccctcttcttatgaggacaccagtcctgctggattaaggctcacatatatgacctcacttaaccttaatcacctccttaatggccctatgtcccaaaacagtcacattctgaggtactggggattaggaattcagctaatgactctgaggagaacacaattcagtccatgatgtaacaatgaaagtttttgatctggcaaaataatcacaaagtctaacacctactgagtggccactttgatccaggcatggttctaagtttcacaattctggtagctcatactcctcacaataattgcatatggttggcacattattatgagaaaacagaggcacagaggctgagaacttgcccaaagtcacacatctaataggtggtaagccagaattggaattcaggcaggctgagttattttagccgtatgatccgcctcaagagcccaccagcttgacccctgctctcccacctctgtgccccaggctgtaaaggatgatgaaggataaagctgcccaacaagaagcaactgttgataaatgaggataatgtaaccaaaggcaccattctccatgctctcaggatacagtcctcatctgtgaataaagatatcaattgttcactagtttttctcaaagtcccataattccatggagtttattccatgtgattcatatcacagagtggttaagtctacaggctctgagatcacacttcctggccttaaaatctgagctctgccacttctaaccatgcaacttggggcaagttacttaatctctctaggcctccgattcctcatctattaaatgaggatgataacagtacccaccacctagagctatcatgaaggttgagggagacgagttacataaagtatctgctgagtgcctggcacatatcatgcactcaggaaatgctggataacactattatcactcaactaacactttgtaaatgataaattatgcaaagggtaggtgtttcataaatgcttgattgaccgaagttctgctacatgtcatactgcaaacgaatatcttcatgaggaagatgcatgatgaaaaaccctcccaaaacaagctacttgggaatttataatgcttccttgttttttcatttgtacttttaagtatcaaagacacagttatatttttcagaaagttattttatagctttgaatattgcagtaatagaggctcccagagtatacaagaacaatttatgcagatgtaaaagaaccaactaacaatggatatgagaaaaatcaacggaatatgataaactactgcctgaggaaacaagaaagcatgaatactaaaggaaaaaagaataagttcatttccaaaatgaaaatttttatgacagatactcagttttctcacgtaaaacagaattgtaattatggattgccatgagaatcaagtagataatatacaaaacgctttctaaatgtcaaagtcctttgtagaaagtcttcaatataaaaatactttgtcactgcttttgcctaagccagtcaaataaggcttggaaatttggaaattgttaaagccccttggaagattcttataactaatcaggtttgggaacatattccagcagatatgcaatcaaagaagccattatctttattatatgtgtgcaatctcaggcttatatccaagtggttaacatcatagaacgactctttagagacacaagtcaaatgtgtgacttgactcataagtctgaaataggacccaagaatctgtattttaaaaagcctccaggtgatggttattgggaaactttaatttttttcactgtgtctgtcacttaatggacacttaagtgtgtatgtagctctagtatgagatccctaaaaagacacttaaaaatatgtctggttccaggtttcagtcagtcaccataagacattccttctagtgtatgtccttcctttagattgctatgccaatggcaaaatccatgttggggcttacaaggtgacttataagagagaatcaccatcaatgggaaccaataaaactcatgcaaatctgaaaaccaactgcagctcatttctgcagttgttcaaaaccatttccgatagtctccctgggcttggatgagagatatgcctcattctctgcatcccattaccagaatggtacagtcaacctgggaatcattgagacagatgcatccaaactaaataatgagtttaattcacaaggggaagtggaaaatatatggaattagtctctaaataaatgctgaggaatgggactctaaaccctccctagttggcatggttaattaatattgtagggtaaaatgcaactaaagcgggtaacagaataggacagataaaaggaaaccatcagagaaataacatgaagagcttcctctaggagtgatttcttaaactggggacaggcttcataggaaatggcacagtaatgtctgtgacatctgcaatttgactgggtcaatttttagttccgcttaaattaaggcttttcatttagataggccagaactgaagagatgctcttactgatgaaataaaataaataagaataaagaggttaacagataaacaagttaaacaaatgtaacaagtttttgttttcttcctcctgtctggcaccatggacagcaacaccctacaattcccatgaagtaggcagacttacttgccagtgaggaaagaggagatttattggatgtgatggaaatgaaataaatagaaagactatagataaatgcagaacagtttgaaaagcaagggccgttacattcttttgacacctacaggtttccactatctgctccctcccacagaagtcaattttattggcaatcatagccgtttatacttatattttaaaaactttaaatcaagattgtgtaatcaaaacacatatttccaataagaataatattaccaaggagagtggcagtcttaactaagagctcagtggccacattctcttgttttttgccatataatgaatacaactatatctaaattaaactaagaatctcatagccaatcacacaacaatttcatactatttagcaagctatgtgaacagctttacagggtgatgatttttgcagaaacgaacaggagacacccattgaacctgggaagtctagctgaaaatgggattgtggaaaggtatagaaatcatttcttcaaagaataccaattgggttgagagaatactcatgcacaaatgacaagtgatgaaactaggatatcaaaatatatcataattatggaagtatagtgacatcatcaagagattctgtatcttttccctactactttaattgcttcaaaagaaagaagacttttgtgcactagaccacaagcttgaccaaaacagaaatttttctctaaattgttcatttctttcagtgccttgtacaatgccttgagtcaatgaagaatccttttgataaagatttgtgtatagggaatttattctctgttaccttaaaaaaagtgtcctgctcctagctcaagtcaattcctcagttgtgtattagatactttctcctcctgcctactcaagggaacagatcagctgttcttccctttgtctgatgaatcaccacattttcattctggtctaaatgagtccctttcacatatttctgccttcttaagaaaatgttcttttgaccctcactccttctcccagctatagtcttggtctttgacccccctttgcttcaaaaggcaaaacttgaaaattgctgcctccaggcctctaaataccattccctttgctctgcttattcttgccttacttggttttctttctatagctctcatcattttctagcagacagtataatctacttagtaattgtgctctatttattgtctgcctccctgttttggaatgtaagatccacaatggcaacgacctttgtctgtcttgttcactgaagtttctggaatagctagatcaattcctggcatgcagaacacactcagtaaatccatagcaaattcatgcctcaatagttacctgctattgttttaaatgggcctccacatgatatcatctatcaaataacctaaaaacttccttaaaagttaatactaagatgaaacactttaaaatttggaaaatatttacacaataagatggttttcaacattaaagaactcctgcagaaatttacagctacaactaagagtatatgctatggtttcaatgtccctgccaaaactcatgttgaaatttaattgccgttgtaacagtgttgagaggtaggatttttatgaggtgattaggccatgatggcttcaccttcatgaatggattaatgccattatcatgtgagtggcctagttatcatgggagtgggctcctggtattaaagatgagtttggcctgacttcttttccgttttgtgtacttgctttcaccttctgtccttctgccaatgtctgagcagatgctgatgccacgcccttggtcttcatagcctccagactgtgagaaataaatttttctttataaattacctggtcagtggtattctattgtagcagcagactgagacggaaaatttataccagaaagtggggctgttgctataacaaatacctgaaaatgcagaagaagctttagaattgggtaatggatagaggatggaagagtttggagcaggctaaaaagagcatttatggctgtgaacagagcattaagggtgattctcgtgagggctcagaagaggagagctataggaaaaacctaaatctccttagagattacttaggtggttgtgaccagaatcatagtaaaaatatggacagtaaaggccattctggtgatgtctcagacaaaaaagaggaacaaggcattggaacctgaagaaaagggaatccttgttatacagtaacaaagaccttagctgagttgtgtccatgcccagcggactttatggaatgtagaaattgagggtgattgatatggtgtggatttgtgtccacacccaaatctcatgttaaacaataatccccaatgttggaggagggacctgttgggagatgactggatcatgggggtggacttcccccttgctattctcataatagtgacttctcatgagatctgattgtttaaaagtgtgtagcacttcctccttcactctcttcctcctgctccagacaagtaagatatgcctccttccttttcaccctccaccatgattgtaagtttccagaggcctccccatccatgcttcctgtacagactgtggaactgtgaaccaatttaacctcttttctttataaattacccagtttcaggtagttcttcatagcagtgagagaatgaaataatatgaataattggcaccaagcagtggggcattgctataaagatacctgcaaatatggaagtaactttggaactgggtattgggtagaggttggaagaatgtggagggctcagaagaagacagaaagatgagggaaagtttggaacttcctagagactcattaaattgttgtaaccaaaattctgatagtgatatagtcaatgaagtccaggctgaggaggtctcagatggagatgaggaacttattaggaactggagcaaaggtcatttgtgtaatttgttagcaaagagatggcaggcattgtgcccctgccctacagagatgatttaaggtatctggtggaagaaatttctaagcagcaaaatgttcaagatttcacctggctgcttctagcagcctatgcttatattcatgagcaaagaaatgacctgaagctagaacttatgtttaaaagggaagtagactgtaaaagtttggaaaatttgcagcctggccatgtggtagaaaagaaaaacccattttctggagaagaattcaagttggctgcagaaatttgcataagtaaaaaggagccaagacaatggggaaaatgccttgaaggcattttttttcagagaccttcttggcagcgccttccatcacaggccctgaggcctagaaggaaagaatggttctgtgggctggcccagggccctactgccctgagcagcctcgggacactgctccatgcatcccagccactccagctccagtcatggttaaaagggccccagagaagtctcagaccactgctccagaggatgtaagctataaggcttgatgacttccatacagtgttatgcctgtaggtatgcagagggcaagagctgaggcatgggagcctctgcctagatttcagaggatgtatggaaacacctggtccaggcagaattttgctataggagcaaagctctcatggagaacctctactagggcagtgccaagaagaaatatgggattggactccttacacagatgccccactggggaactgcctagtggagctgtgagaagagggccacagtcctccagaccccacaatggcagatccactgacagcttgtaccctgcacctgcaaaagctgcaggcactcaacaccagccgatgaaagcagtctcaggaactgtgccctgcagagccacagaggcagagctgcccaaggccttgggagcccaccccttgtgtcagtgtcgcctgaatatgagacatggggtcaagggagattattttggacccttcagatttaatgactgccttgctgggtttcagacttgcatggggcccatagcccctttttttgatcaatttatcccttttggaatggatatatttacccaatgcctgtatctctattgtatcttggaagtaattaacttgttttctatttttacaggctcataggtggaagggtcttgctttgtctcagataagactttgaactgtggacttttgagttaatgctgaaatgagttaagacttgggggactgttgagaagaaattattgtattttaaaatgtgagaaggacatgagatttgggaggccagagaaggaatgatatggtttggattagtgtccccactcaaatttcatgtcaaattgtaaacccaagtgttggaggaggaacctggtgggaggtgattggatcatgggggtggacttcccccttgccattcttgccattctcataatagtgagtgagttctcatgagatctggctgtttaaaagtataaagcacttctcccttcactctcttcctcctgcttcagccatgtaagctgtacctccttcctcttcaccttctgccataattgtaagtttcctgagtgccccccatccatgcttcctgttcagcctgaggaatcatgagccaattaaacctcatttctttatgattacccagtctcaggtagttctttatagcagtgtgagagtggactaatacagtgatgcacaaggatatctggtggaagaaatatctaagcagcaaagcattcaggttgctgtgtggttactttcaactacatatagtggaatgctagagaaaagaaattacttaaatatgcaatttataattcaaaggaaacagaacaaaaagatttgaaaattcacagcctgactatgtaaagaataaaaagcatgtcagagagacaatgctaagggtatagccacgtgatcctttgttaaagagattaatatgaacaaaaagaagccaagtgctattcatcaagacaatgaaagaccccacaatcattctgaaaattttctaggctgcccctctcatcacagtctcagcgctctagaagggctgaacagttttgggagataggcctggggcaccctccaccctccacaggctcactgcccaggacaaccaagggactctgctccccacttctcagtgcagcactctttgcccagcccagctgtggctcaagtggccccaagagcagctcaacccactgctccacatgttacaaatggtaagccttagtagtgtccacatggtgataattctacaggtgcacagaatggaagaactttgaggaaatggcttcttcctcccataatatttcaaaggatttcataaaaagcttggaactcaggcagaaacttgccacagaagcagaggtgtcacagaatctctactagggcaatgtatagtggagccctggggtcagggctgccagtgaaaacatagaacttgtagggccaccagcatggaactccaacccattaaagctgggtgaactgagcctagcaaagtcacgggggcaggacttcctgaggccatgggggcccaaccccagccacagtgtatccggtaaatgggatatagagtcaagggtgattattctccagctttaacgtttaatgttttctctgttgggttttgggcttacctgggaccagttatctctttcttcttgtctatttatcccctttagaatgggaatgtctgtcctacgcctgtcccaccattgtattttataagtagataacttgttttgatttcacaggctcacagctgaaaggaattagcctcaggatgaatcatgcattcagtctcatccacatatgatttatacaggactctggactttgaacttttgaattgatgttggaataagttaagacttctggggctgttgggatggaataaatgtattttgaattgtgagaaggacatgagttttgagggaccaggaaggaattctatggtttgaacatccctgccaaaactcatcttgaaatttaattaccattgcaacagtgttgagaggcaggatctttaagagatgattaggtcatgcgggtttcacgctcataaatggattaatgccattatcatggcagcgagctagttatcatgggagtgggcttctgataaaaaggataagttcaacccaatttcctctgtgtcacgttaacttgcttctactttccacccatctgccatgggatggtcttcatcagatggcagagccaatgctggcaccacatccttggacttcccagcctccagaactgtgagaaatgaatttcctttctttataaattacccactctgtggtattctgctacagcagcaaaaaacagactaagacagcatctctaggtaaactttatttccagcgatgcagacatgcaccaattcacttatagaatactgcgcaattattgagtttaaagattaatggaaatccagtatgaattcaggcaacaaaactcataattacaaaagaagtttctcataccaattaattgatatcaattaaatatattaaggctctctggtaaaaatattatcccataagagaatagtcttactccaaaacccagtatattaaaaatattttaaaattgtacaaattgaagaacataacttggacttaaagacaagaaaaacattcttaggcataattaaaattatttattttattgtttgtaaatgcatgtaaaattcttagaagactgaaacaactgtgtccacagatacctatgggcatcatggaactagggcagcttttgaaccaggagtgaccaaaactttgctctagtctctgtagtccaggttaggatcaagcccaggccatgtcaggcattctccaatggataaaagaggtatagtaaatgacaatataaaaagaggggtgttgacaaatgcactcacatgttcattgcagtactattgacaacagcagatttatgaaattaacctaggtacctatcagttgtggattaaataaataaaatgtggtacatatacaccacagaatactatgcagccataaaaggaataaaattgtgcccatgaaccctctgaatctaagaagttgaaaaataaataaataaataaaaatcaaaaaaataaaaaatcatcttggctattataactcctttgcctttctctctctctctgtctctccccgtatgtgtgtatgtatatatatgtatatgcatataatcttagaatcagtttaactatatctataaaacattctgttggaattatgatttatatggcctaaattctattagacatcaacttatcaaaaaaaatgtattcatctgggaaacaaaccatctacattccaggaataaactctccctagtcatagtatattatcctcttaatatagtgatgacttcaatcttcaaagtttcatttataaatgttttgcatgtatagtcataaataaagtttacatagagtttttaaaaagagggctttgatattaaacgagtgaggcacataatatgcaaagcaaagggtaaatacagagaataagtgtgacaagcaggcaagtcaaaactgggatgtacttattaggcacctagcaagtactagaagccattgaaggtttgtaaaaatgactaaacgttgagtcttcctttaaatattttacaattgaatgagaacatagatacacagctaaattactatcatgtaagaaaactagataacaaataacgtactactgaagtaaacagaggaaaagagactcctgactgaggggatggggaaaataccactagaatattccttgtgagttgaccttaaagaagatgggacttgaacataaggagatggcagatccgggaaggaagggcagtcaaatcatatggaagtagctgcagtgagggaagtggaaaagagtttgaaagccagcaattcagtcccaaaattacactatcagacatagaccaccaactattcactgcaccaacttcctttctgcctttaattacatcagagcatcttaattcaaatcagcctccttaacgggatccctaaagagaaaagccatttacttggctgataagcagttgagctctgccaaaaactaaaaggggaagtgtgatcaaatccttagggatggccaaagaaagatttagtactatgaatgtgagagaaagcccaaagcaaactctaggtacaaataatttgtgtcctatagagtgggcactgaacaagtagaatttgctccaagtcatgtaaatatatattcttaagagggtatcttaaggaaactaccccagacaagaggtcagagatttttctgtgtaaaaatgtatgtgtgggccgggtgtggtggctcacaccggtaatcctagcactttgggaggccaaggcaggtcgaatcagttaaggtcagaggttcgagaccagcctggccaacatggcaaaacctgtctctaccaaaaacacaaaaattagtcaggcgtggtggcaggcacctgtaatcccacctactcaagaggctgaggcaggagaatcgcttgaacccggcgggcagaggttgcagtgaacagagatagcgccacttcactccagcctgggtgacagagcaagactctgtctcaaaacaaacaaacaaaaaagtatatgtggagccagatacattttttaacaaatgaaaaaaggtagagagatttttggaaaagtgcagattgagtagaacatacccctccatgcatcatctctttttttttaatacttcattaaaggaaaggaaatattatcatccaccccattcctatgttgctttcttgatctacagaattttcattctctgttggagggattcccatcccctcagtcaggagtctctcttcctctgtatacttcagtagtacattctttattatccagttttcttacatgatagtaatttagctgtgtatctatgtatctgagaccaggacattcagtaggcgcttcccatgtacactctttgctgaaatgtcaccagacattgaaaattctactgagatttccctcagtggaacaggggtaattaaggccaaatctaccaccctgtgaaatgtattactacagctatcataggaaactcctgatgaggtagagtaacactggttacaatgagctgcttgggatctgtggggtcactgcatgaggtggagaaaaaagagacctcaagcaaggatcttgtacttccaaaaaccaagaaccacattttaattcttttagagtaaatgcaaccaaaccatacattttatattgataactgccatcctattaaagcctaaaaagcaaactgctcgctaagttaatatggccatatattaactgttaccttttcctcggggcattaataatgcttatcctttagtacacttatatgtgtaataatgtttgtatgtttagtattgttatagcccatgggtcaaatttgttctattgacattgatttattttacagactccattatgaaattgaattaggtgccagtattttaaacaagcgggatacttcctgtgatgcacaggcagagtgagtgagtatagcggggagactctcagaaggcatggtgcaaggagtgagggcagagagaatgcagcaggcataccatcagcaagtgggaactcagctacggtgctaagcgggcagagattcttggtcagcaggcctccagaggggagagaaggggaaagtgtaggtgggtatgaatcagcctacagctagagagctagagagcaggggaccctggactggtgcagcacaggagacaaagagatggcccacatggtcaggaggctggttacataagggagactgcacaaataaatatacgtatattgaagataatgaaagcaggtttctcactctcaaagagggaagtacaaatctagaaagggggaaggcccagccaggcgtggtggctcacgcctgtaatccagcattttgggaggctgagacaggcagatcacaaggttaggagttcgagaccagcctggccaacatagtgaaacccccatctttactaaaaatacaaaaattagccgggcgtagtggtgggcgcctgtaatcccagctactcgggaggctgaggcaggagaatcgcttgaaaccagaaggcagaggttgcagtgagtggcgatcgcacctctgcactccagcctgggcaacaagagtgaaactctgtctaaaaaaaaaaaaaaagaaggtgggggagagcccaaataaagcaggagacactgaactgcagttggaagggtcacggtttcagatagatagataatatagatgtctgtgtgtataaatacttgtatatacacgtgttgtgtgtgtgtatacacacatatatatcctgtccacttagaaggcctagaagtatgataccctagaaacaaagaatatacctagaacccagatcttggtttctaaatcccagtctccaccaaaagaaaccaggatttcttggaaaaataactgattccaagctattttggcaagggaaagcacaacaagatcctgaaacatattgtaccaaaaaggtaaaaatgttgtcagagaatgatgcaggtctgtcaaaaggacaaaggagtcaactcctaggagcttccactggctaaatttggaggaactgcactccaaaatgacgaatagtaatgtattataacccagtgaataacataggaatccataagtacatgctgatataattaattaattaagaaagaaaaatttttaccaggagtgagggcagagataacaacattttgcgaaatgattgtacaatgtcacaatactcaaaaattttaccactgagtagaatgctaattaataagtttagaaggaattcaaaataattcaccatgtagcaagcatcagagtaacagctgatttaaagaagtagcactagtggataaaactagtaggtgacagtttgatgagaaacaggacatgtacagtctcaaactatatccccacaaaatatttattaatattacttattaaatatttattaattttgagagaaaatatttatgtattaactctatactagagatacctggcagatatcatcttatcttactagagatacctgcatatcatctgttgagctctgccattacaaagtgataaaagttagcatcactagcagtggcacaaattaacatgatgtgtgttctgacagcatacactgggcatcactttcttctgtagtaatcttcccagaagctaattattaacacgaagctaattatgagaaaagtatcgggcaaatccagagtgagggacactctacaaataaacactgggcagtactcctcagaagtgtcaagatcatgaaaggcaagaaaacactgaaacactcttccaacagagttagtttaaagaaactaatgaaacctgacaattaggggcaacaggtgaccctggattggatacaggccctttaaaaaacacaattagggcatatgttgcaaacattttctctgggcctctaacttgtcttttcatccccttcacagagtcttctgcatagcaaaagttttgtcataggcaaaatttggggatctgcaaattagatggtaatacgggatcaaaggtaattcactgactttgacagaaggaactactgctgtgtaggatagtgtcgtttttggatactaatggatggatggatggatgaatagatggttggaggcatggaggcatggaagcattcatatatagatagaatgatacagtaattgggaagtctaggtgaatggtacacagcagttctgtatactattattatagctttttgtaaggttaaaattacttctaaatttaaaatatacaaaataaaattgggaacttttattacaatatgaatttaatcttttcttgaaaatctgatgtggcaatatggggcccacatcctcctgagattcgtgtgcactggagttgacagctgcttctttaggtcccatgaatcctataattcagcacagtcctcaccactccttactgttttataccttgcctactcagcttgtttatgttccctgacacatcttggcaagaatgtgagtctgtggcttctgccttcaagtgtgtttgttctgacagaggcagtgaggcagtatgctttttctaggtaagcctatgaaaggggatatattttaaatgaagtttcaatgatgtaattatggaatcatttgcagttgtgtgtgtgtgtatatatatagttgtgttacttgtgtgtatatatatatatagttgtgtatatatatacacaatcttatatatcatctattatatataatatatagttgtgtatatatgtagttgtgtgtgtgtgtgtatatatatatatatatatagagagagagagagagagagagagagagagagagagggagcctttgcatcctgtactcagtcttccttcacagcgacattttacaaaattattgtacaatgtcacaacatagatgcaacctacccatcttattcagcttctcccagttttacctgtactcatttgtgcgtgtgtgtgtgtgtgtgtgtgtgtgtgtgtgtgtgtttagttttatgcgattttaccacatgtgtaggttcatgtatccatcaccacagtcaggatacagaactttccagtcaggacaagaatcccttgtattgactttttataaccacatcgaccccaaacccccctcactcactcttggcaaccaccaaactttactccatttctgaaattctgtcatgccgaaagagtcacataagtggaatcccacagtataaaaccttttagaattggattttttcactcagaataattccctggagattcaagcaggctttggtgtgtggccgtagttattttcttttcattgcttactagtattccatagtatggatatactacagtttgtttaactattcaccccctgaaggacatctggggtgttgccaatttggagctactataaataaagctgctaagggcatttgtgaacaatttttttgtgagaacatacattttcatttctatgggataaatgcataagagtgcagtttttgggttgtatggtatacatgtctaattttttaagaaatagccaaactgtttcccacagtggctatgaatcatttcacacaatgtatgagtgattcagtttctccaaatccttgccagcatttagcattgtcactagtttttattttagccatcctgagagatggatggtgatttcttgtgtggttttaatttgcatttctccgatggctaaataggtattaaaaatcttttcatattcttctttgccatccacatatctactgcaataaaatatatattcatggtttcttttctttttttttttttctgagatagagtctcactccgtcacccaggctggactgcagtggcatcatctcagctcactgcaacctccgcctccagggttcaagcaattctctcacctcagcctcgcaagtagctgggactgcaagcacccactaccatgcccggctttttttttttttttttttttcagtagagacggagttttgccatgttaaccaggttggtttcgaactcctgacctcaagtgatccacctacttcggcctcccaaagttctaggattacaggcgtgagccactgcacccggcctctattcatggattttgcccattttctaatggaactgtttaacttatttttactacggagttttaagtttcttttacgtattctggatactagtcctttcttggatatgtagtttgcaaatattttctcccagtccatagcttgtcttttcattctcttaacagctcttttgcaaaggaagtttttaatttggatgaggtccaatttatcacattttcctcttttgtattgtgcttttggtagcaaatctaagaactctttacctaaccctagatcccaaagattttctcctattttttcccaaaagttttaaagctttatgttttatatttaagttcttgatatactttcagttaattttgtataagggttagttttaggtcaaagttcagttttttggcctatggatgcccagttactatggcaccgtttgttgaaaggttatctttcttccactgaattgtttttaaacctttgtcaaaaaccagttgagcatatttgtgtgggtctatttcttggttacctattctgttctattaatctacatgtctatctctctgccaatacaatgtcttgattatttcacctatgtggtaggccttaatattgaaaagaatttttcctcctactttgtctttgtcattgttttaattatgatagggtctgtgcatttccatgtaaattttagaataagtttatctatggtcataaaaaacatgctgtagaaattgcaggaaattgcattaaacctattggttaatttggtgacaaccaacatgtttactgtgttgaggcttcaaatccatgaatatagtacatctttccaagtatttagttctttttgatttcagtattttataattttaagcatatagatcctgtatgtgttttgttaaatttacacatatatatttctttttctttggagtgattataaaagttgtgtttttaattttgatttccacatgttcattgtgagtatatagaaatgtgattgatatttatgtgttgatcttatatcttgtgacctcactgaactcatttatctgttagagtagtattttcgttgacgtcttgggattttctatgtacataattatgtcatctgcagacaaaatgagtgtaatttctttatgagctatacgccttttgtttcctttcattttccttattgtactggctaggacttccacttctacattgcatagcattagcgagaatggacatccttgccttgttttcaatctttggagaaaagcattcagtctgttaccattaattatgatattaactgtacgttaggtttctttgtagatgttctttaccaaaatgaggtaattctcttctattcgtaacttgctgggcatttttattgtggagtgggtgctgaattttgtcacaaattttttctacatcaatttatatgatcatatgatttttttccttaccttgtttatatggtaaattacattgattgattttggaatgttaaaccagcctcgcatatcctgaataaatcctatttggtcaaggtgtataattctttttacacattgttagatttcatttgctgatatttgaaagattcttacatgtaacttcatgagacatattggtctgcagttttctttttttcatactattgttgtctggttttggtatcaaggtaatacagcccacataaaatcaattgagaagtgctccctcctcttctattttctgaaaaagattatgtaaaattgatatcaattctttaaatgttagaattatccagtgaaactatcagagggtgtggagattttttttcagattttaaatcacaaatccactttctttaataattattaaactattcaaattgtctatttcaccttgattaagttttagtggtttgtgattgtaaaggaattgatcccctgtggttgtcaaatctgtaagtataaagttgcttgtattattcccttattatcctttagatggctacagaggctatagtaatatcctttgtttcatttctgatgtgggtgatttgtgtcttttttcttgttgtcagtcctgctagaggtttattaattttattgacttttttccaaagaatcagacttttgtttcatttttttctctattgttttccattttcagtttcattgatttctgttctttttttatttccttccttctgcttgctttgggtttattttcttctctttcaagtttcttgaggtaggaaattagattattgatttaagacctttccttgtttctaatgcaagcatttaatgctataaatttcccttccagcattgcctcggctgcttctggacaagacactttcatttccaaggccttgtattcgctgaacctggttttccagataatcaatttttttcccaggaccctaagtccagagttctaatgccttctataatttcccctattacaccagactatcttaaaagagcttcatgaaactccttctcattaaggtgtgagcagggactttcatttcttaacagggcatccagcctcccggctctacaaccttggaagaagcgagttccatcactacactcaaaaatcatgcctgttaaatatcagatcatcttagttgatttgatctatgcagatcacagataatccagaacatgaccaccaaatctttatccatatttatatccatatttatagacactaaagatagacatcaaacataggattagaagtttcaaggacaaaccagaggaagcacttgtaaaaacttgcatgagtagatacaatgcattagtcctcaatgtgttgtccctggatcagcatcactggcatcacttgggaacttgtcagaaatgcagattctcatgcctcacctcagacatcacctgcattgaaggcattggtacagcacaggctgctgggtgcgacctgctgtaccatcaccttccaggtaacttcaaggcagctaatgtttgaaaaacactgctctggagggcacaaaacttgccagcttaggttcttattcagaatccagaaggtctagtaacctgacaggatgctgtgtagggcaactgaggctctccatactgccatttagaattggatcattatttaaaacagatctgatgggatcacatttaatcaaggcagtggctatctcacaagaaggtcaagattaatatttaatgaaaggtagatacattaatatattcacatcatggttatctgtggcaaaaacaaatgttctaaggtatatgctaggcctatctgctcaagcaaattgcaaaaagcttctgaaggtaagtataatttatcgtaaattaaaattttatccacacattaacatatatactgtggcagtatatttttattttacactctttcttaaaacttctaaaatttttctctttagtcatttatatgtacatataccaggttcttaaaaatgtcacgaaaccgcttgcaaaaatacataccatatacaacatctcttccatcccagaaataaaaatgtactccaggaatgcactcaaagtgataatttctgccactagttcagcttcaagtttagcaagcatttgttaagtttacttgcaaagcactagctcccatggaaataaaaacatagaagcagcaaaacaggatcgctgtgtccaggaggtgtgagttcagtctaaggagaggacgtggcccagctttaaacatctgctagagcatccaactcatgggaggctggtctgaattctcaccactggagaggatttcagggtcccagggtctcttctctttttggttcatattacacaaaagttagcctatcactcagtcgtggccatggaggagctgcacaacactgctatggtatttcaatgagggaatggaagcctatggagatgctagaaggagaaccaaggctctctctcctttatttgaactattgttcttagatgggacctggatgagggtgctcccacctgcactcactaaaatgtgtccaaatagttggttatctgggctcaaccagccctcaaggtatcttcttttaattagcacacttgccacaggtgcagcatcttactgggcgagtttattagcaggaaggagggagagaaaccaaggaccttctttccacagtgggacctttttttctgctcattaacagatctgtcagcagaaaactggtagaactgaaagcaggtgatgttcacaccagtcaattttgctacttgttaacagctttgataagagaccaaaaatagaacggggaagaaaggccctctgaggaggaaatgaaatcagattttgttcttcctgctggatttctaaaatccttgctctccttagcatgcattgtcatggaaaattccaagttttttgtagaagagttcattctattccctgatgtactactcctaattccttccttccttccttctttctttctttccttccttctttccttctttctctctttcgaaatgaggtctcactgtgttgcccagactgcagtgcagtggctgtttacaggcacgatcccagcactgatcagcataggagttttgacctgctccattttcaacctgggcaggttcacccctacttaggcaacctcgtggttccccgctactgggaggtcaccatattgatgctgaaattagtgcaggaacccaattagcatagcacacaacagcccaggactcctgggctcaagtgatcctccagcgtcaccctgctgagtagctggaactacaggcacgcaccatggcaccaggctctccttgttttaattaagtagtttatgaaacatgaaccacaaaagctacagcaattgggagtccaatggacaaaacaaagtatgtacagaccctttatcgatgctctcagtctcacacaaaccatgttgaaggaaaagaagtttgagatcaaaaggaaaacttagagttggaataaaataaagaaaagccccaagccagagttcaaacacagacctttctgccacttttgtttccaacatgaacaagcaaggaatatatcaataactataaggatcttatgattttataaaaggaatctaaaagcaagataactgagcccccataaatgtttgaataattctagaacatcctagaatggtctacttctttattaagcactacttgagtgtggtcaggggactataatacaatgcacaaatccaaatatggtttcattttatactatcaatagtatcttttgggatataaaatatatatactcgtagaaaaaatatggaatctaggtttcctagattagataatgcctttagagtatgtagcctttagataatgctttgtctcttcagagtactgattcaccatcacattaatactaagaataatagaccttgcagatgtaaccataatcttggcagatccttccttctaggttaatgtttctacataagtaccactcctttttcagcatacccaacacatgcaaattgatcaccaatacatattgggggtaagaggattcttctctccgtagagcattaataaaatcagtcttcagctacacttctcaacctttaatatgtttcaaaagaaaattaataaatccctccccttctcttccttctatcctccttccctttctccttgtctcttctaatatacaaacaggggtaaggcactctccttcctcactccactataatgattataaactttctttttctaattaaaaaagatcaaaatgaggataggaaaatgctagatattttagatgcaaaaatattttcaaagtgaaccaaatggggtcaagagactccctgagaaataacattccctatattaacagtctatttgccttactcttatgaaatagaattacttgttcaaatttccccaagttttgaagtttcacacgttttaaaatctgctaatatttcttgggagaactaaggtggtagtcttcatgggtgctaatatactatgccccataacatttgaagatgagtattgtatatagtgaccaaaatagatagcaggacagcagtttaaagtcaccacatgctgctgctgctagtggcacaaatcattctgccaatgtagttgatgatttaatcaaattgcacttttctctagtaccttcaacaaaaaacaatcctcacctggggcagtcaagaaagctgggaaaaaaaaaaaaacaatgaaaattcactgtaatcggaaaatgcaaagtgcttcctggcatgactgcattactaaacctgatgcttccaaagttaaccttctagggtgctaacaacattaaagtgccataaaagtgatagagaaaaactccaagagcaaagaattaattagctccatggggacatgccagacaggaaaacaaggtttcgaagggtacagtgtgaatccttaggtagggaaaactgtaaacatgaatcacttcttcaatctaaatccaatattttagagcagacatttgggattgcctgcaaagtcacagggcactgatggacaagtttgtgtatgggaagttcctgcaatccaagacaatgatctatttgagagctacccacacgcaggagatgtgtgaaaaatcaccaaatgagaacagaagttgatgtgaagaccctcttctcctagaggagactaggagactacttattctgtgggcccaagtccaacatttctctaggaattctcttttctacctttattaagccaaagctctctgtaatatttgttcatttggccatgatcaatttttctctccgttactgttttgttctctagctcccctctcccttttctcatgttcagatataacacgtttgctatcccattcatggtaaactgactacctatcgcacatgccaacacttagtcttgggatgaaactggagacattcaggaatgcgttttggcaaaactgatctacctggctccatacctgctgaaatgtataatccctcttggtaatgaaaagaaatagaatgtcttggtgagagaaagagcaggaaccctgatacacaaatggaagaaagaaacctccaaggtcaggagcaaagggagcaaaataaaacctgtgatgatttcccattattggtgtcatctctgaggctataattccctctgtggacactggtaactccactgacagcaggaaaagaaatccatgtccttatattgttccccacataatctgactttataatgcgcaaaccccatttcccaagcccttctcagcctgccttcttcctaccccacctctaagatgatctctagatttgaggcttctaacctcagacggccccactcctatcttcccctccccagcccttacgtgtgttacctaaagagagatattctagccaattatccaagccttagagatcaagacatagtttaaaaatagtttctatatccacgtgtctgttaaacacatacactaaaggaacaaacatcacaatctgtttctcaacctctttttcattgtcatctccccaaggagtcttttaagacttttttttctgaattacaccccctgtaaaattttaataccgtaagtatactatatgtctgcttatctaagatatgtttatctatgctttatacactaaaaaggttttcttcacccaccaagaaccaattttcagccccttagggaagatattagtataatccctgttgcgaatgcatgctcttgaagcatgcaacaattaaggtcattttaccagaagtgttaaactactgcttttctaatgttcaatgaaatataaatcttcagaaacaccagcattcctatagatccgtcatctgtattacagtggtcggagaccgggcctggtagctcacacctgtaatcccaacactttgggaggcctaggtgggtggatcgctcgagtccaggagttcaagactatcctgggcaacatggcaaaaccccatctctactaaaaacacaacaaaattagccacatatgatggtgtacacctgtaatcccagctacttgggaggctgaggtgggaggatcacctgaatccaaggatgttgaggctgaagtgagccaaaattgtgtcactgcacgccaacctgggcaatctgaatgagaccctgtttcaaaaactaaaatattataaaaagctaaagcagtccaggacagcagagtctttatctcctgggattccaaaacctactctctatggctctttccccgtcttcaataggaaattctccagaattagcaagtgttactctcaagttagtgccaactccatctagtctttttttaatcttaatgcattttacttacatactaagacacaaacacatttaaacaatttcccactccagaaactaaacaaatggactcacttcttgccgtttgaagttctggacatattcttcgaactgttcgtcttttgtctcatcagctttccccagcttttggaggacctaatttgcaaataaaacaaaatggtttaatttaataatgttttcaaagaaagatgtgcattttctgttaatggagcaaggctgttgttttgctctgaggagtagagcaaaactatcagcacttctaatttttctgttctggaagcatcttggcttggcagctctggagttgaacaaaaaaaaaaaactgaatcccagtcccgcccctcacaggctgtgtggctttgagcaagtgttgtgctacactgcacttatttctttatataactgtttcctttagcaggctgtgcgtgacttagagacagaagctatgccttatttgtctttttgtccaaagcatctggcacaatgctgaatgcataattggtactcaactgcttgtgaacagtagaccaaagctgtctgactaaagcattcatccacttcagtggtccccaaactttttggcaccagggaccagtttcatggaagacaatttttccactgaccagagggtggcggggggaatggtttcaggatgactgaagcacactacatttattgtgcactttatttctattattattattacattgtaatatatcatgaaataattatacaactcaccataatgtagaatcagtgggaaccctgagcttgttttcttgcaactaaatggtcctatctggggctgatgggagactgtgacagaacatcaggtattatattctcataaggagcttgaaacctagatctctcgcatgtgcagttcacactagggtttgctctcctatgagaacctaatgccgctgctgatctgacaggaggcggagctcgggtggtaatgctccctcacctgctgctcacttcctgctgagtggctgggttcctcaccggccacaaactggtaccagtctgaggcccagggtttggggacccttgatctacttcatagggacagtattagaagccaggatgatggtaagttccgtctcaccatcttctgatactcccttcaactcaataaacactcaaagaaatcatgggatactcaaggccccatgctaaacacgggtcacccagaaatactaaaaaacaaggccccaacacttgatcctaaaaaatgtatattttagcggaatagacaaggcaggtccacaaataacaaatcaaggataagttaaagacacagcatagagtctctttgggacacaggacataagtaacaaattgtacttgctgcctttaaaaagtagggcagaaggaagataactaatatactttaggaatacaagaactcattttcctgcataacaaaataaacaatacacatcccttttttaactagacattttcatagctcgtatattttccccaagatacatttataatgttatattaataaataaacctaagtatcaaagtagttacccaataagtcagagttcatgcagatttcttcaagaggtcaattttcttcggagcaaaagtaattattctaaacgaaaaatgattttgtattctattctaaaaatagttgctcataaaatgtgctagtatttcttccttttcactgtcattaataaagatatatgttttaaataaaattgtaaacagattcacacatgtattaccaattatacaatatcactcaatttcatttcacaaaccaatactacatgtaagtaatatgaaatatgctatttttcattgtaaatgtattatttttcagaagctgcaggaatctagtatcataaatattaaaaggacacataatcactgtattaactaatactctcctgtcacttatagcagggtttctttgaaaggtggagcagaatacactgcatttttggaagaatagggcattataactagggaagacttgataaacataagaaacatgaaattatgtatatatgtaaaaagactataactatgttaaaaagttaatagtggctatttctgggtgataagattaagagtgatcattattttcttctttataactttctatattttccacagttttctcaatggttaaagtaacaagaaaattcattaacataaatacgcaagagtttaacatactataaagtttttgtaagaaatgtacacattagattttagtacaagttaagtggatgtattagtagctggttaaaaactcccagcaaaaaaaattcccatcaaaaaatattgataagcaaattaatataaactgaaaataagacttccagaggcaaccatgagggacctatatctgattgagtggctcacatgtaagataaagatattaatagtgcctacttcacagtgttgtatggaaccaccaaggatacacatggaaatactaagctatgatggccagcatatagttaatgctcaataaataatatctattattattatagttatttttatctaaccccactgaacttcaccaatgtataagcttatactgagaaaaagccagggagaatgttgaaaatgttacatgaccagaatcaggattcacaaaagaccttctttaacaagatgaaattcaacaaggataaaatttaggacaaaaacttaactatacaagcaccagatttattactcaacttgcaaccaaaatgcaacaagacaggtgttagggatgggtggtttccacccttaagtagaagtaagggatgacttaaacagatcgtcaatatgagccaacaaagtgatgttgctgccaaagcatctaacgtaatctcagtctgcactaacaaaacttaacagctatcaggaaagtggtcctggacgcttccagaggtggacaagttggtaaacgcacaaatacacagaaaatctggagccaaaaaaaggagctctcaaaaaggcaaagatagttgatactatgtgatgagaagaacacttgatatgatttggtatattagcagggagaagaaaagacccaaggaaaagagcacagccatcctcaaacactggaaggaccatcagagtaaagaaggatcaaacttgctctgccaggaagacccaaaactcacatcagcaggcaaaaagtgcattaaaaatttgttttcacaaaaagttttcatcatagtttcctagaaattaaatagtttgttgctagagttaatgcgctcaccattccagaagttacatgagcttcaccaatagttagggtctcagagaagagacttactcatcaaacaggtaaatagactaagtcacatttcaaatacattctgagaatccataataaatgtattacattaggcattttccctagtgaagaatgcaaatcacaatgaacagtagcaaagaagaaatcctcttcatatttactaaagactgtgtgtcaaacactgggctaaggggctgcaggaataacaggctgcattctagggactgtgatctttcaatagtattcaagcccagggtgggaggtgtggaactggagtggacaagggtggcatgataggcagaggacagatttcagaaaggcttaggcagtaagaatcagaactttgattttcttgtacagaccatggagagccaatgaagtgtttctctggaggaagccacatggagaggtctgcactccttggtgacaatgttagggacagattagaagaaggcaagataggaataatgagaccagttaagaggctttttaatagtccaagcaataaacgacagaaccggagctaggaaacagatcagtctttaagaaacataatgcacagtacataatggcttatgggatgaaaaagatgaaggacagaacagagtgaaggatgacctcagatttctttgggggagactgagtaggcattgattccttcaaacaaattagacatcattttggacatgcagggtttgagacagctctgtggcatccaggtagagatatggtaaatagcatgatatggccaaggttctgagagatgctctgagctacacttatactttggaaatcaccagagtatggtggtagtaaagctactagagtgtataagaaagcccagagaaaatatgaggttcagaaagaagtgagctgaagacagtccagaaaaatcattatttgaagaacgggcagaggaagagaatccttgacaggagactggggacccagaggtatggtcaaaccaggagcaaattcatagaaaccaaaggagacagtttcaattgctacagagaactcaagcaagttaaaaaccaaaagccctgaaagtgtccactggatttaggaaccagaaggttcctgggatccttcccaagggctattagtggaatggcagtcagaaaacagatcacagtagattgagcaaataggaggagaggaatcagaagagcaagtaggtactctttccagaacttgggggcatgaagaatcaaaggagcaatacttgaccctgtttctaggccagagggaactgatcaaaggaggcaagagctataagggggtcacacagtaagaaaagtttcaaagggggtggcaactcagattcaccagaaaggacccatcttactcaggaagaggcacagccattcctcagaaacatgaaggatttctgagaaggcagggaagattgcctttgtaaaggccaaattggaaggaatgcacacacagcagatccatctctcctgtggggtaaatgaccagatcatctgctgagcagcactggggtgaggtcacgggaaaggtccccaggagaggggagtgattcagatgtggaactggaaaagatgagaaccagaaacacatgacatgaattttacatgaaactctaggccccactgaggcaaagaccatgatgtgcagttgcctacatgtaagcagttttgtgatttttctccagcagcctcaatggaggtgggaagactgatctgctatatagaaaagatcttaagacaccaaagacagtgaaacctagaactgagatgactaaaaacatcttttgccttgctctatgtcacgagtatttgacagtgagctgataatttaaatgacctctttcattaaccactcctttggcagtgttgaaaacaccaattaaacctgaacagtgtggcactattgatattacaggaggattactatgtatttatgtatttgatatgcagattttgacatcaacatgacacatcttccacctacaggcaaaaggaagaaagttcagtgcctcgtgcattttggtttaagacttgaatctttttcttcaaagacaatttcatctacattgacacgttagtattttgaaacagtaagatttttgttgttacttttagtgctgctgtttttcaaatgcaaaataatacactatgttgactaagcttttcaaattccacttcctttcagtgagattctgacatattctgttagggatgtgtgctcctcctccaaccctcaccccaagctcagaagttgtgatctagtcctaaaagacatcatgacataggcaagtaaaaaagtaaataggaaggaaaagcaggaatatggtaacttggaatatttcatcttaattgccttctcttaccattttaagttaggagtggaatattgtgttggcagctttcaaaaaagtggttggcatttaaagtcaaagataaagttcacaatcttccattccacacagaaataacttctgttaatcaggggaaaagatcaaagaaaagtcaagctatgagaaggtgtgaccccaagcaaaaaaaaaaaaaaaaaaaaaaaaaaaagctagtcctacaatcagaaatggggcagttgacgagaggaaaggctgcaggccacaaagcagttcaaggtgaaggccaggcatggcttgttactgagacaagaatgatggcagggttggccaccaagatgccttagtggcattcatccatttgatgagggctccaactagacaaattttcaactctgggtgactcacgcttccttgagccagactctaaaagtcaagaataaaatcacacaatttaattagtcttctttaacaaggagacacctttctcttcacactttctgttcttaaaaaaaaaaaaaaaaaaaaaaaaagaagagcacataaaataatgtgtacattctccatgtagttaatcaggagtaaactaaatcagaaggccatggcctcttctgaacaggacatggaggggtggtcttctacttgtgcccatgtccagatgattcattcattcatcagtccatatacccacctatccatcaagagttcttatcctgtgctcaccctaacactacaaagtcccataacttatgactggagaggccatcaggggaggtaagtgcagggtagctgcttgtcctaaagcttcctgctgggcacgtcctacactgtttcccaaacttcagggtactagtcctttgacctctttccgagtgtgtgtcaggacttaaggaagtggatttaatttgccctaatgtgagaggactaagatgaaacactagaaatgcatccttcggtgtggttcatgggcctttaaggtcctcacattgtcctccagcttcccctctgggggatttatttctataccactatgacatctacttcttaccttagtagattttaacagtgcattagccatcacgtcatcaaagcctctgaggctggcatgagccttcctgccaattctgggaaacacttctgggaaagtaaacaagaatagataagagagaatattcacagcctctgtcccatttgaatggccttcagactttaaaaggttgagaatgacatacagtaattacatgtctcatacatgagtaggtttatcctaagtgggacagaggcaactgggaattagaaaactagggagaaaggacagaggcaactgcgaattagaaaactagggaaaaaagaaaatttagtccctagatgggaacagaggtaagtgagaagggccctaaaaggcagtgcagtaagcacctgccaaggctgctttccaatcacacatctacctgaaaaggtatcatgttgcagaatgctgctctcttctctccttcctaaccctttcaatttcaggacatttagtcctctgacttcaagagaaaaaaaaatattggtggggaaaaatagcttgaggaatattgatctggcaaagatttgagtcctagcatccaagatggtcctcttctccaggagttgctgcctgctggctctccctccagattgagtcaccttgtcccagaattactttttcatgaacctgatatcctcagtatccaacccagagtataataattataccaaaatccagtggaagtctgctaaagcctgtgagtcatcccatgagactcggataaacaccagattttccttctccagtggccccattcacaaacagagcactgtctcatgtcattattgcacagaataatgcaatgaatctccaacctctttagatcatgtaaattagtcctcatgttccttagctaggcaaagggatcctccatatactaccagccagatgtttgagagcaagcttacatctgccacactggtagtaatctatcctgcatcagagctgctgtaaacatacgtgaccacaaaagccagagagggttctacatttgggaaattcgccacagaacgggtctgttcctgattgctttatacagattcttcaggcagttttcatgtcagtcatccattagaccaataaaagatgagttagcaatgtaaaaactgacctcctataatcccaacactttgggaggcgatgccaggagaattgcctgagcccaggagttggagaccagcctgagcaacatggcgagacctcatctctacaaaaattaaaaaagaaaaattgtccgggtgcagtagctcacacctgtaatcccagcactttgggaggctgaggcaggcggatcacaaggtcaggagtttgagaccagcttggccaatatggtgaaaccctgtctctactaaaaatacaaaaattagccagacatgttggtgcacgcctatagtcccagctacttgggaggctgaggcagaagaatcacttgaacccaggaggcagaggttgcagtgagccgagatcgtgccactgcactccagcccaggtgacagagcaagaccctgtcccacaaaaaaaaaaaaatagccaggcatggtggcatgtgcttgtggtctcagctacttgggaggctgaggcaggaggattgcttgagcccaggaggttgaggctacagtgagctatgattgcatcgctgcacttcagcctgggtgagagatcaagaccctatctcaaaaaaataaaaaataaaaaaacgctgacctgctgtacaaatattaaagaagatgttgactcaggtagaacagaaattccacaaaactctacccaggatttcaaatgggagctgtaagttccctaaggcaagaaggggctgcttgtgatgatgggtatgaaacagatgaagcagatagatagaatatgttcttgctttttttcctcttataaaaaatgcccactttactaaatctataattctctaatttattagctatgacctatggaaatttacaatatatcaagcacagatctaagtgtcctatatctaaaaatgtatttaatcctcctgataatcttgtgagttaggttactatgattgtgttcatcttactgatgagaacactgaaaattagagaggtgaagtaattgatctccgtcatacagctggtatgtaaccaagtttatgtaaggctaggatttggttttcagctacccttctgatttaccatgatctttctggaatagtgtttcccaaaatgtgttccatgggaaataatctcaggaatctctattcaaaaaaatccaggcgattctgtttgaaaaataccaaagactatatatccatctacagagtctcaaagaatactgttaaagaaaaaaaggaagaaatcgcaatacccataaagtacaatgtgaacatgatgtatcaatcaatgattaattttttactcattaattaatgaggaaactggtaagattctaaccactatactataatgccctaaaaacaggagcagagaaagaaacacagcctggtgaccacactcctctactttccccttgacaattaagtcattttcctctattttagattctactctgactaaccatatcatattgtcaggaactcaaatgtaataactgcttgatccatacttttgttaaatggaaactatatgacatcatctccctcccaaaataggttattgtattaattcaaataccctaggagaggaagcaagttatacaaaatgtatgttctccctactctgtcatcacttagaggaacctaattagcctctgatgagcaaaaggccaaagaggacatcccctccttgtaagaatattatggatcaggccaccaaggtgtcccataggagcagcaggaaaacacaaatgaccatggcctttctctagatactgggttctatatctggggtccatgaacagatcccaagatgtccaggaattgcctggaattgtggctaatataatacggctgtgccttttatcaggatgggaggaagggtctcctggtttctgtaaggtgaagaaccactgaattttaagagacttcatgggtacaagtggaaagaaaataagtgctaatatcaaacaaaactgggcctcacttgatcacttttgagagctggataaactttgcaaaatgattaacttggttgagcctcagtttcttcatctttagaaatgggaggataccaactctaggaagactaagtgagaacacaagcaaaagctcctagcttgatctgaaaagtgtttaatgagggtttattctttcttttctccttgacttcatatcttcactttaagttgcaatatcaaaggtctgacagggaacttagatcttccagttgatccaatggaagagattcttaagagattcttacgtgtttggccaagctcacatcttcgactttctatgatacagatggatcttttagagctaaagggatactgtagagtctatggaaacatctgtgcttagagaattattttctggcaactctctttctgcagctcggtaagtgtctcttgagcaattctataatttcaagaaccatacatgtgccagcaatgttgccaatgcaaccaagaaagcctagagtggtggtctacattcctagaaatcatctttactggtggtttctcacatttgagcagacttttgtagcagcaggaaatggaatccttccatgtgaccccattcaaacctgaccaaatccctccatcagatctgctaatacctgtcttcctgtacaggaaaatctgggcttggggaataagggtggatccggctttacaccaagaacagcttgctttttcccccttaaggtttattttcaagacttaaagctatttgaaagttcagtttgtttgtggcagaggcggggctgttgtgatttggtttggttttggtggaaagaatagtgtgaccagaattctcacaccaaaatttccactgcagtcctacctggggccactgagtgacatcaggagggccacccatcctctttgagcaaactttcttcctgtttttattaaatgatgccttttggtaatttgcctcacaaacacatcataaatgaagaaaaagagataggctacacggtacttacgtaacttttgaaaaaacattctgcataatctcagattggtagatgttctgcacaatctcagagtgaggtaccaccaaaattccacaggttcttaagtggtcccccaaaaggcatgcaatatgccccaactgccaggacataattaccaaggatttcaaacagatccagcaggatgtgcgtgatcacaaaggcaatttcaccgatggtttctatatttaatgtttattgatccaaaaataaaaataacctgatacaaaacaaattatacatacattgcaggtttgaatggaagttaaaaaatacagggggggatgattgctaatagaccaaaaaaccaaaccctacttcctctggtaatgactcctagttgaaggctggacacagtattttcagttcagtttgtccacgtggtcgttttctaaagattgctcaagaaggaactctgagtgccttcataaccttccttgagaacctggacagagggtaacggaaggtagcagagagatgctgccccttctggctatctgaggctgcctatgtcagagcacacagcttccagctctggaagtaccaaaagctgaaaatacttctcaccagcagaacaggcaatcaacacaaatgaataaacagacaaatgaatgaatttgtgaagcactaattatttttgtatacatttctatactttgatctgtgctttgattttccactttacacagctgttttaaagtctgatctgcatgaagtgaatttctaaaaaaaaaattaaacactattttgtaggagacctatgtttcagatttaatctgagcttctcaaactgaaatttccatgttcatatgattaacatggatattttataataaaaagttggatacaaaacctgcaggaattttttaaataaaattgggacttcaaagaaatattgtgttaccagtatgtgctttgggcaatatcatcacattctcttgtttgctatttgggtatccggaggggtatgttttacgatgcagtgtttgggatataagaatgactgcatgatagatgggtgggaaggatagaattctattctggtgaccctgggtaacacacctaccagccttgcatacagataagtaaaacgtgatactggaattgcatttcgctagctatttacaccatctgtaaatactggcagacacttctatgctgcattctctccagttgcccctccagatccattctccacccttctccacactgctgggtgctccaggaagctaatccctaagaaccgcatcctgcccagaccctctggcttccctctagtctcaaccaatggtaagcatcagcaagagatgcaagggcgggcaaaggtgggaggagggagagcctggggttctggttcccctggctatctcccagccagccaccaccagcagccatctcatccccttgcctttcaggtggccccaataattgcatctcctctccatatgctttgataaaagctccctccccttgcttttaggcctggggaaaaatgtccccagcagcctccactgcccctaaatcccttgctggtttcccataaccctccccacagagaatctagaaatagaatttgggtctcaaaattcttagctcaaaatcttccactacctttgtacacttaaactatgagaagtaatgaattaaaacaatccaacacactcctaaaaaagcatcactgtgcgttacggtgtagaaacggtgcagaaacaaactggtacaattcaccagaccaaaaacaacttgcatgctaagcaagcctgagtatactaatcccacaacaatggggtctgccaatcacacacttttcaggaacataagccctgcagttgacaaaggataattattaaaaagtgtttagtaggatgtgttcagctgtgaacccaaaatatctgagacaagtctcagtcaacttagaaagtttattttgccaaggttaaggacaagctatgacacaggcttaggaggtcctaatgacatgtgcccaaggtggttggggcacagcttggttctatacattttagggaaacatgagacatcaatcaatatgtgtaatatgtacattggttcctctggaaaggcagaacaacttgaggtggagaagagggcttctagatcataggtagagaagagacaaacagttgcattcttttgagtttctgattagacttccactgaatatacaacttacagaaatagtcacttacgccttcactggcttagtgaaacaatagggcagtggaagcaaccagatatacgcatttgtctcatgtgagcctcagggtgatgactttgagttctgtctgtcctttgcctactaggaatttccttgtgggcaaatttttttttttttttttttgtgacagagtctcgctctgtcgcccaggctggagtgcagtggtgcgatctccgctcacggcaagctccacctcctgggttcacgccattctcctgcctcagcctcccgtttagctgggactacaggtgcccaccaccacacccggctaatttttttgtatttttagtagagatggggtttcaccatgttagccaggatggtctcgatctcctgacctcgtgatctgcctgcctcagcctcccaaagtgctgggattacaggcttgagccactgcacccggccccttgtgggcaaattttgagggaggtatgcagcctttttatctttgtattaaacagctatgttatttaggaataaaatggaagcaagtttgcctgacacagttcccaacttgactcttcccttggcttagtgattttggggtcccaagattaattttccttttatatgtcctttgactggaggtatctaaaatgaagtggcatcattcatctggggtaatatccaaggttcattgtcccatgccaaggaaatcaaggttatgaacacacaaggagtgaggttaagagaggaggtttaataggcgaaagaaagagaaaagctctctgctgcagagagagggggtcccgagcaggtcttctggtccatagtgaaatgcagattttatagatgagcttgagaaggcagtgtctgatttacatagggcacaaaagattggttggacaaggtgtgccacttgcacacgtgaagaactggttaggactaggtgtgccgtttgcatagtgcacaaacaagctggctgcctcaccctaatcttttattacgcagttgagttgtctacgtggccagtgccatgttgtctgctttttcactgtggtaacaaagaaacagaagatggatcctccatgttgaacatgcctggttctcaggtagcccttttctattggcacagctgccggcattcacctgtgcaagcttccagcttgcttatctatgttggcagctcaatttttcaggctgattgtttttagaaaagcaatgatttaggggctttgttttttgttaaaagggaagccttgctgaggactcctttaccctcactatctgcctaaataatttatttctagctgctgtatcaaaagggcagaagttgttttccccttttaatgactgcaagacttatcacaaaagtttacacaacatagcttcatcattattggtaagatgttgattttcctccattgagaatgcaaggcaatcacaaccaatttcataggtacataagagacaaggtacataagatctggctcttttgaagaaattaacaagctaattctcaaaatcacctgaaaaggaagaagatgcagaatagtcaaaacaatttttgggaaaaaggagaataaagaaaggatgctacatcccactccaaagctcttcagagacaagaagcccaaccttcagaatacaaaactgaaaatgtgatgagttatttctgccctgctaaaaaggtagtttcattcaaaacctttgaccctaatacctagaaaagactaagcatagtaaaactaaacaaccacaaacaactaacttcctatgagccttatttcatgtccacagggaaatcaaatcccacatatggtcttggtgtaaagcacaggggctgtaaggtattagaaaaatcggtgtagaaaaaagctggactgttttcagaaaaatgaccaaccatgttactaagacaaaacctctctctatggactgcattctcacaagataattactttagattcaccagatatactggttctacatcttattatatgaaataatatggaagtatttctctgccttctatttaaaatgatcgagatatgtttgctttctaaaactttaggttttgttattccactcctgtgtatctgttaaagccataatttacaacacttaatattttattagtgagaacattgaaagaatgttgttgtctgatcaatacaacatcctggttatccgaaaggagtaaacacttccaactcttgttatagcatagcttccaagaataagttagtcatcttgatgaatgtatgaagcaataagtatgctgattctttattggatgaaatcctttcattcccttacatttcctcccctaaatccttgccacttaaagtgggtcctcacaccagcatcagcctcaccagggagcttgctagaaatgcagtatctcaggccctattgcacagtacaatccacaatttaacaagattcccatgcaattcatctgtgcactaaagtttggaaagcctgttctaaattacaaactcaatgtcaagccctacaggtaaatggaggaaccaacgtcattattctgggcatttgatgttgatgcagacaaagatcagataatcaaattgaagctgtaatgatcacacgatacaccacaaatgctggttattaaaatacatgcatgatctctgtttcgcatttccctcattcttttttaaaattatttttatagattttgggtatataagtgtcattttgttacatggatatactgcgtagtggtgatgtctgggcttccagtgtaaccatcacctggatagtgtgtattgtacccattaggtaatttatcatccctcctccctctcccaccactcacctttctatgtctccaatgtctatttaagcagaggacggaaatatttccaaatgcttaagtgttttggatggttggctgggtttcggttgtttgtagtttaatttgcattttaatgaagccatcacaattagatttgtataaaaagatgattccgcaaatctccacaggaagtggaatcattctgattagtcacatttttcacatttttgtcgtaaaaatgtgaattaaatttgaatatctggctcagtgacactcaaaaacttcacataaatgaaacagtaacatccatgaagctattcctgaccatgacccaaaatgataaaccatcagtggcttgctcaaaacccctgtggatgatcctgccctttcatgtggaaacaacaactgaaaccagatgagctgcacctggttttggatttcagcaccactgtttcaagcaactcagattacaagcaggggattttaacatcaggcaaatctatgtcagatttcctacgatgactttttacataaaataagaaataggctttaactctatcttgtgtgccatagcatcattaacaatgaaccaatcttcacttcttcctccaaaacctaaggaacaatcagcaaccaaatccctcctcagcaagtggctgtgaacaaggcaccatgtctgccctgttctgatcatctgcaaataggaagaatagtcaatgcttctttcacatttacagttgaagtaaatgcaggttttctctccccatcatttattgccttctttcttttttcctttccctcctcacctcctattaggagtccccagactttgttagcatacagtatatttaaattatgctgcgaaaagtggccagtattagagaagaaactttcattttgtataagtgtctgtctaaagagtctgaagggctacacatcctccaagaatgcccaggacctaaatagtgcaaataccttcccccacggcccatggacccagggatgtgagtggagagccaaagggatgctaaggaaagaggagagaggaaaagagaaacagaaagaatgagggagagaaacatccgtggctgcacatcccaggtaggctgcctatgaaatgttaagcaacaaactgttagaaaattggaaaagtaaagaaatgtctgcatgacactcaggaattaacatgggtgcaagagcaactgaaatgcacttccttttaaattcctaaattcctttgtaatttagaatatggagtggacatacactgtcctcagtgttgaaggccaaactaaaggattacataactagttggaaaaacaaaagataaaaagtgtacatttaaataattcactctcaaagaaaattatccaggaaaccagaaaacttcatacagacttaatatgccaagtacattttgaatctccaagaggaagatgcagaatgcagtgttctccaatttttcttttctgacaagagaacccttttgtcaaaaatgagtatcctgcaagactaatctgtaccaaatggacttggagggaactctgggccacaccatagagatccagaccccaggaccccctgcacttcagaaacagagctccttggcctggctggcataaggaccagctggcaggcttctgatgcaggaggtctgcacagatcatttggatgagcaccagaactgctctcatttgccagatatgggcaaatccctatgcatattccataggagtaattattttaatttaatacccaatttatacaacacccagaagtaagcaacatgaactaataattagatgtcttgattttaccaagtgcaagctctatcacctggaataagtcaccaaggctctgtgagcctcctttcctcctctgtttactgacctgcatctccaatcagggtcctgaagaccacttgtgcccaaacacaatctctacattataatccctgccaggtgtatgtcaggttactgggatgcacacatcagcaccattaatttccctatgtaaataattcaatatcagccaggctcaaataagggaagggaagagctttggagaaggttcatgaccttgaccctgttctgccaagtagaagctaaagttttctcatctcctcctcttctctttctctatcgctctttcatgatgcaagtgacaactaattaaataaaactatctgtgaaatacatgtgcattgagacctcccagagacaaagatgcaaccttctgccagccccaaatccaatctctgctgttccctgtgcccaggggaacggacccaatggactgcattacccaggttcccttgatcttaacttcctgtaagccagtgggagaggcaccagcaggagaggaaaggtcaggccctgctccatcctgctttgaactatttctggcagtccctaggtcaattcatacctgtctggagacctctcctttatgacttctgatctcactgggaccagttgtaccattttctctccttgcctcttccggccttgcagtggttatagcttcatgctattgttactggtctttgggggcctcaactccactgtggattcccttaacacttcccacacttccacaaacactccatgcagtaaagcctcttgaaccatctgtgctgaactctgcttcctgcctgccgagctctggctgatagagtcccagaccatctctggccctggggatcatcactgttccagtgtacccatcctgaacccaagggggctgcagacaaccattttgtagttttaaaacacacatgcaaatatacatagtcacggaataaaaaacgatgtctggaaataggttactgagggatcacacgtgccattttaaagcacatcaagcagtgtgcatttaaatatacattacactgagttaaaattctaaagtcctaattgcaaaacaagcctgcacccaaggaaggacaacagatatttattcagattaaatattgtcctcctgagctttcattacacttcatggggccttgagtattgccaaaatttgatttctgtaaaataaaactccaaaactcaaattgatacacattggagcctggtggttttcacagcaaagccctctgggcagggctggaatcacatgcttggagtctcatcctccaaccctgcaggctaaaaaagagtttggttttggctacagataaaaaagacagatcatttcctggtttcaccagagttgttaggagtattgagcttattagagaatttacaaccaaagagctggggctctttaagcatcactagactctgcctccaaaagagcactcctcataaggtgctgggggccttagtgacccgcagccccagctgcatcgtttctgccacatcacattccattgtccacactcctccaattcccctgcctggctgggactagcttcctgacaccaggaagatgcacagagccacattctgggcattttcatcaagcctacccaagcctctttccctttgaagcccatgaagaatcttggatttgtgcacattatgatttctggtggcttcccaaattcagcagataaccaggtaaatctgaagctcaagtaactccaaatgcatcctgggccttcctgtctgctccatgtgtatgtctcagaagaattcacaatcatgttctatagaaggctaaaatcagtaaatgagcgtttttgtgaagtcacaatgtgatttagcctttctggagtacactttggcagcatttatcaaaatcccttaaaatgtctatacttattgacccagcaatcctacttctataaatatgctttaaaaaaaatcaaagatatgcccaaagataagactacaagaatgttcattataaatactttacttataatagcaaaacagtaatggcaaactaaatatccaaaaatagttagttaaatatattactggcatttccacttcttaaattatgagtgggctagaaacccagaacaactctccaactcaaaatttccagacaaaatataagcttgttttcaatgcattgctgagctagcagaaagtcaggaattccacaaggccaataaaatggtgtgggaggctttagcccagagggcatcttccactgttttgacagctgcactggtgggaccaatcagatataaagtttagatacggctaagccagagtgagaagtctaccaggagatgcacaccctcttctccccaaccttaacctgcataaggttaagaccccaaggggttacactttcaatgtgaattaaggtacctgtaaatggtgaattagaattatacctgtccccagaaggagagcataaagaaaagttgcctgttttgacctggctattgggggaagtggaaagaaaccctttccttgaagtggtgagcacaacttggccatggcatttgaggtccacagtcccatgtcagggcaagagttagaatctcaagtggagaatttcatttaatgcagttctttgggagaccagtgaacaatcacttgaggccaggtattcaagaccagcctgggtagcatagtgagaacctgtctctaacacaatttaaaaaaaaaaaaaaaaattagccaagcatggaggcttacacctgtagtcccagctgtgggtaggaggattgcttgagcccaggagtttgaggctacagtaagctatgatcatgccactatactccagcctgggtggcagagagagaccctgtctttaaaaataataaatacatacattcataaataataaagcagttctgagctgatgaattcatagtcccctcattgatggtacctgcaagggctggccttgacaaacaaaaatctcctctggaggaatttaacttcagccccatcttcaaagaattcccatgtgttaggttctaaggaatattataataaggaatgctaggcttaataataaattcatttccagaatcttcataaacacaggaaaatattcacagtattttactatgtgaaaaattctgtatgataataagaaaattataaaaattagatagatctgaaggctatgagcaagtatgtttccactgcctaaagtcaacagggatcaaattatgggttttcccacttttttctcataatttgtagtgttttccaaatgttctataagcatatatactttagatattagaaaaaaaatttattgagaaagccaaataccacatgttctcacttataagtgggagctgagcattgggtacacatggacataaagatggcaacaacagacaatggggactcctagagcttgtggggaaggaggagggaaggaggaggctaaactaactattgggtactatgttcagaatccattgtaccctaaacctcagtatcacacaatatacccaggcaacaaacctgcacatgtaccccctgagtctaaaataaaactggaataaataaaataaatattaaaaataaaaatcaaaagaagataaaattaattgttttaatttgaaaagaaaaagaaagctattcaacaaaacagccttgaaaagaacatcccaacctttaaaaaaatgtgatcgaattcctgctatcttttggttcccctaaagaaaatactagccgaagcactgatgtgagcattgcataattttactgttattagacacctgctgtatgccagaccctgctaggcataagaggaaaaaaaatgaatgagaaactgcccaggccttcaggagctcacagctgagatggggtttcagaaatgaagtaagtgtaaagcccagtgtgcctgacgggctcactcaccagatatggggagataccagcgaaggccctcactcactgtagtcccgcagtcaaggagggctttcagccttcttcttaaaggataactgggggcgactcaggcagaagggaagggaaaaggtgcttctggcaaaggagaaagcacatcattcacaccaccctccactcctgcactctctgccccctgctctgctttatttttcatcacagcaaatgtcactacattatttatgtagttgtttcctcatttggtatctgtttcccaattccactgtaagtttcatgagggaaagggctttgtctggtataccgctatccccattatgtgctagacataaagacggcaacaacagacactggggactaccagagtgggagggacggaggatggcaagaggggaaaactaactcttgggtaccatgctcagtatctgggcgtacatatgcttaagcaaattgacttggatgaatgaatgaaagagaggcaagaaagagaagcatgagcgtagaacaatactatgcttcagttcattgtcttcggaccacaacaccaaattcccaagagcaacagggatcccttgaggaggacaaggggatgatatggtccaggacagctgtgtagaggactgatttggggtgggaaacaagggaagcatgggacaaaacagcaggcaagaaagagaaactgaacaaaggcgcgggaatagctatatccactcattcatcccacaactacttaaactacacgtgattacatgaaagtgacacagctatagtagttatcacagccatgggtatagtagttcctaacccaggtgatgtggtttggcagtgtccccacccaaatctcatcttgaattgtagctcccacaatcctcacattttgtgagagagatgaggtggagataattgaatcatcagggcggtttcccactatccctgttctcattgatagtgagtgagttctcacaagttctgatggttgtataaggggctttccccttcactgggcactcattcttctccttgctgctgccacgtgaagcaggatgtgtttgcttccccttcggccatgattgtaagtttcctgagacctccccagccatgctgaactgtgagtcaatgaaatctctttcctttataagtttcccagtctctggtatgtctttattagcagcatgagaacagactaacacaccaggccctgctgtaatctctggagataacggctgtgaacaagacaaaggccctcctccatggaatttatattctcttgtgagagacagttaaaaaaaattgaataaaataattttaaatagtaattcatcccagcactttgggaggctgaggcaggtggattgcctgagcctaggagtttgagaccagcctgggtaacatagcaaaacccagtctctactaaaaataaaaaaaaattagccacgcatggtggcacacgctgtgaccccagctactcaggaggctgaggtaggaggattgcactccagcccgggtgataatgaagccctgtatcaaaaaaaaaaaagtatttcatgttatatgaagaaaaatacaggaaaggaaaaaagagaaagatccatgaaacatttaagaggtaaaaaccgcaagacaaagtaaccacaaagctgcctatgaattttcagaatgctccatcttgacttcagtgctaaagtaaagaatcttcctgaacactctaagcacagtttctagagaaagtccatctaatcaagagcacataacagatggttcttgatctagttccacaacacacagctcaagggcaatgcactgatggtttggggctgccatataccaggggttctgcaccacccacaggcgacagaagcaggtggagtgcacctggccaaaatccattgcttgggattccaaagagagagcctttggcaatgcagctctgcaattagcggtctggttttatactgcatctttgctcgctcagagaattgaaactcttctggacctaaggagttgtctccaatgccaaacgttaaatctgaggaacagttttaaacactgattaatgctatttttagtctgcaagatggtgggaaagacaggaataatgatgggaaggagggaggaggtggttagtaaacacctggttaagaaagacataaagcatttccttttaatggaatgtttgttggttaagagatataaaacaacatgttatgtaacaattttcctatctcgaagaaagttgccttagaaagacgctgatgctggttcagcatttgtcctgagacacatcctgctgacacactgtactccggtgacccaggccagtcaacatggggacaaaaggcatctagagtgacaattgatgaaagaaaataacagtctcctgtttttgcaattggcacgtatataagaaacagacctgcataaagaagcttattttgcattcttctacttgtagtcactccttttaatctatactggcagcaacataccaaacaggaaacagtgagacataaggaaatttatatatagattctgaatccaagaacagttcatttaatgaaaaactaaagtcacaaaggacatgccctttccatgttcacgttgtcaaactgtataattcatgtgttttccagccttctcaggttcctagggacccacaaagtgtgcagcttgccagctgccagcattttgtaacacggcctgtgggcaaacccagcaggcccactactgaaatcacaaccagttacccagccgtattacttcagcttctctcctgattatggcaacagcaaataacagagcagtcaaaggactgcctcatttacagctcacccgcacaaggtgaatatagatgaaggacgatgaggtgtaaatctaatttttaggccggagaacaacagacagtggtttctacagaatgtcctggaagaaagtcaggcacactgggtttcccgatggaatggggagccagggatcccagcaatacaccccagtcagccctcactgacaataggctcacatgaccagctggatccctgagtcagactatatagaaacaaatggaagttccaccttgtctctctgacacttggggatgtctaattttcacaacttcacttactgaatacttatgctgtgccaaaaacggtgctgcatgctttatttcacttaagcctcacaaataccctataatataggtacattactagtcccattttacagatgagaaaactgaggcttataggttggagtaattggcctaatgtcgcataattagtaagtgatagaactgggactagaattccagatctgtgctttcgataacctattcctgcttcagtatgccgagtttgtggatcatctcaggtcaggagatcccatcatgctcctcttgcagctgacacctatggcgcctgtatacatggattagtggctgggatcacctaaccagtccacttgaagcacaaagcaatatgataaaacaaaagtggcatccacagataattcttctgtttcatatggaattctgctcattggtatactgtggttacaaaaaggcccacaaaatctttcatttcctgtatgcagtctgcttcgcagtgtgacccttcagctcctcccatgaagaggtgaaggctatctctccacccttgaatttgaaattagccaagtgattttctgtggccaatgagaatttaacaaactataggcaagcggaggcttgaaaagtccctactcatgattatactttcttttgcttaagaatcctgggccctcctctctgtggacaaacccaggctagtttgttagatgatgcagtacacacagccatctcatcccaaccgccccagccaatagcgaatcaaccacctatcagtccatccagccccagaaacttgcaacctcagttgatattagctgagacagcccagaccaggagaattcccacctggcccatggaattgagagaaatgataaacatttgttgttttcagccactaagttttgggatggtttgttacacagtgcaagctagctggcacaagaatttagaaagtaaagctctgacatctttgcagtattatcagtagcacaacgtaacttgggccacattcctctcatccagacagcactgctagatgggttatgtctgttcaagaagagaacttgttctaaatccaagccagtagcacaatgcatgtttgtttgttttattttgtgttgtttgcagcctacctcattcccaacagttttgaattgagtaccactcctagggtggttcccaaggctagctgcagcacagcacaatcacctgggtagcttcgaaaaaatactgatgcactaggcccatcctcagggatgctgatttccttggtctggggtgaggctgaagtctggctattttattttctagaatcagaatgtgatacctctgccattggctaaatgatatgttatatttattacttgttctctcaaacttgggctatcaggaaactttaaaaacccatgctttcaattaaagcaagttaactctttcactaggaaaagttatctttaatgaagcatcaacagatgcttagcctttcctgaagcacttaaatgtcagtatttgcaggccagtaaccaagacccacagcaggcatgtggttaaactaacagggaaggcatatggccactgccatgtgagatctcagcaagtcactgaacctctcctatattcatctttcctatttggaaataggtaggtgttgaataacgaaccacgaagttcccctccagccctgaaagcatgactgtttaatagttatcaacattccaagctaaatgagcaatacctggttcctctcatgaggttagactgctagccctgtcttatcctccagaaagtgtcatatgtacagcccagaggtaccagcacaatgggtcatgcatcagtcactgactcagtcaagaagcagagtgccaacatgtgtcaagcattgtgctaggcactgcacaacagaaagagggcgaaatgctggcattcctgagcttatcctgtttagagagaagcagaggagagaaaaataaaaccacagagcttcatgactggcacttgattgaaccctcaatgaaggagaaaggtggaaccacttccggttcagatgaaggagggtgctgagaactgaatgtttgtgtcccagcgaaattcatatgttgaaaccctaatcttcaatgccatggtacttggagatggggcctctgggaggcaaataggtttagatgaggtccttgggatgaagcccccataatgagattaacgtccttataaggagaggaacagacaccagcgtttcctctctctgccataagagaacacagcaagaaggtggccatctgcaaaagcaagaagaggcttctcactagacccagaatctcctggcaccttgatcttggacttgtaagaaaaaaaaaaaagtgttgttacttaaaccacccagtctatatgtttttttttttttgttatggcagccgaggctgactaagacagaagacttttccaaaaacggtgggacttcagatgagggccaagtagaaaacaaggtggggaagtgagataggtggaaatgaaggagaggaagaaaaaagtcatttcatggaaggaaacgtgaggctaaaagagaaaaatgaaaaaagtcagcaaggtaagcacagagcaacctccctagacagagaaagaaaaaaaaatggtttgtttaatcctaagcaaaacacattgacactttctattctttccaataaacctgacattcaaaagagaaagtcatcattgtctggcagcactaagcagctagttgtctgacagggagaggccatgctaactgctttagagtttccttttctaattaaatcaattaattttaaagcacgtcttaaattggggtgatgtcgtttataatactttgacagcatcaagaaggaatcgctagttcataaatatgtattatcagctactggcacagcagagaagggaagaaagacttaaaggcctttcacaccatgaaagtgacagatccgaggcaaaagttgaggaatcctaagtccagaggggctggtaagactcacagtctcagcctctgaggcaatattgggattgtaacaaaatactcaaaggaatcatgatatgagcacaaaaagagggagaagaggggagggagaggagaggggtatggagaaaaggggagtgaaaatgtaagagaaagaaaaaaaaaccaaaagcatcttttatttgtgatgtgccattattaagaatattgcagctaaaggaataaacaaacaaaaatcagcaatgcaaggagtgtgtcttcatacttatttttcctcttctttaaaggggtaaagcttaacttgaaacagaattccaagccatcattagtctcagatacagcttacctgaatgtttctgtaagttctccttactgagcatagccacgagtacctgaattcaaccctagtaccttgaagtcaactacatttgcacccagttgggaaaccaattgttaagcatgttatgttttcctatttgaattaaaatgtgttttctaaagaaaaggcattagaaagagatttttcaggcctatcactacacatgcagatacttgttaagcactgaatgatgaatgaatgaatgaatgaatgaatgaatgagtgaatggataactactttccatggttcacccaggggcagcctattaattgcacacataaatgcccccatagaaccaaccagtcttctgtaaggagaagactctctaaaccaattctttttcatttatttatttcaatcacttattctcaaatactattctcaaattctatttgagaacctactaagtcagatgccttaacaaacacatcatgattaaattatttcattctatggtatttggtgagtattcacacctcaatttcctaggaggctatgagctccacaaaaggaaaggcctgacttaagtaactttccaaaagtcatacaaccaaaaagtactataattgggttttgagtctaagaatctggcccccaggatctgaatagctgtgagctacagtctttctcttgggggctcagtaaatatttggggaatgaaagatttacatatgatccatgactttaaaataccttgagaagagcaataatacacattacttttaaatgaatcatatttgaaaacaaaaattatcccaaaagtgttaggaataattctgatttagatataagtgctctgttaccaaaacatggaaagtctaaagaaaagaaatatttcttatctcaaagaccagcaaacaccaccattagcatttgacatattttcttatgttcttttactgcgattacttatttatttttacacttctggaatcatgttttccttcaaattatatcctaagaatgttatcacctcaccacacatttttcaagcatcttagtcactccataatatgttaccccatgaatagaccccaactggtgtgatcaatcattcccttcttgacaaacacttgggtcgcttccaactttttacaataatgaaataattctttagggttattctccttaactattctttcacagtttctctattgaattagaacaaatccctagcatttttaattaaatgtgtagttgaagtaaaatatctccacaaattatgtgaaagcaagggcataactagggtttagatgctgtgtagtttcagatgatgggtctggggctccatcaccatcacccagggactaaagtggagatgaggtgacagaacccctgcacacgtcaagcagggatcagggactatacagactgtgacccacttgcagggcagtgtgagagatgggagggctgtggaacagcctgacagaaaagcagctgcagagaaaagtcctcaagtggcaaggtggtggccacctggacctggtaagagggctggtggtgaggtaagaggaacagagcacaggtgagaagagaaggtactgagcatgtggacctggggaccagagagctggtgcccaaagaccatggggaacaagccatgcctcagggccaccatcatgaacaaaggacagcacaaaaccaggagaccctcaaagatgctgggatgatccaaatcctcagatattcagctcactcctattacctaatagatggaaagtgaattaccatctacaggaaataaagtgtctccttcccaatacttaatatactgcctctgttctcaggcatccttctgaattaagaatggctatttgtaggtcgaagtggtgaaaaaaccttatcaaggtgaacataagttttatctataaatgcataccataaaaagaaaagaaccggccgggcgcagtggctcacacctgtaatcccagcactctgggaggctgaggtgggtggatcacgaggtcaggagatcgagaccatcctggctaacacggtgaaaccctgtctctactaaaaatacaaaaaattagccgggcgtggtggcgggtgcctgtagtcccagctactcgggaggctgaggcaggagaatggcgtgaacccgggaggcagagtttgcagtgagccgagatcgtgccactgcactccagcctgggtgacagagcgagactccgtctcaaaaaaaaaaaaaaaagaaaagaaccttcctgggatgaatcctactttgtccacataaatgattcctttaaataatttaatatgatttattataattttatttagagtttcaagccatattattccaagcccctgttttcatgagctatgcttcttaagctaagaagtgtgtataatggtttgctagggctgtcaataacaaaataccacagactgggtggcttaaaacacaaacatgtactttctcacagttctgcagactggaagtctgagatcgaggtgccatcaactgtttcctcaggatggtttctccttggcttgcaggtggctactccctagatacctcttcacatggtctttttttctgtgcacgtgctctttcatagtttctgagtaaagtctaaatcctaatctctttttataaggacactaattatgttggattagtgcccatcctaatgacctcattttaacttaatcacctctttcagggccctagctctgaatacagtcacattctgaggtgctaggggttagggtttcaacatatgaatttggggggtggggaggtcacaattcagtgggggtgggtggggaggtcacaattcccacgtcagtgggagatgaaagcaaagggaggctgagctgcaagagttccgggtccttcacctccttcaacccatccctctctttcaaccagtcatcacccattcttatcttttcccctagttttatcagctttttgtaaaacagttccatttaaaagagaaaatgctactaggctaaaaacactgaaataatagtcaatgcaacatttacaaaactatcactttccatttaaaaatcaaagaaaagatatcttcatatgaaaatattaacagggaccacctttagaagaaatgtgttttttcaaaactttcttcctaagtcccccaccacctgctcctttcccttactctctgttttttatttttgcttttgttttatttcagggacctgtttgcttttgtagtattttctacctatttagaggtaaaacttcttaactgctatgaccaaaaacaatagtaatgattttgggaaaagcaccttgagacaaaagcatctcatcctaatgttgtcaggctatcaaggagctcaaaatctcttgaaactcattaatgtcttcttttgtcttgtttattgttttttttttgttttgagacaatctctctgtgttacccaggctggcctcaaactcctagctcaagagatccttctgcctcagcctcccaagtcattagttattaaaatatgcaaggacctaacaccataaaaaccgtagaagaaaacctaggcaataccattcaggacataggcataggcaaagagttcatgactaaaacacaaaaagcaatggcaacaaaagccaaaatagacaaatgggatctaattaaactaaagagcttctgcacagcaaaagaaactatcatcagagtgaacaggcaacctacagaatgcgagaaaatttttgcgatctacccatctgacaaagggctaatatccagaatctacaaagaagttaaacaaatgtacaagaaaaaaaacatcaaaaagtgggtaaaggatatgaacagacacttctcaaaagaagacatttatgcagccaacagacacatgaaaaaatgctcatcatcactgaccatcagagaaatgcaaatcaaaaccacaatgagatatcatctcatgccagttagaatggtgatcattaaaaagtcaggcaacaacagatgctggagaggatgtggagaaataggaacgcttttacactgttggtgggcgtgtaaattagttcagccattgtggaagacagtgtggcaattcctcaaggatctagaactagaaataccatttgacccagcaatcccattactggacatatacccaaaggattataaatcattctaccataaagacatatgcacatgtatgtttattgtagcactattcacaatagcaaagacttggaaccaaccgaaatgctcatcaatgatagactggataaagaaaatgtggcacatatataccatggaatactatgcagccataagaaaggatgagttcatgtcctttgcagggacatggataaagctggaaaccatcattctcagcaaactatcacaaggacagaaaaccaaacaccgcatgttctcacccataggtgggagctgaacaatgagaacacatggacacagggcgggaacatcacacagcagggcctgtcaggggttgggggctgggggatggatagcattaggagaaatacctaatataaatgacgagttgatgggtgcagcaaaccaacgtggcacatatatacctatgtaacaaacctacacattgtgcacatgtaccctagaacttaaagtataataaaaattaaaaaaataaaatacaatacacaaagatagaactattatcacaatgcattgctatccatgaatccttcaaatcatattctgtaagagtacctttctgcccatgcagaaatatgttgtcatcaaatggatgttactaacctaagctttcaactgcaggaaaagcttatgttttagctgctttgcactattcagaaaagctcaaattgaaaataattagaatagtttttaagccaggaaattgagttttgtgtttacatcattcctctaacctccatagtaataataataatcaacccatgtgattattatgactctccatttgaatctatattgaaaattttgatagcacttaaaattaataaggcagctgtaacaatataccaagtatgaatgaaaatatttatatattctattattcatatttatattttcctgttacatattattttgatctagatttcattggcaatacccctaaaatcctacagatttaataaatgtcattccaatttaacttttccaagtgtcttcacgctccccaagcttttaagaaacactaactttaaaacaaaaccaatttttccttattactgttggggtattacgtgcaaattcaaattaagccaatttaggtacaccatttacataatgtatacttcctaatatgtaaagaatcctttaggaggccgaggcaggcggatcacgaggtcaggagatcgagaccatcttggctaaaatggtgaaaccccgtctctactaaaaatacaaaaaattagctgggcatggtggtgggtgcctgtagtcccagctactcaggaggctgacgcaggaggatggcatgaacctgggaggtggaggttgcagtaagccaagattgtgccactgcactccagcctgggcggcaaagcgagactccgtctccaaaaaaaaagaatccttccttctaaagctatgactactctgtaatgggtttgagctaatatctccccaaattctgaagcaaataagtgttatcacacatggctgctgaactggtgaagaggcattattacggttactatgactatactaattattctgaagttgctccttgatgcaacaggaagagtgctgtatttgattattgatgtctgtcacaggcataaggggcaggcacagaagtgcaggcagtgcctaatatccacaccaactccaggaccatgactgacttaccacaccttgtgcccagcagcaagacatctagtttgcattaggccatgtgtgcaggagggaccaatggaagggaatggaattaatgagagctgaaccctgacactggcgggtctataaacatgtaagaattgcccaaaggaaactcaatgattttgtaacagctctacataatgggtgatacagatgctattattattgagttatataaaaactgatgcttagagaggcacaaggtaacatctgggtcagaatgagactcagaaaccaggttcctccaacagcaaagtccatgctgttcagctgtaactatattgccattagaagctacatgttttaacattacacttttaaaatgataatgtaatccaaccctcatctatttttgctgataaatataacctgcatcatatgaaagttgagaaataatttatgctacctaaagtaatagtctaaaacccagaaatgacttttgtacaaatactctcatcttatctttttctactgtttaaaaaaaaaaaagaaatgcccccaaattaggaacactaagtatgcaatttacaatcataaaaagtattttttaaattactatacacataatttctaatgatagctagaattttaatatgtgtattcatatctatctatattacaaatatcgtatttgtgtgattatacctttgtatctaaagaaaacaaacaccaactcacatatgaaaaacagaaccacctgatagaagtacttgccgttagtgcaaagcatagtagaaccgaaacagaaaaaaaaaggaacataaagaaaaataatggctggaatagggctgcttccattttataataaattgatataacatatatatatataaaatgaaaacacttttttaaaagaaattttcaaggaagttagaattcagaaagttttgggatgaaaagcaaatcccagccagggttttgacaggtggggaggtataaacagagtaatccgtgtgagaggttggttatgagtaccattttgattaggctgaccacagccttagaggcaataaaaaagtggcattaataggtcttttgagatattatgtatatgttctttcttattaacatagaaatggaagcaattttcataaaaacagaaaaccaaaatatcataattatgttacatttgtcaggtcataagtttcttggaaataaattactgaaacaaatgaatttcattttttcaatctaaatggtaattctccatgacagcaaaaatcttacacaacactgtactgagtgtaaatggatgttcaagtagattataacactgcaacctgcccggaagttgccttaacgagtcctggaattggaggcccaggactccaagtctgttggcaagactcaatctcaacctaaatgcagtcttttggtgagaaaataatactcaaagaagtagcacaaagaacaattttaaactaagtaatgaatcctatattagcaatgcagacttgatggtgaggccagtcttcaagcttctcattggtttttattttgcagattagtgagacaacatatgatcatccagaaacctcctggattagtgagttctgatgtttgtatcaatcagaaaagcagaaaccacttcaaggatttacagtacagtcatgagccgcataataatgttttgtgtcaaagacagatcaaatatctaatggtactcccataagattgtagtggagctgaaaaattcttaccacctagtgatgttgcagccatagcgatatcatggcacaatgcattacccacgtgtttgtggtgatgctggtggaaacaaacctgctatgctaccaggcatataaaagtcttgcatatgcaattatgtacagaacataatgatagtgataaaaaatggctaggttactggtttctgtatttactatacttcttatcattagggtgaattcccatcgattaaaaaaaaataactgtaagtcagccttgggcaggtccttcaggaggtgtaccttccaaaagaaggcattgttgtcctaggagatgacagctgcatgtatgttagtgccctgaaaaccttccagtaggacaaggcgtggaggtggaagacagtgatactggtgatcctgaccctgtgtaggcctaggctaatgtgtgtgcgtctcagtttttaacaaaaaaatttatatatatatatatatttatatatatagaatatatatatagaatatatatatattcaatatatatatattcatatatatagaatatatatattcatatattgaatatatatagaatatatatattcatatattgaatatatatagaatatatatattcatatattgaatatatatattcatatatacagtatatatgaatatatatatttttatatatttatgaatatatatatttttatatatttttatatatgaatatatatatttatatataattatttatatatttttatatattaattatatatataattataaatatatattaaatatatatttatatatatatttttatatatatttatatatgaatatatatatttatatatagaatatatatatttatatatagaatatatatatttacatatagaatatatatatttttatatatttatatatattctatatatatagaatatatatatttatatatagaatatttatatagaatatatttatatagaatatatggaatatattctataaaatatatattctatataaatatattctataaaatatatattctataaaatatatatattctgtataaatatatatatttatacttatacataaatttaaaactagaaaaaagcttatagaataaggatataaagaaagaaaatatttttgtacaggtgtacaatgtgtttgtttggagctgttattacaaaaaacctctaaaaattaaaatgtttataaagtaaaatgttactgtgagctaaggttatagtgaagaaagagaagtatgattttgataaatttagcatagcttaagtgtacagtgtttattatctacagtcatgtgctgccctaggccttcacattcactcaccactcactcattgctcacccagagcaacatccagtcctgcaagctccattcatgataagtaccctatacacgtttatcttttttttttttttgagatggagttttgctcttcttgcccaggctggagtgcaatggcacaatctcagctcaccgcaacctctgcctcccaggttcaagtgattctcctgcctcagcctcccaagtagctgggattacaggcatgtgccaccatgcctggctaattttgtatttttagtagagacggggtttctccatgttggtcaggctggtgtcaaactcccgacctcaggtgatccgcccacttcagcctcccaaagtgctgggattacaggtgtgagccaccacacctggccaggtgtaccattttttatcttttataccatatttttattgtgccttttctatgtttagatacacaaatccttaccactgtcctacagttatctacagtattcagtgcagaaacatatggttcaggtgtgtaccccaggagcaacaggctatgctatacagccctggtgtacagtaggtgctaccatctaggtctgcttaagtacaatccatgatgctcacacaacaataaaattgcctaacgatttctcctcattttaccctcatcattatgccacacacgactgtacaggggatgcaggggctgaaaagccaataaggaagagtcaggtattccaaagattagcaaatgtggaaggctgttcccatatctgagctgaagggatcagggaggaggtgatgttattaatgagcccaagggccaagatcacctgaaagaagctggcaccagaagccagtccatgggaagctgctggtaaagcagccacccaatgtgaagtgggagcaggaggaagaccttgttttctcacttcctctgaccctctggtctcccagcaggacctctcattggccaatcccagccagaagccaagaagccaaccaacagggagtgtgggataggaacagcctgcagtgtccatcccacccccaacacagagggcagaggaagcgtgagcatggcctctgaagacaagcaggcccaggaccgtggcctccaagctccagcacaatatcagcatccccaacagcaaaaagcgccttactgtaccctgccttggtgtggtagcatctcctacacccagagaatgaaatatgtcatcatgattagtgttattgacaaaatggtgtcaagattccgattcattacatagtccgtactctcttttgaaggctctgaaaagaaattttctgctgttgtcaatatcaaaaatatttgtacctccctgatgtaattacaaagactggggcttgtggacactgggctgtggcactgctcgggcttcccatgtcacactctccatcatggccaaactggttcagcctcagtcctccttacatggtttctactttttcttttttcttgtttttaatttttgctattttgtaccttttgtattattgtaaactgacttaaacagtttatggataaagcaggaaagaaatacatacatgtatgtatacacatacatacactcctatgagtggcacacaagcataattttgaacatgggctaatgacaaccaaaatataacatgaatccaaggtgtgagctttggtgtcacagcatattgggtttaaagcctattaactccatgtttttcagacatgttgtaactattgtgtgtctttatttacttttcaatattctaaaatttatactttgctttcttgacatatacaatacagacttctaatgttcatgtagtcaaatctatcagccctctgtggttttttgcactgattgcatgcttagggagactctcctgatctgaatttatttttccttctgattaatttatatttccttctgattatttcatggtttctttcaataaaaatagttaatgctttaaagcacttaataataccaaacaattgtatggaacctgctttgtgccaaatattgttttagattatagttctaaatagtaactaatgtagtaactcatttaattttcatgactgtcctaaggaagtagctactattatcatccccattttacagatgaggaaatagaggcctatagaggtgaagtaacttgaccacttgctaataagtggcacagcttggactggagtccaggttctacatagatttcagtgctcaaacacaatgccatgctgcctctggaatggattttgatgttaagtataaggcaaaggtgtaaaattttgttttttgctatcctgaacagtcagctaacaaccctagcaacattactgaatcatcttgatttcccacaacgagtgatgccaactttatcacatatattcttattttccttgacatcacatatgtgccagacgacagagatgaagcagtctgttattcccattgcacacttacagattcaataactaagacaactgagaggtgatttatcaaaacctctccactggagacttctgctccccacggcatctggccggcagaccatgagtcatgctctccagcggcccctctcaaacagcaggatcctcaagatgcaaatgaacacccagaacaacactgaaaattagaatttcagccaaactattgctccctcattaggatttcctctaattacaagatttaggaagctgaaatgagatttgcaattgcagctgctgttcacacagcctctgccacttacaagggagagaaaacgggtggcctgaaaaatgtaacaaagaacacttattacaagaataaatatttagggataaataaaagaataacaggagtgattatcaacattatgttcatgtggtaggacgatgggtgagatttttattcttctattctatttttttctaggccttccaaatttatcattcaatactattaccttaataaaaatcactattaaggccaggcgccgtggctcacacctgtaatcctagcactttgggaggccggggcgggcagatcacgaggtgaagagatcaagaccttcctggtcaacatggtgaaaccccgtctctactaaaaatacaaaaattagctgggcatggtggcacacacctatagtcccagctactcaggaggctgaggcaggagtatcacttgaacccaggaggtggagtttgtagtgagccaagattgcgccactgcactccagcctggtgacagaccgagactctgtctaaaaaaaaaaaaaaaaaaaaaaaatcactattaaaacatttcacagtgatggaaaagtgtaagtatacccagatctcaagtttcctgttgcatctttcaaacatgaacaaatacgtactttcaactctactctatatagaccctccattgggcactggggatatagtaccaaaaaatatttagtcttatctataacagtttaatttttttaacctagataatacagtcattaatactggtataattaaatattaattttcaaaatgtttatgaatgtagaaaatggagaatgagcattatattgtcaaagcaaggattctaagggaagtctccaaaggacatttatttggtttggctgtgtccccacccaaatctcatcttaaattgtaatccccatgtgttgggggagggaccacatgggaggtgattacatcatgggggcagttaccctcatgctattctcatgatagttagtgagttctcataagatctgatggttttataacatttcactcaaacctctcaaacaaagttcatttaaacctctccttcctgctgtcatgtgaagaaggacatgtttacttccccttccaccattattataagtgtcctgaggcctccccagccatgctgaactgtgagtcaattaaacctctttctcctacaaattacccagtcttgggcagttctttatagcagcatgaaaatggactaatacagccgtcttgatgctccttccactttgttcatctccacctctcgatcgctgcccaggctctgctactcactttcattctattcctaaggggaattcacctgaaatcagagccaagcagagaagtggctgccctgcctttcctaacctggtagggatatggtggcaaaggcaccccctggaacttcctccaccactgttatagtttttatttagcttctgtaagttactctcttaaaaggagccttcgaattctaagttggcaaacattttataagcctctgggatagactgcctagtgactagagttcctgaacacctattgagatgtggtgctatgtaagatcacaggacataaagaacacaattgacaaccaaacaccttcgcaacatgcctttgatgtaaccatcattgctggagaattcaaacctttcaaaggagtccatattactttggaaaggtctaattaaaaaacaaataaatgaacaaacaaaacaaaacaacttcttaatattgagctccacgactcatgcttataattctttttattggtcctcttagtttatatccccagggcagaagtaataatcccttctccacacaacagtccttcatgtttgatttaatatcctcagatactaaactatggcaattttcattataatgtattgctgctctatcttcattatttttcttgttttcatacttagccacccgagaattcctagaattaaccatctgaggccttccaggaaatcgtatgttaagtgctggttttcaggagaaaactggagaaaagtgtgaattagatggccagataatcatgatctttgtcttatttatcagaatataggagataaaggcaaaagaatagggcatgggggttgctcattgttcttttctatttttatgtttttttaaaacaggctaaagaaacgagacagaacccccagactcatgcctgagagatctcacttaagtctttactatgtctaacacagggacaatgtgctaggcatgtggttacaaagctggacttacagtcagaatccggaccctgctaatcaacagttgtgtgaccttgggcaagtcatttaagcttcctgaaattagttttcccatctatacaaaggaaatgataatatctacctggccgggctgttccgagaaaccaaatgaaataatacatctagggctcatgatatgcttttgatagctagtagtgattattattatttcttaaagaggatttatatggggttctggtcaaccaccttattcttttctagtctacatacaagtcaactgtaccagtgtgtaattcagaaattcagaaatagatgtttatgtagcaggcataggcagaggatatgctactttattataatttttctaaaaactgctgaacaaatgacatccaaaaactaatttggaaaatcaaaataacaagagaagcatgtggacaaatgtacacctgtggccaggtctccaaactgcatgcagtggagtaaatcgccttactcccatgacctccctcttcatccctaggctgtagttccagcccccgccctgtcagttacaagttctcatacgagtcttcgcttctccataagcagatgctaagaaagggtatccactggaatgccaccccactctgaactagcacattaccattgtggtttagattctttattcccttgcgagtttgattagcgtaagttgactgcaaagaattctggatactgaccaagtttcctgaaggcaagaatatcaccttttttgttttctcctgaaaaccagcacttaacatagtgtctcatacaccacagaatgaatgcagcaaacagctgttgaacaaataatagggaggtggtgagagaggagaagggagggaggaaggaaagaaagaaaaaaagagaaagagggagggaagaagagaaggaaaggagaaaagaaggaagggcacaagggagggaaggaaggaagaaaaaaggaaggaagggagagaaagagaaggaggaagggagggaaaaagagaaagaagacaggaagaaaggaaggaaaggaggagggaagacggaacataaaagaggaaaggagaaatgaatgaatgaatgagtcaagataatacctgtgaagcctcttggaagtcatctctacatccctcttagcaaataccaagggcttaacattggaaacaaacacgatagctgcgtcacctgtgcaggctctgctataagtgacaacacacgactacactgtacttagtgataaatgacagagattgggctgaaatcagttgttgacactgccacacacttataggtgatgcccttccagtagcccccaaacttttccaggagaaaatcatacccaccactgcaaagtcagaaagaaagacatcaagaataatcaagtgtgcaattacttattaaagttggttccagtacccactgaacaggcagtaagaagaattgcagtgtctccaccctctccccaaacagcaggtgctaaaacctactgcaaatacaaggacttagcaagttatgttgttagatttagtaaataaaaatacatgcaatatttgggaaatacatgtgcagaaaacaattcccaaagaactttggcttatgcaagtgatatgttagtatttatcatattagattttaacgaaaattttttttaaatattgcatcatttaaactcacaataggtgaactgcagagcctcacatctgtaatctcaaccctttgggaggccaaggtgggaagattttttgaagccaggagtttgagaacagcctgggtaacatagcaagacccccatcactatgataacaattattttttaaattaaccacatgctgtggcatgtgcctgcagtcctagctacttgggaggctaaggcaggaggatcacttaagcccaggagtttgggttgcagtgagttatgatcacaccactgcactccagcttgagctacagagtgagaccctgtttctaaaaaatacaaaaaacaaattaaagaaacccctaacaaactcatcacatgtcaatataataacatcttatgacattttaatggttttttcttacatttttacaaatatctttactgtttactctccagcctaataaaaaacagctagattcttttatttacttctgctttgaatctgttgagatattgcatgtcatacagcttctggaaaactccattgtacacttgtaagagaatgagagtgatgaaagcaaatcatatcttagtgttattatgaaaataatgctggcctcacaaagcccctgaaagggtcttgggctgccccaggagtccctagaccaaactgcaagaactacaactctaagccaactaaggacagatagaaagaccacaaaacacccagaagagatttccatacctgctgtgctggtgtccatcaccggtttctagctgttctgtagtgtgcagtgtctttgacaaggggagagaccaaaacacccattcttggccccagtccagggctgtctccagtggccactctccactgggatgttggtccagtggaaacatggccagactctctaccacctgttggctttgctttcccttccagtgccattcttcccagatcagcatccttaagcttcaacgtaggtatgggtgacaaaccaatcaagttggcttcatttccaaacccacaaatcctaagttgctttacaatgtaatatacatcaagtataggctatcttctccagagcagtagctacaattgttagtgtatattatcttgacttatgttcaggtatcggttggcatgaagtgaaatcttaagagataactcaatatcctaagacttaagaaatgcctggtccaaaactcttcttacaaaagaggcaacagttgtgtcacaagtgcaatgacatttatgtcaattgttgtactcccagaataattccttagaggagaatgaaataatcaaagttgatcatgggaagacatcttttatatctgtaccaaatctgaagtattgatgttaatccctacataacctaaatgtaacattgagctagctcctctctcaccaaaccttttgtgtaaattatgcctagggaaagagaaacacaaaagatcaagaaaatgtacacaatgttcgccagaaaatgcataccagtcccagactcatgaataaacactcaggtaaaaagcactgtcacataaacacattgatgaatctccaaaatgttaatctccaaaatgtccagtcgacttctgatgctcacatacatttacagattctcatcagagcactacatcaattttacataaataaaataccctcctagattttgatcccaaactaggaaaaaatgcttaattataagacttttctacttactttttatgcctttctcttcctaatattggaggccagaggaaagatgaaaaaaattaacaaatataaatagtaaagcttcattattatattcctgaattcccccagtgagatgctacaagaacaaaaggctctgaattccattaagcatgtaaaaccctgcattctttatctccttattaggggtttacaatgcacaatcgcaaaataaaggccctgggaaaacagaaactttaactgattacctcccagattagtttctcttgaacttcacctctttttgcacaacatctattgacatcaccaaacccctgtggcccactctccaggttggacgtcctcccatatcaagcctggggtcgccaaaccccaggagtattaggcatgatgctctgtacgaatggaccagatttgtagctggcccactttcctcagcctgtgatattcaccctccatatcagtgctatgacctgaggatgagaagtccaagagatatgggatgatgatgatgatgatgatgatgatgatgatgatgatgatgacgatgacgataagggtctgagaagtcaggaatagttgtacttgttctcaaagcagagccccacactgaagttcctctaccacaaaatccatttatgcccaaagcacctaactttgtaggtataagtctgtactttaacctcagaataaaattaggacattcctttgatcaaagtcacatcttattacaaaagacttttttcaattataccttattttgcatactctggaaaaacttggagtttagactgggttaagcctattatatttctttgatatgtttataaattatttctcaacatgaagacataaaatggtctactttccattcattcattcacttcaaatatttactaatactctagtaggtgccaggcacactcaaggctgaggagcaatagaagaacagacaaaagaaatggctgtcataatagattgttcagctgtggttggaaaatgagaggcaattattttaaataataattaaaatacgtcatacattaaatggcaaaaaaaagtgccagggagaaaaataaagcaggaaaggggggaaagagtgttggaggaattgcaatcttaaaatgggtattaagggaaggcctcacttgagaagctgatatttgaataatgatctaaggtcgacaacagagtgaaccctccagataaatggggacgggcactctaggacgatgacactgtaagtgcaaaagcccagaggtcccacaaggatgtcagtgtgggtagaggggaactggcagggaagggttataagaggtaatggaagtagggatcaggtcagatggggttttgtgggcctttttaaagaaccttggctttctttctgagtgacatgaaaagttgctgatatgtttgggacacgatagagcctcactcaccttttaacaggaacagactgatggctgtgtgaagaagagattctagtggagcaaggaaaggacaagggacggttaagaggctctgcagtaactcaggcaggatgttacggtgttggtagtagtggaggtgtaaaaatggtagcattctacatctattttagaatttgatgcagatgagcttggctgatggacgagatgagaagcatgaaagaaggcctcgagaatgactccatgtttctggactgagcaacctgaaagatgggatttgctgaggtgaaaacgactatagggggaagaggtttgcagaagacggagatggggtgctcattttttcatgcactaagtttgagatgctattagatgcctaagaagagatgtcaagtaggcagctggatacacagatctcaagttcagaagagaggctgaggctggaaatacatgcctggtatataaaaacatgaggttgaatgatgtccccacagagtgaataacatagattaaaaaaagaaaagaagcccgaagcctgagccatgggaaactccaacattaagaagtcaaagagataaaaaggaaccagctaaaaaggaattgagtctagtaccctggaagccaaatgaagaaaatagttcaaggatgggtaaatgatatattgtgccaaataattctaagagatggagaagtgaccacttaattaaacaaggtggaggtcactgatgaccttgacagcagtttaagtgccatggtcatgtagaaagcctgactagggtgggttcaagatagaagaggagaaataaaaaagcatatagatcaggaattattagatcatgtccaggcacccctgaggggttcccaagagctttccatgcatcaacagagtcaaaactactcttattctttcataagtttatggcagagttgttcaaagattccatgacatatagatgacatcctgtactgacagctaatgagatgtgtgcttgtgtattatgttttaaatgtttttaatttctaatatgggaaatactaatgaatataaccaaaataaactacaattctttggaggtgtttttaagagttgtaaagaggtcctgagatcaaaaagtttgagaatggctgagtagacagacagacatgcatgcatatacttatagcaaagctttagcctcagaagtcacatcggggacgcacagggtcctagtcaaaagctgattctattcagtgcaatatgtgactgtctgaaaagctctagcctgaaacaaccttatttattcagggccggatgtcaaaatgaataagaccatccttcactcaagcacaatttggtccatagattcaaattctctttagcattattatatttttgtctaaggggaaatttagtttagaatggttcaccacacataagagtcaacaatgtattgacaatctcatggtttattactgatgggaatagggaattattttaataaaagattaaggttaaaagaatcaccaccatcccgcttattcattttcaaggataatatgcatcagagctccctttcactcaaaacatatgaagagcccaagattacatttctgtatctctgtgtagtaaaaagaacagataactttagaaatcaacagacctgggcttgcccacttcctagttcagtgactttggcaacatacttgacacctctgagactttattcttcaatctttcaagtagagatttcataagttcgtgacaatcaaataaaatatgctatacaaagaacctaatagaaagcctagcgaaaagtagctattcaataaatagtgaattttttttagtatttcagtaactaagcacaagccacacaccttttaatacttaaacttgaaataataatatgaaaacacttgttcaaagcaagagagaataaaggatttattgagacaatacttacatgtagacattcatagtgaagccttctgcattcattttgaggatgaacccctctgtacaggatagacatattctatcaggtatttatttcctaaatgctattgtgtgccaggcactgtggtggacaataagaatactaaagaaaataaagcagagcccctgcccccagggaagctcacagtccactagggaaacaaattctgaacaaaactgcaatagagagggataaagctgtgtcagccatgcactgggtgccctggaggcagagtgaggggggccagaagcccctgcactgcttactacccaccaagtcctataatcttccttccagtgagtaacaactcttgaaaaatatccctaaagaaccctgctactaccattgccattgacacatctctgaacttactgagttctgctctataatgacagggttagagagagacaggatggtcatgtgtttccggggtttagaatttgattagcaacaatctaaatccatggaaaagacttgcttataaccagtttatttttacatgtgcatttctttttttaaaaaaataaggtcattaagagcccatttgtttttatatatttgacttgtttcaattcattttagtcattgtcctttcatgctcttattgcagcatttcaggctactgggagcaccttcatgttggcctctgtgtccttttgaagtgactccaggtagtctttgacagcctccttgcttcaggggataacaagctattccagatgcatcttatacatttcctacccacacctagaatcagctatttctgcaaggagccctggtagtaggaagttttagtaggatatggtttcgtttagtaagaaatgtggcactgctgcatggctgtcattgctttgaggcctgaatatcattcaagatgtggtcatgttcatgagatgtcgccgcagtgaggttagtcatttactaccacctaacaccgtccttttctgacaatgccgtccatgaggggatgtcccctgaaggcagttattctgccaaaaatcaaagctccctgcagagatatgccattcctgaactggtaggtcactcttggcatatgatcatgaatcacgtcatgtggcagaaaaggaaaagaacctcctagagatttggaaggccagtttctgacgagagaactagggaatcaacattcccaggcatcagccttcctggaaattttccctctgcactctccggggcacacggcctgattccatcactgcctcagcagagacctgagcagatggagctgaaatcttgcaacttctacctaaataaaatggccattatgtaaatatcgggcttgaatccagtgtgcaagggcatatgtgtatttcaaatagccatcaggtctacatttctcccacgtgcttcaagctttaaacaaaaatttcctatcccttctgagtaagaattacaaagttcatctctgaattctccatgacaaccaagaaaggtggcaatttccaaccttgggaaacagcaagctacatgttccaaccctcagacttctcagtccatgattcatcatcataatcatcatcacaattcacacaactgtttatttacggggtgccagttaagtaagaagtatctcatttcccctcacaagaaccccatggcatagataccactattattccatttttacagtgaggattctgagaatctacaaggccatgtgtttcaaaactattaggaggcagtgccagactcaggtctgactcgaggtggatgcccttagccattactctgagaaagaagggaacaagtatcctttctccagttggcaggacatacagtagggaatatgacttggccactagctcccagctagtggggagtggagatgcataaactctgctaactagggcactcacaggggcttttgcaaagtaagaagatgctgtcatttgatggtgacagccgcgctcaagtcatctgtagtaccaggtcctgacgacacaagcctggcttaagaaaaatacattccctttacacatatggatctttgaggaaacaatgcagaaaaagtgctttatactaggttctgctgttattttacacaccacagagccaaatttagcctaagcttttaatacatggatctgtccaatagcctcacggtccaccgtgccagtggaattttcctgtctactcttaataggctatttaaatgcagcaagggctatttttgaaacatttttcaccatttgagtgtggtatatggtagaatttctaaatctcaataatgcttcagcactgattacttcttctgatgggaacattaagtataaatgtatgcatagctgtggatacacagaagatttcatttacataatccttaaaccaggggatagtgaagtagcagctagcctgagagatttttttctaagcttcatctctttgcactgagataactttcacacatttcttttgaatttagctttcacctttttcaccctttaaaataatcttatcctacaaataatggcatgctacattaaattacacctaaaagatggccacatgaagtccagacatggaactaaaatatgcctggacttccaaatatttcaacaggaaggcaaccatcccagcatttgtttaaatatgaaaattttcatcgtggaaattttccaacgaacacgtaagtaaagagaacagtataaagaacccccacaaaccgtttacccagcttcaaccccttatcaacattctgccattcttgtgtcacatgtcaatctcatcagaatttttaaaagggcattctctgagcaaaacaagccttctgtcagaactacagtggtgtctcaaattttgtattttctataataacatagattcttctaccttgtggtaccaatcacagaatatatcaactcaacagcatctgctcaatttcaaaactactctaaacagtaactcacatttgcaacaaatcaagatatgaaagggccaattgctagtgagttagctctaagcaacatagactgatcttttctcatatatatatatcacattcatgtaaaaatacaaggtctgacatggaaggaggggtctagagctgatgcagagtacaagtgacagcaggtggctccaaccagaaacacaaaggtacacacagtctacattcggccacaccaagtaggggacacaggtcccagttctgcttctcatcattatcctcatcatgactatttattgatgatctgtgctatcctgcaccctgtgctaagcactttacatgtcttctctttcatctccaacaggatagatctattttatcttcaacttgcagatgaagaaacagaggtttagagagatttcatggcttgttcagcagagtctagattagaaaccaggttgtcctaacttcgaagtctgcattatttctcctatcacacactttggtcccaagtattattgacccaaatattaggaattgtgtaaatacacacacacacacacacacacacacataaaatccacacctattctgaatctctagtgtgctaatgaataaaatgaccagtacctgtgcaatatctggttaaaatctgagactgtggggctctcaccaattttataacttttttcgctcctgaagagaataaacaaatcaaggagctgtggccatgctcatctggacactgagtcgacactgtttactgtacttcaaagcacctttaatattaggaaacagctctgggtgctaatgtttcctggggcaggtgggtcaggaggtttcaaagctgtgactatttagtgccagcaaaaaccaatcttgacatcgatctaaacgtgcttcagaagaggtggttccaggagaaactgtcagcttaaactccctgagttatctgtggtatttaagtccaggtaataaaaggctctctgatatttggatcacattttgtactgaaatcacctgaaagggtatttggggagattttgacagttaaataatgaaagtttgcaaacgagaaagcactatgttataacctaagatattcacagggggctgggaaatgcaaaggtaagtcctctgaacttaattctttgaagaaaatatttaattagcaaatgtcttacataatggaaaaaaccttcaaatagtacaagaaggtggtgcaagaatggccctgatttgatatactgaaacatcataccatgtgtatgccaatgtcttcagtccattccaaaagaaaactgtcataataattgtgctgccaacggtgctcattctctaaccctaacctacagtatttactctaatattaatctcctctataatcgtgggtgatcagctaggctccacagcttcaaaatgctgaactttaaacagcttattaattactgtgtgtgtgtgtgtgtgtgtgtgtgtgtgtgtgtgcgcgtgtgtgtgtgagagagagatagggtcttactttttcacccaggctgcaatgcagtggcgtgatctcggttcactgcagcctcgacctcctgggctcaagcgatccccccacctctgcctcccaagtaggtggactacaggtgtgcgccacctcacctggctaatgtttttgtatctttttctagagatggggtttggccatgttgtccaggctggtctcaaacttctgagctcaagtgatcagctgtctcggcctcccaaaatgctaggattacaggcgtgagctaccacgcctggccttattaattactattaattaagatggaagatgggataatatcttccatcttatcccaaatagtatttttctcccaactttagttctgcatcgctctctcaataagccatacatagtggggatccatatcatcttgaatcttctccattaaatcttggtttcctagatataagaaagcttcagaacaccaggcatatgtgtaatcaccatactgcttttcctttcttggtgaactgatctgggaaaacaaagggcactaaaatttactaaatgtctactgtatgtgccagacatgttaatggcaccacatcaaaatgagcctgtcaagatgtaaaactccttttttaaaatttttgccaatatgcactactcacatccctgcctctgttctgaacctaaccaactctccaattatggggcaccatattggattaagagttatgtgtatttattagaaaaaaaaagataatcggggggaaaaaacagatattttcagaaaacctattagaactggctttgattctaaatgttattattacttccaaactatcattataaagaagacttgtaatactaacttgaatatatattttactaggattgaggccataattgttaaaaattaattgaatacttaatgggcatctgaagttcaaacaccctcctccacaccctctcctgcccccaaacaaccactgactactacacagtcaaacaaatataattaattgaaataataatttaacaagaaattataagaataattatgattttaatcatataattaaaactcacaaaagtaggtgagtccattctttagaatagaaaataccatattcctattgatcaaattccaatttcaactaataaatttaattgatattgaagtctgactatccaacattaaagtagaaataagataatcagagattcagaccataaaaactgcaagtgtgagcagaacacttcataaagaacaagcaatatccttttctagaataaatgaatatggtcaacactcaactcttggtgaggtataattttacttctagattgcatctaattctcacaccatcacttacccatctctgaatcccaccgaattcctcattccatctctcattcctacttttaccttaatcctcatctcagggttgatgtgactgtaaagcttacatattggataagattgcctgtctcatacactagttggtaatttttttaaatagcagaatgtttaatggcttggcttccagactgtgtcaacctaccccgagcatcaaaacagctgcatccaaaccataatggtcacataaaatgtcatgtattcttgccactagttatttcatcacaacaattttgtagaatactgtttctgcccaacctgaagatgaggttttattaaaattatatctctaagaatacaggctttgcatttgattgctgacacagtatttcatattacgtagctctcaattattaattgagtatgtgaaagtttagtttggcgtaaacacaccaacctgatacatccttaatcaatgccagttttatatgcccagaaagggcacctgtgaacacaaaattgcaaatgttggacctcctcataggcaagattttagagatcacttaaaacaattcagtgggtggaaatcaccaacaatcacagaatggataaaaacagtaaactgtcttaatgagttcttgttgctcgaaataaaatttcaagggacactatcacacagggcttcaaagagtgctttatctgaaatgacattgatggagtgttgaagtgttactggggggtctttgttcttccagctcccaagatgaggtgggccttttgttctctgacccggggttcttggcctcacagattccaaggaatggaaccttgagccatgcggtgagtgttatagctctattagaagctgtggatcacagaagagaaccgtggaacccagcgactagtgttcagcttgattaggacgaacccaggcacttagctgtgcaggaacaatggtgagcctttagcccaatcaggagcagcaacggatgcctcgctggatcaggagcacagcccacaccctgccagatctggaggggtagaagtcagcagcgggtctgtgatggcggcattcagcagtggtggatggtgagtgaaagctcagcttgagccagaacaaacacagaccagaagagtgtgcagttgcaagctttaatagagtgaaaacagagctcccatacaatgggaggggacccaaagggggttgcccactcccggctcgaatgcctggggtttatatcccaatcattgtccctccccctgtgctctcagatgatagatgatttgactatttctttacctcctgctcttagcctaatttgtattttagtgagccctctttactacctgattggttgggtgtgagctgagttacaagctccgtgtttaaaggtgggtgcggtcaccttccccagctaggcttaagaattcctagtcagcctaggaaatccagctagtcctgtctctcagaagttccctggaaaactaagtgggataactcaaaaggtggctctattgaggacaatgaccacaaggccatagatgcatgtgaaagactaatataactttcataaaatgtaagagtaaaaatgtcccacctcgaaggtaagatataattttatattataagcgatttcaaaatgttactaaattaatacactaatattgtaagttgacattcacctatttgcagtatagccttaaaagttcatttataaacaggagggatattttgagagggaatcttctcaccagttgtcttatattcaggagaatgcggtaaatatcattatcatagggctaggttaccaggtctcctctgattcccatggcaagctctccagttccctaaagctaagggaattttcaaatataaataaattatgccaaactgtctttctcaaccaagagagaataatttaagaatcttggaagcccaatgcctcctttcttttcttttctttttctttttcttttttttttttttgagatggagttcctctcttgtcacccaggctagagtgcaatggcatgatctcagctcactgcaacctctacctcctatgttcaagtgattctcctgcctcagcctccctagtagctggaattccaggcgtgcgccaccatgcccggctaattttgtatttttagtaaagatgaggttttaccatgttggccaggctggtcttgaactcctgacctcaggtgatctacccaccttggcctcccaatgtgctaagattacaggcataagccaccacgcctggccccaaatggctcctttctataaactcggctctcataagttagaaagggtcccaaaagtggaacgattctgcaaagttcccccaaaccttatcatccctccaccactaacaataaacacataaccaaactgcggacaagcctacagctgtcctcagcatgccatctttaccacctccctaattctgttcactgccctgacacttgtcccaaggaaccaactatatcccttgaggtctgtgtaaagccattcacatttctctgatgtctttcgctgcacatattgctgagaccagcttggtcgtggagaccctaacccagcagcgctagaggagttaaagacacacacacagaaatatagcatgtggaatgggaaatcaggggactcacagccttcagagcttagagccatgaacagagatttacccacatatttatttacagtaagccagtgataaacagtttctattatagattaactaaaagtattccttatggaaaacaaagggatggggcaaaacaaagggataggctctggctagttatctgcagcagaaacatgtccttaaggcacagatcgctcatgctattgtttgtgattcaggaatgcctttaagcggttttccaccctgggtaaacccacaaccttcagcgtgggcgtcatggccatcatgatcatgtcacagtgctgcagagattttgtttatggccagttttggggccagtttatggccagatttgggggcctatcccaagcaaggtatgatcattccctcttcacagctaccatggccccttctgagccatgtttgatcagaaaaagaaatgaccttgggtccagtgatctcagttaaaattcagtttctgggcccggcatgttggctcaagcctgtaatgtcagcacttcgggaggccaaggtgggtggatcacctgaggtcaggagctcaaaccagcctgaccaatatggtgaaaccctgtctctactaaaaatataaaaattagccgggcatggtggtgggcacctgtagtcccagctacttgggaggctgagacaggagaatttcttgaacccaggtggtggatgttgcagtgtgctgaggtcatgccactgcactccagcctgggagacagagcaagactccgtctcaaaaaaaaaaaaaaaaaatcagtttctcccactgtgtggtctcacctggtgatcctgggccagctactgagactccctgcatctcggttcactaatcaataaagaggaaatagcaatacctgcttcacagctgaataaataggagcattgctttgagaagccaaggccaacctgcggcatattctagccccaactgctgttaaagctggggctctgttattgtactgacacacctcctcttgtaacttcttctgaacctgcattatctctccaactaaattgcaagtgatccaattgtaattgaaatccaattaaagttattcaagtagtaaaacaatgcaagtactttgtttcactacttctctctatatcttacaaagcacttggcacacagtagaggcataataaatatgttggctacatgatacaaatgaaaggctttttataggcaagaaaccataaagcatcttaacaatagggtaaacatttacttatttttgtatctgtaaaaggatctacttcactctagtgaagcagaaactattctttcagtgtagaatcatttctactaattttctttggcagtcttcaaaaacaataagataaagaaaaagaaaagaaaaaaacaaaagctcaagcaactcccagtgtgccctaccaaatgtacgtttcaagggagcaagcccggctgaattaacagaggttacatccaaagggtaacaagcagcgttcctgagtggctcttacattaagtcaaatgaaaatattaaaggacctgtaattttccctttattgctctcagttccatcacaggagctaactgcctctataaaaataacaaatgttaatttgctgcattacttgatagctttgctctgcaaagaagaatgccacattcggtcctgctttgattcactttcattcgttcatcaacaaacatgtatggggcacccactgaaatgctgcatcctgttcagggatctggggatacagtagtacagtagtgaacacacagtcaaaaatccccactcagagcttgcattcaactgggtagagaaataacaagacaagtaagtaaaacacatagtgcgtgagatgatagtaaggctcagggtataagaaggaagctagacgggagagaaaaggaacagacaaagctggcgggagggtggtgggaaatgaggtcaaagagggaacaagcagctaggtgatgagggcctgtaggacatggcgagagcggtgggtttacccggacaacatggagagccaaccggggctttgagaggaggcctgacaagctcttggcgttagcatgctggtggtcgtgtggagtaagggtgcagggggtcacgggaagaagcaggaagcgaagctgggagaccagttccataatcaggtaagagatgatggtgccctgggtcagagtggtgaggagcgatcgaattccaggtatgtcctgaaagtagagctgccatgatttattgatgttatggatgtggggcaagaaagaaaggagtttagagtgacaaggtttctgcgaggtccatattacaagatacatgaatgatcccagtgaattccaagttccttccaagtaacttctactgatgtcccgaagacactttcctaaaacaccctttcctcctaaccctagataccagctgtttggaggacagcaacctacactgactgcttccctacctggtatcagacattgtgcaaggtgctttgattccatgtgatctattaacaacctgtgaggtcttggttattgtcctgttttatggttaagagacctgagactcagtagatgtaggtgatctgccaaggcttcatctggggaagaaggggtacgtatgaatggggtggcatctcttccactccaatggtttgctttcaagagggaaagccaagccagtattaccacattttcatatttttctagagaaatatgaaatcgagactactatgtggattctcctgatatttacatgtatagtttaaaaaaaaactatgggccaaacaaacaaatctgcatcccaaatttcccctaaaggaagcaagataaagacatcagtgctgcttattctaaattatttctaaatttttaagcaatatttttttcaaatgatgatcttaggtgatgcaaaggcaattaaaccctttaaagaaatctaaggcagagattagatggaagtaaaaaaacaagggggggaaagaattttaagacggatgcttaggccactgttgtggtgtacattacatgtgaaatgtaccagaaagaacacaaacagcctttgccctccatgagagaaacttgctagaggaaaacagggacaggagtctgctaatggccagggctctgagctccatgaccagggagggacagaggggagttgtgccctggttgccctggtgatacacaacgacgctgccccgcccctgctttggggacacaagcaaactgctccccagggcttcactcctgtgtgtcttcccttcctctcctccacatatcacagctccccctttccctcagcaggaggcagattaggggcccaggtacatggggtagtgctgtacaggtgggaggtgctgggaagacaaaggtcatgctgaaattaggctgtatgaaaaagatatgtctgcagtctgggctgaagggctctatagccaggaggatagtccctgccatgtttctctcatagataaagggtatcacaatggccagtgaagcccgaatacagagtagaggttgtggagaagtgcaagaatcctcccaaaggagttttaggacaaatatcaatcagggtgtccagaaaagtccaactttatttttttatctcatttttaattttagattcaggggttacatgtacaggttttttacatgggtatattgcttgatgctaaggtttgggatatgactgtacccatcacccaggtagtgacacagtacccatttggtaatttttcaacccaagctcctacccccacctctagtagttcccagcgtctactgctcccatcttcatgccaatgtgtgctcagtgcttagctcccacttatatgtgagaacatgcagtatttggttttctgttcctgcattaatccctttagggtattggcctccagctgcatccatgttgctgcaaaagatattatttcattcttttctatacctgcatagtattccatagtgtatctgtaccacatttatccaatcgaccattaatagacacctggattgattccatgtctttgctattatgaatagtgctgtgatgaacatatgggtgcatgtgtctttttggtagggtgatttattttcactggggtatatacccagtaataagattgctgggtcaaatagtagctctgtttaatttctttgagaaatctccaaactgagaaaactccaactttagcttggatgtgagcaagtgtgagagaacagctactggtgtgaaaggtttgaaagtggccgggaaacaggagttattacttgccctgtgggagagaaggaataagtctatggaggggtagagtttgcttacaagcaaccagcttctaggagccaacagtgggcttcctccagcctcttgtctcagttccagcctgggcacacacaggattggctcttcagacagaaatcaggagcccggggaattattagtcctatcaggcaagaagtataggcagtagagggtaaaagttttgtatgttgagacactactgagaggtgggaggacatgaaagggagagggcagagtggattattcacacccaaatcttaaactgggaccctacattataaacatgccccaacttgtgctttcatgttgtaattctataatttcatgtttgcctgatgcagtcaaacacaatcaaacaaaaatgaaacgtgacgggaagggaaagatgagaaaggatgggattctgagcctcttcctctttatttattttttcaaaccagaaatctaaaactgtcctttaccatacctcttgcccactcccacatgacaaatctcaccaattctacctcccagtggaccctccattccatccaccaccttcaggccactgccagcaccctgaggtagatggccttctggcctatgcatttatctctctgttttcagcccattctctactccagtgtccaaatgacctctcaaacacatgcatctgatcatacttctctctggcttcaacagtttcccactaactcttacagaacaaagtcccctgccgcccggcccatagcaacaatgcaacaaatagtcattgaataagtgaacattttgattttacatcatttcatgtatgctactccattttgagtcaggataaacctctgagctgactatcaaaaagcacacatagttcttgtcaaccattaaagtaaactaaaagggcagggaaaaaaaacagcccatggttttcatacaataaataataaaagtttcagattcatagtcatccatttgattatgacatatgaattcatacaactcatgcagatttgtatatatgattgtatttccatttaacaggaatctgtcatcatgaaagttatattatgttaaataattgccctctactgaatatttgccccataagaggaacaggaaaagggttataatgaatcactgacatcagaagatcatgtatttgacctagatgcctctgaatcagctctgcaactaggacttcaaggtaaaacatatgttatacagtcaaatatgaatattttaattcaagagatatgctctgaggtaattcactgtctgagatttcttaagcagaattaaatactgtatacattccccatgctgaggtgaattatctttttatttttttccacaatgaaaatagatttttatcaactctcacaagcagaggcaaaaattactcctaccaaataccaatgatactcacaggatgtgacattaatgtctaataggcttagccagtcttaaaaaaccccacccatcacaactcaatggaaaatactaataccatatgctgagatatcttaaaatttgaaaatagctttatctttccatcttgtttatggtaacttgtattcttgttttgtgtttctatggggtggaatctggcaatcttttcaggtgtagtatctgccttggcacctggctcagaaagagttccctttcctcagtccctgcatgtgcccacccttatcctctgagaacatttattttatcttcctcacattagtcttcatcttagctatgaacttatttttgtatagagcatatagaataaagctggggtcattttttcttcaaatgatgagttgttggcccaaatagatttattgaatgattcttacatacctttgactttatgttttaactttccataattttccactgatttgtctatttatatttgtaatattttaatatccaacaagataaggtcaacttccttttagtgaaagcaagttgttaagttagtctgtttaagtcattacttgtgttcgcaatgttttttgttgttgttgttgttcttttgttgttgttgttgttgttgtttgtttttaagactgagtcttactctgtcacctggactggagtgcagtggcatgatctcagcgcagtggcatgatctcagctcactgcaacctctgcctcccaggttcaagcaattctcctgcctcagcctcccaagtagctgggattacaggtgcctgctaccatgcctggctaattttttgtatttttagtagagatggggtttcgccatgttggccaggctggtctcgaactcctgacctcgtgatccacctgcctcgggctcccaaagtgctgggattacaggcgtgatgcaatgttttaatatcttacaacacaaggtctacttcctttcaccaaaattttccaatttataatttatattttataggtttatcagcctgtttctaattccgtattttcttgatgtggcttccagcttctgttcttgatttgtcatcttagttatgtttattttattagccttttcaaagaattaatttgtactttaactgattaattttttggtattattttattgtctcattccttgatttctgcttgtaatcttgatattcctttctcctcctgtccttagattgggttttcctggcttcttaagtagacactcattttctttaattttatcttttcctgtataacataaaagcatttaaaacaactgctttttccctgaatatagctttgcttgtctcccatgactttagtgtgtaacgtgctcaatgtcattaatttctatatagtgcctaaatgtagctttgatttcctctctttgacttaagttacttaacataaatctttctaatttttcaagtaaattgtgataaaccttttcaattattttctaattctttgagttgtggagagaatgtggtctatgtgatttctgcttttagcaatgcagggacatgaacttcattgtttctatataccgttgacccttgaacaacacagatttcaactgcactggtccatggactttcttccacctctgccacctataggacagtaggaccaacccctcttcttcctcatcctcctcagcctactcaacgtgaagatgttgaggatgaagacctttatgatcatccaattccacttaatgaatagtaaatatattttctcttccttacggttttcttaacattttcttttcactagcttactttactgtaagaatgcagcatataatacacattacatacaaaatatatgctaatcaactgtttgtactatcgttaaggtttccagttaacagtaggctattagtaattaagtttttggggagtcaaaaattacacgtagattttttactgcattgcggggttggcacccctaaccgccacattgttaaagggtcaacggtaaatatatatctacatattacatctacataaattgctatgttcttatacatcaaatttggtctgtatttggtctgtatttgttctgtagcatgcacttgtattaatattttatcattaatattaaatttgaaatattttaaatatttatgtattgtaaatattattttaatagtaaaataataaatagttttagtataaatgaattaacaaagcccctactttccaatagtattccaacagtccactgttatgagtctcctcatacagagcactgtgatataaaatatcgttgtatctttttattttcttataatatattcctaagagtggaatcactgaatcaaaagttgtaagcatctttaaggaccactcccaaacaacaatttgagagtggcctttggattcagtcctcgccaagaggtaacaaggtttttaaaatacatttttatttgtgatagtttaaaaaaataaaagataaaaatcccactttaaatgcatttattttattattaattaatcttacctttcccatacctttctaaattatttttattgcttcttttgagaacaatctaggccaatcatgagttttaagcaaatatttaaatttttctttgtatctgtttatcatgtcacattcctgttataatattccttccattccatgcctctttgagttacccagaaattccagattaacattaaaaaatagtatttaatggtggaatcctcttcatattcccgatttttaaatacaatgacttcagtgtcagcatactctgatgttctcgtaagattaatattaatatttttaccataaaaaaggttttatttttaaaacaggaatgagtggtgaactttatcataacttctatatatctattgagattattacttactgattggctacacttttatgttgaaccataggaaaatgtcaatctttgaccattttttacctagaaagtatggtaattttctattgttcaacctaacatattaaatgatatgctaaatattaaaccatccttgcaccgaagagacaactcctacctggttacagaggttaattctttcagtgcccttttaaattcagtttgtcagtgtttctatatgagatttggtatctgcattcatgagttagctttggctgggtgttctttattcaatctttgttataaggtaatttgcataagacattaagacactgttataaagtgacaggtactaccacaaacattacccatgctggcagtgagccacagatacagcttgtcttctgccaagcaggaaactgtactcaaaagacgattacaaatgattgctcattatgccagttcacatcttttccttgaagctcattagcacagagacgccgaactctcctgaggtccttgttatccagtggatctcctctcctgctccaaaacagcctttcccattgtcagtgagcagtgccaccttaccagctgtgcccagccataaacctgcccttctgtaatagaaatcaagagagaatgtccaggcatccaaatgtcaaggcctcatccacagccaccatggctggcccttcttcgctactgcaacagttgtcccgagaattcactctgatactaattggaagccctcattcccaagaagcaggtgtctgactacacttctttctccagatctgttaaaatagcatctcattaaaagcaacctcccttgggagataaggccaaagacctctgtcttatttcacacttaaattattttttctctttgcttaatccaagttccattttgtgaaggggcctttaagctcaaacggttacttttttcatgatctaggacactcaaagctgtattctaataattaaatttatgatatttgaaaatccaaactatgccttattcattttcttattctttcaagccctcccagtatctatagcacagttctgctcagtaaatgcttgctggattcaaagtattaacatagtcgtatttttcagaggtaaggtaatggaatggaaagactaggacctcaaaatgctaaagatctgcctggaaatcccagctccactgtgtaactttgtctgagtgactcaagctctctgagtgtctgttttcacttttgcaatatggactaatcagattgctggcagctctcaagaagaaagcaaacataatttatataatatttgaggtgagcaagcactctcctcaccttctctactccctcattataagatcctataaagaaccccagaaaactaccgaaggcctgtgtattgctcagatcccaaaagcaaaaccataactacctgtgggtatcaatgcaaaaccattagcaaattttctatgtggatctaaacgccctaaggaaggcagcaaataaaagtccttcaacctggtcatctcaccctgtctatgccattgataatggaggatgttaagcacaagccatctgaggacagcccagacactctacagcccaacagtgggcagcaccacagacgccaataagggggatgagacaccttgtcccaaggtccacagaggcccaccctgaccacctggcagccctctctcagagcctcctccacctcagctcagtagcccagctttctaaattgatttctgtgtctgtttcccatagctgttataacaactaccacaaactttgtggctggaaacaacacaaactatttgttctgggggtcagaagtttgaaatgagtcttaccaggctaacatcgagctgtcggcagggctgtgctccttctggaagctctaaaggagcatccttccattgccttttctagtttctgaaggctgcccatattccttggcgcatggccctgcatcactctgacctctgcttcatggtcgcatctccttctctgactcacttgcctccttcttgcttttatagcaatccctgtggttacagtgagcctaccccagtaatccagaataatctccccatctcaagatcctgaactgaactacatctacaaagtctcttttgtcaggtaaggcaagatattaaaaaattccggaaatcaggatgtagacatctttgagagtacattattctgcctaccacagttttcaataccttgacgtgacaccctgaaatgatgcaccaagaacactgcttctcttctgtggtattcccactgaaattgtgtagcctaaatcatggtatcctgaggaaacagactgcccaaattaagacacattctccaaaattactggtgtatcgtcttcaaaaagtcaatatcccggcccaatggaaggctgaaagttgcctgagattaaactaaaaggatatgatgttgtaaagagcacaactgacaacacctgaatcaggtccagagatgagaaaatagtaccatatctatttcctcattgcaaatattgaacctactttatggcaggtggatcacttgaggtcaggagttcaagaccagcctgggcaacatggcgaaaccccatctctgctaaaaatacaaaaattagctgggcatggtggcatgcgcctgtaatccctactactcaggaggctgagacagaggaatcccctgaacctgggaggtggaggttgcagtgagccaagatcaagccactgcattccagcctggtgacagagtgagactctgtctcaaaaaaaaaaaaaaaaaaaattatgccaaaataaaaagttaaaatcaagccagaaaatatcacataaaaatcacattaagaaacacaatcctcatttctcagaatttcaaagcaaagaaagaggctacatgaaccagctttgaaatgcttttctattctctcaacctcctttggactccatgggtgccagatccttcctagcacccgaaccatatttggtagttagctaggtacaagctacagctacgaacgtacatgcttccatggtggcttaaaacagtggttggtttctaacgcccctagactatgcaaatggagttacatggagtgtgcagaagaagagccaggcctccatatcagtcttccatggaggttctgaaacccagcatgccaagggcttgtcagatccagtagaccaagcatcacagctcagccctccctgctcatgcagtctggtcatttatgtgacacttccctgaggcctcaaaggattgctaggtcccagagtggacaatgctaccaatccagctaaactgtattcagaccgtgctctcatcctggaagcaaaaataagaaaagagatgcacattttgacaaatctgacaaacatgtgactgtgtaattcaacaaacgtgatgtcctttctcttcagtgaatgcagggtggagcagaaagaatttaggttacatgtcagaaataattacagtaggagaattatatcctatactgattaagatgttgagagaatttccaggaagcttcaaaaaatagacacacaagtgtgattgtgcctgtctgaaatgggatgatgtggtcatttgtgaaaaccacatctggggaagatgagtggtcctcattcacctgtgctctaagatctttgtaaataggagatttttgcactatctccaacaaggcacacacagaaacaatgcatagcaacagatctagaaaacgaataatcatacattgtgcaggcagacgaattttgactatccaatgatggcaggacagattgcaacaagagcaaaggacaaggtgataaaccctcctatcccccagcccagagcctctgcaccttcggcaagcccagcatgtctgtggactgggcaatgcttgtgtgctgatgtggggtagagaaaggagatatgcaagaatgaggacgagcacacactgccccagccctgcacagggcagttgagagcttgggatgagtctacgggcctaggttgggatcctggctcagccatgtgttgctcacatgagtagaatagattacttcatcccatggagcctcagcttcctcaataactacctcctaaggttcctgagaactggaagagtccttcatccaaagacccagctcttattattattaccaggaatctaccctgttataaaagctctacaccaaatgaactatgttccctcttcaatctcccctctgcctcaggaggactgactttgtcatctaaagcaaatgatggccgattcaaagttcttttttctcacccttttcttctcaggctgtctctaagaacagcattttccttcatttttttttcctaatagttttctttatttggaggtacgatgtgattagtcaaagtagactatcatttttattccctccatccttcataaaaatgacaaaggattaacaggtgattcatttggaagttagtaaagattaatgaaggatatttatcacataaacacaaatttctgtggcaaagataaagcaattagcttttcttcagtgaagtctgaagccttttgggtactgatcccataataagtatggctacagaaccagaaaggcctagacagaggataaactgttatgcagtaaggaggcagagccactcagagcagaaagggtgggagaaggggacaagagaggaaaggtgaggggacgaggggaacatgggctaaagtttgggtattgagagagaaagcaagaggaagaaaggggtttttagggggctacactgccatgacacatgaaatgatggaaaagagatgagacggaaagcatctctagaacattctgctgtatattagtcaatgtactttgcctttgggcccctttttgagaaccttcagcagagacttctggaactttctaaggcttttgtggaggtcacatttggttctctgtgaaaatgtaaggtagagtccatttaatatttcttttgatttttagaattttgatccaatattcactggagacttataatggttttcttttcgttttttctttttctttttttctttttcttgaaacgaagtttcactcttgtccccaagcaggagtgcaatggcacgatctcggctcactgcagtctccgcctcctcagttcaagcaattctcctgcctcagcctcccgagtagctgggattacaggtgcccaccaccatgcccagctattttttttttaaatattttaagtagagacagggtttcactatgttggccaggctagtctcaaacttctgacctcaggtgattcacccgcctcccaaagtgctggcattacaggcgtgagccaccgcacctggcctttataatgttattttgagtgctagaagtctaaactcgtaggaaagaaagcccctcagtgcgagtctatggccatccctcatatgcatgacctcacttactcctcacaactgtgtggtgtagaaaacgctcgtgtccttacattacaaatcaagaaatgagtgctcagagagattgtggaactcgtgcaagcctgcacagtaagtaaatgggagagctgggactcaaacctaggtcttgtactaggtcagtacaagcccagtccccatgctttaggttttggggtatctttggtttagggatttgttttttgctttttgctttttaaaaaaattgtggtgagattcaaataacatgaaattcaccattgtaaccctttttaaatgtgtaactcaggggtatttagtgcattcacactgttgtgcaaccgtcaccactgtctagttccggaatattttcatcatcccaaaaaagaaccctgtattcattaggcagtgagtccctattcctccctctccacatttcctggcaaacactaatctgctttctgtctttatggatttgcctattctagctatttcatataggtggaatatctacaatacattatgtggcctttggtgaccactcctttcacttagcatgttttctacattcatccatactgtggcacgtctcagaacgtcattctcttttttttttttttttttttttgtgagacagggtctcactttgtcgcccaggacagaatgcagtagtgcaatctcagctcattacagcttcaaattcctaggctgaagccatcctcctgcctcagtctcctgagtagctggggccacaggcaaatgccaccactcctggctaattttttaaacttttttgtagagacagggtcttgctatgttgcccaggctggtcttgaactctcggcctcaagcaatcctcatgctttggcctcccaaagcactaggattacaggtatgagccaccgtgccaggccaatcatccctttttaaagctaaataatattcattacactgtatgaattttcacattttatttatctttcctcagtgaatggacatttgtgttgtttctacctttgactgttataaataatgctgctgtgaacattcaagtccgagtttttgtttgaacacttgttttcaattcctttgagaaatccccatgtttttcatcattacagtgcccaactcttcaaaatgtgactaattcccatgacaaccacctagctttgagggatccaaggaggctcagaaaagcattctttaatggagatggtgacttagaaatgacacattcagagaaatgccctaaattctaccaaccgaaaatttctcaatttcagtactaatttctaaaggtcccaaatattcatagaagatccacccaatatgaaagcaactaaccagcacttcaaatcacctcattttcttattacgagctccactttagctaaatttccaaagcagaacatgcaaaatgctaacatagttaaatgtctatttggttatacataaatggtgcatgtccattaatgtataatacattttgaatgcaaaaggtaaataccctttatgatttctcaagctaccatcaaagaggctccagtggtcaacagcaggagggtgacagaccccttcagggacctcaggacccccggtgaagcaaggtaggagtatagtaagtggaggaaagcagttgaggaaaagaaaccaagaggctctgtttctactactggaaaatggtttaattaatatctgctaagtcatcgatatctatgactgcacaataaaatgaaagtgcagggggtccagatgctataaggatgaagacaaggaaccctgcacaatgttctcagtttatttgaattacataggccactgaaggcactgaaaataggacctgagacttccaatacccaggactttgtgggatgaattcctgatgttaaactccatttacaaagccttatgaaaattacttaaaacacagaattttcttttagcttcccccttggagaaaaggctgatataagtcagtgattttctttttcttttcttaatttgtcacattgattttatttctctgctttttttaaatttttttccatttcaatttttagtagagatgaggtctcactgtgttgtccaggctggtctcaaacccctaactcaagtgttcttcttgcctccacctcccaaagtgctgggattacaggcaagagccaccacgcctggcccttcagagattttctgtggctcttcttagaacccctgtaagagcacccgtgggtgttgctgtgcataagacacagcctgggtggcattcaggattgtgagtatctgagcacggctcccggtcagctttcccaggtgcagcttcacaatcactgtcagcagctctgaccatccagccctttatctctctgctcctggtgtcctcatgggtaaaactgaaggcaacgtgctctctctgccagtgaagattaacttagacaataaacaattgcctggcaaggtatctctcctctctgcccccttcttccaccttttttcactggggagctccctgtcttcctaacatactattttgacccctctctaggcttttggggttctgtagcacatctattatcctggtcagctccctgaaaaccctcagacttgaaacgagaaaggctaacagtttttgcctttgctgtgtatctccccaatcctccaatatattgatgccaataattgtcactacagacaccaataatcaatactgacatcaaacaggagaaagaaggctgagggctgcaagaagtgatggtggaaggcctggcccccagacactgtcatctgtggtgtgattcatggttttaacccacatgtgcagtacacatcagcaatcgaaattatgcaatgaccatgttcttcaacctgtccatttcccctaggcaagcccacattaggaatattcctacagaagaattagggcaaaggagatatgagagttctaagcaacacaacgggcagtttaaatgagctagtgtctttttgttgctatatgaacgtgctttacgtagtcaatgataaatcatcatgaggcaaagagcgatattttaagccaaagcaaagctttggtaaaagcccagtgggctcttggccccaatcccatttgctggaaaggtgagatgactgtgagaagagggtgatcatttgatcacaaggcggagggaggggccagttgctgaaatcagctctctgtgttcaggctcgactcggataaataggaactgttttcagagccagctaatagtatcaaagtcagcacaagcaggaatatgcacgcagcacacaggagggcaagagcagagctggttttggagaaacacaggctctctccttcgatggaggtttccttttatttctgtttaacttgggtgccaataaaggccctcgaagtcaccctgaaaggcatctgctaagcctccccaccatgcttgattatacctagaaatcctcctgcccaaactcagccacagtgaccactggctgaagcactttaggcattttgtcagaaactgttggcacactgtagagagcctgaggacatcccaggaattccacaaaggcagtcagtgaagaattgggtccaaacaatggtccatccttattacacccattaaaaaccacattctccaagtggaccgaaccaagaggtgctaagcagaaagatctggatctaaggctatcttctgtatgatctcaacttgtaaaatttatctttttttttaacaaagctggggccatactgtataaggtgtatatatacatttaaatagtggttacccctgggtaatagattgcaggtgctgtgttaatgaatatatattacattcacaattgtaaagtatctatttctaaaaatggaaatttagttacagatcatacagacagcactcaataatcattaattcatccagtccataagctttttcaaaaacttactctgttcaaaaaccagtaaaaggaggaaagcacataatataaaagaaactcagctgagaacggtggctcatgcctgtaatcccacctgagggatcccacctgtaaatcccacctgtaaacctcacctgaggtcgggagttcgagaccagcctgaccaacgtggagaaaccccatctctactaaaaatacaaaactagctggatgtggtggcgcatgcctgtaatcccagctactcgggaggctgaggcaggagaattgcttgaacctaggaggcagaggttgtagtgagccaaaatcgcaccattgcactccagcccgggcaacaaaagctaagctctctcaaaaaaaaaaaaaaaaaaaaaaaaaaaaagaaagaaagaaagaaagaaagaaagaaagaaagaaaagaaaagaaaagaaaagaaaagaaaagaaaagaaaaaagaaaagaaaagaaaagaaaagaaaagaaaagaaaagaaaggaaaggaaaagaaaagaaaagaaaagaaaagaaaaaagaaactcagtgagttacagaaaacacaaatccacagaggggcacatacaaataaaaagccaattttgttgacattttattctaataaaagtataaaacactagtcttggattattaaaaaaatagaacctaccatgttttgagaacttactatattccaggcactatgctagacttttacttgcactatctactaatctttcagttatcctttaagttaagtgttttacaaatgttacaaatgaggaaagtgaaatttagggagactccattgccaaataacaagtaattggaagagacacattttaaacatgtgtctatccatcttgatttgccctataaataaataaaaaggaatgtaaaacatttagtaacatagcaaacaaaaaaaatcatttaatttcaacttatgagctcatagagacaagagttaaggagtataaggacagagcagcagaatgagagaatagaaaggaagaaaaacagagaagtgaatggtacccagacattagatcaaatatcaagtttaatgatccagcaatcccactctgggtatttatccaaaagaactgaaaacagaatcttgaaaagctattagtattcccatattcactgtggcattattcacaatagacaagaggtgtaaacaaaccagatgtccatcagtagataaatggataaaggaaatgtgatacatacataaaatggaatgtgattccacctttaagaaaattcagcaatatgcaagaacatggatgaaacttgaaattaagctaagcgaaagaatctcatcacagaaagacagatacagcataattccattcatatgatgtatctaaaacagccaaattcatagaatcaaagagtagaatgatggctgccaggagatgcaaggggggaaatggggagttgctaatcaatgagcataaagtttcagcttagcaagatgaataagttccagagatctgctgtccaacactgtaccctatagttaacaatactgtactgtacacttcagaatttgttaagaaggcaaatctcatgttaagtgttcttaccacaataatttttttttacaagacgtaaacatctcttatctggacagtgaaatcatatttgttctccaagattgtgaatatctgattcacctctacatacagccttaatggctaaaccttcagtctccattgcggaaggcagagccacagtaggaaataccactttggcttctgtaccctggctggaacaataattccacacctgttatttgcagcagcccagcagaaattaaaccaagagttgagttctacccactggccacaggtcctcacacctaacttttcctgcttacattagttcatcttgcctgcaggtgtctcaaatatttttccggtgcatgggactcagaaggtttcattaattccctataccataaatgttagtaataggagctaattattaaaaccttgattttactgacaagatagctaaatcacaggaaaagagatgaacctttgggtgttaatcctcaaacacggtctgtctacacagcttaataagtggactaagtaaatgacccaggtctaaggacacgcctctgattgctcacttctgttccagctctaacattctaagttcaataaacactgctaagactgattttttgtcttcttctttttttttttttttttttttgagatggagttttgctcttgggcagtggcacaatcttggctcactacaacctccacctcccaggttcaagtgattctcctgcctcagcctcccaagtagctgggattataggcatgtgccactacacccggctaattctgtatttttagtacagacggggattttccatgttggtcaggctggtcttgaactcctgatgtcaggtgatccacccacctcggcctcccaaagtgctgggattacaggcatgaaccaccgcacccggcctgtttttgtctttttacaaatatcactgtgaaaatgccactggagtttcacagggggctttggagcttcaatagagggcaaggctggtgtcttttacatcttacccacataacacagtccttttctacagcctaaacagttttctcaaagggcctcagaaacactgatatggatagattatccatatgaaagaagagcgagagaggaaatgtctttctatcttggtcttatctaaagatggttctctgcaggaaggggaatcagggtttttcaaaaggtccagtgggtctctttccccatggttgaagatgagggtacccgagagccagtagatgatgtcaaatggtctgtccccatctgcagttctgggacacctctttagaacacttgggtgtgaccaaaggaaatatgtgttatatactacgtgttcaaagtttaaacaaggtgcttccccatttggttcaaatagatatgtgggttatacacttagatcctcttttatgccatctattctaaaggaaggttaaaagcatataaatatagccctaatttgccaccttgagaaagacattgaaatccaaagaaaataaaaatagctaccatttacattctatggaaatactacataccgtgccagtacttaaaatattagttctgactctaactgcaaccttaaaaaaaaagcatcattttctgcattttgctaaagtcgaaacattggttcagagagacttgaccaagaccatacagctgagaagtgagaaggtcaggatttgaatccataattgactcattccaaaggtcttcccatcattctgaactgcttccaaataaattgtaccaaaatctttctgtaattctagcatttcagcttatattttaccaaagtcaccctttctaaaacgtcttggccaactccaaatagtccccttatagcatcatcatacctaccacggcataggacccaatacaggtagaactttcacctcacaattcaagtagaaatactgcccaggggccaaattgtaaagctctgtattgaggtggctgccttccaaccaattagactaaaagtacctgacaatgcttccaaggaggtcttaactaaagagatcaatctttttaacagataatcgggataatttctaagcaatcaagcacctgctcattatccgctgttctgagcggagagtatttctccaccgtgcctgaatcatctctgaacctttcataaaatgctctccacttccacagtatgcagcctcagacagtaggtgcaaaattcaatttttacaagtgaaagtatattcttaagttgaactgtatgagattgctgatatttgacaaattttgtttcacaaaaaaatggcaatttcaaacggttcaaagtaaaccttaggacagaggtttagctgcaggaataaaagccaaaaaaaaaaaaaatagcagcttctgtagatatagaagtctcctgcttcctcatgcaactgtgctagtgtaaggaacccaggatgccacagcagttccatagtacagaggacccatgctcctccatgctcatattcctgctgtactcaacatgtgacatggcaggagtccaccccatagtctaaaggtcacagccccacctcccaccatgacatccacatccaaagaccgggaaagggaaaggcagcagtggaacacaaacctctccccttaggatcaagacctagaagttttctatgcaccttctgcacatctcccactgatgagagcttagccacatgacacatctagccacaaatgatgctgtgaaatgctatcatttatcatatatgggtagttatatcccagcaaaagttggaattttattactaaatgaaaagggaggaattgatactgggggcaacctgcaatctctgacatatagtaaggaaaagaattgcaattggcaaacaatcctgcagtttccatgatggatcatgtaaaattgactgaactggaaagctctggaaaagcacctggaaagatgaaaattgagctattgaagtaagcttaaattaagtggaaatcagaattcttggcatatggaagttgctaagaagcagatatagaacacgcatgagttctctgatggcctgggaaacatctgccctttggagaaatcggccctttgccaattggtagagcacatgcatccaggctttgctctcatctttctcagtctgtaaggtcatatttggaggcacatctttatttctggtgttcaacttaagatgagctgtaaaggttttgtaagatgttcatcttgtaagaaatgaaattaactcagatactcaagcattctttatgatttttccaaaccatctttcgaggcactaaggccccgaggtagaagtgcctctttcccagatcccacaagaccttaggcatcagatttattaaagcagtttaagttgctgggatataactactgtgcaaccaaaaagagctgattatcacatcagtttgccccactttaggaaagtccagtatattaaagaaaaccctctccaaagttaaaaagaaggtaactggaaggtcccagcgatataagtataatgacacgtaaagcaatgaatgaaatgtaaaggcataaaaccttttcaggtgccagaccacttggaattactcccctacactacatgacacctgacattctctcaactcaatattgcagaataacttcaccagaactgatgaaaagaacattgcactgcaaagtcaaatgagacttccgagatcaattccatacttaactagctaagtagtctcaagcaaattgcctaaccattcatctctgtgcttcagtctgttcatctgtaagatagggataataatagcacctacttcataggttcactacgagggtgaaatgagttaatatatgggactgctcatcacagagcctagcaggggaaacacccaattctttattctaactggacttggcacaagaattaagataccttgagtgcaaattttccattacccttcattaagtctaaaaagggagataaaacctggaagccccagctcatagagccctctttcccaaagtggaatgaacgtgcccccttcatccatggtgcctggcaagctctgccacaggaggatataacagaaggaagaagaaagccttcccctctgcaaaaaagagtaacaaaagtggaagaaaatataccccaattttctcctctcctccctgagaagtgaggataatgtcagggtcagaggggagctacagtccttatgccccactgaacactctggaaagatcacttcttgggctgcccctctcaccagcctagggcacagttacatcctgtagctgcacagtgtagccaggctaaggagacctgaagttgagattaccccagctgcccttaatactcatgtagtgaagacacagcaggttagctactgtagcagtggccacgtggttctgtagcaagggctggggatcagagcccaatgtcagtgcagccagatggcagagcaatgaaggtgagcctgagccagtgggtgcatgccatgccactggcctctgctagagccaaagatggagatcgtgagttaatgaaccacatatacatgcagggaataccactcatgtgagcataggacactgctcccagaggacaggaggcagaatatagcacaccaaagaacctctgacaccacgagattagctgtatcacaatccttcccccaatcatctacacagacaccatgtgtacatctcctctgcacaagcaagtcgtagtctgagtttaaaatggtgaccactcccccacctgattcaaacacaaaatgtggacagttcatgagagaaacgtccctacgattatgtgtgaaatatataaagataaaatcaattatcactaaacaaatatgagtcccatggggatgcaggagtgaaaaaaatacaactcagcgaaatcaaacttagaacatgaaaatataggctttctaaattctcacaactgtggacaggactataaatttgatgcaactttggaaaactgtttggtaccatctctaaaagctaaagagggcctaccctaatgaatcattcattccactctcaggtattaacccaagataaataagtggttttttctaccaatagacatgtataagatgtgttcagctgccttattcaccatagcctaatactggaaacagacaaaatgcctaacaggtgaagaatgggtaaataaattgtgggatattgtacactataatataatttatcaataaaaaaagaaggaactgctcctacagatggcaatacggatgaatctcaatacatgatgaggagcaaaagaagtaaaattcataagagtatatactatatgattccatttatacaaggttcaagaacaactgaaattaatctatggggttagaatcagaatagtggctacctggtagtaggaagtgagcagaggagaggaggtattagctgggaagaggcatggaggagctaatggattctggaattaccctgtgacttcatctgagtagcagtaacacaggatagatatagataagatatagatacagatagaagtagatataaatatagataatgtagatgtagatatagattttgatttagtattttacataaaatttttacatatataaaaatgtatgaagctgtacggctaagatttttgctacttactacatgtatttcatacctcattataaaagcttcaaaacaacatacatgcacagtcttttccacttcaatttaaggaagcaaggtgtgagaggaatgtgtgttaccccaagggggctgatctacacccaaactctacagggcatcatctaatgtacgttggaaataaatgtagacttcccctggtcacctctgatagagggttcctctcatttacctgggccacctctaaacagagatctctagatgccatgaaatggacaactagaaaaagtcataggctgtggtgactcaaaaactgaattaccttaagaaattttgttatcccttaaataacagatcaaaataattattttagagatgtgtgacaaggaacctggagtggcagaaggcgtgcaccacgcatttatgttgaaactatcacaatacttgggccaaatcctgagggacctagaaaatctgagtcttcaagggcaaggaccataaccaaaccaagaataaaccatgctgggtgcccaggtgccagcagctctgtcatccactgatgacttaattctccttcctgctcttcaagttttgcagaaatatttaagccaagagtcccttaatactttagactcattgttggtgtttatgctttttaagtcacagatctttttgaaaacctgataaaagttacaggcacccagaaaaaagttataagatgttgcatatatcttgaggtatcataagtaatacttagtagctcctaactatggaatggaaaaaaaaactggaattgtaaaactactaaggggagtatgaaacatttcctcaataatccaaaccagttagcagacagtaagtgtaactttatttatactatggctaaaaactaattagttccttatattactttactttatgtttagctggagttatgcttaataaatgtgttagtaacactggacatctcgtactatgatcttgctttattttttaatgagcaaatgagttaataattgtttattaaacagagtccatttcataagaaaaatatatttttgaaatatgcagtaacaacataggttaatgcaaaagacagtataaatgcattattgcttataactcattatgattctatctgatttaaaagagttgcataggccaggcgcggtggctcacacctataatcccagcactttgggaggccgaggcgggcagatcatgaggtcaggagatcaagaccatcctggctaacatggtgaaaccccatctctacaaaaaaaaaaaaaaattagccacgcgtggtggcatgcacctgtagtcccagctactcgggaggctgaggcaggagaatggcatgaaaccgggaggcagagcttacagtgagccgagatcatgccactgcactctagcctgggtgacagagtgagactctgtctcaaaaaaaaagagttgcataaagcaattactataaatcttgttgacgaacataaaatatataaacatgtaaggtgtttgacaatcacaatacaacaaaagagagaaaatggagctacacaggagaaaaatgttatatactattgaaattgagatagtattaatctgacctctattgtgacaaatgtagatgttaactgtaatcccagggcaaccactaagaaaataactcaaaaactatttgtaaaagaaacaacaagggaattaaaagaccacacaagaaaatatctatttaacaccaaaagcaggcatgaaaaataaagcaacaaagagaaataagatatacatgacaaacataaatcctgtcttttcagttaattatgtaaaatgtaaatagacttaatactccaattaaaaggcagagattggcaaaattgatccaaaaaatctaacaaaatactgtctatgagagacaacatttagattcaaagacacaaataagttgaaagtataaggatgaaaaagatatctcatgctgccaggcatgatggcaagtgcctgtagtcccagctactcaggaggctgaggcaggaggattgcttgagtccaggaattcgaggctgcagtgagttatgatcgtgcctgtactccagcctgagtgacagagcaagaccctgtctcttaaataaaaaaaaagatacatcatgcaaatattatagtaaccaaaagaaaactggaatggctataaccgtatcagataaaaatggactttaagacaaaagttactactagagacaaagaaggacatttaataatgacaaaaggtcaatctatgaagtagacgtaacaaatgtaactatgcacctaataaaagagcactaaaatacatgaaggataaactgacagagcggaagaaagaaatagacaattcaacaacaatactgaagactccaataccttagtttcaataatggatagaacatctagatagaagatcaacaagaaaacaaaccaactcatcctaacacacatctatagaacactctacccaacaacagcaaaaaacagttattctcaagcgtacatggaagattctccaggataggccatatgctagactataaaatgagcctcaacaaattttaaaagattaaagtcacataaaatattttctccacctacaatggattcactgtctatgcttaacaggaacaactatgggccaatatacatccccaggagagccctacaaggacttaggtctcaacctatagtttaggaatgccagtggtccccatggtcacaagcattttgtaaagggatggaaacagaactctggataccattttcctagagactctcagagaaaatattgtgttataaaatctgtaggttaaaaaagtaggatgtcttacacaaatgtctcatatattaaagaattacagagtaattacagagaaaggtattagactgttcttcaacatcctaggagtgctgccattaagttgggagatcctcccaaggtttggaccatctacgctatttaaaggtttgtaaccattatcagatagaggaaaagattgtctgctatgaaagattctcttccctaatttaggattccttccaagctgcaaatcacctgaagctgattattcctaagtccaagaccactgcctgcaaaataatcaagtcaatacccataattaagtcaagttgccagccttaattatatttctctctcgctcgttcactctctctctccttccctccttccctctctgccccacccccgtgtacattatataccaattcattggagatatatatatgtgtgtgtgtgtgtgtgtgtgtgtgtctgtgtgtgtgtgttaaagaagcaggatgtcttacacagatgtttcatatattgaggaattacagagtaattacagggaaaggtattacactgttcttcaacaccctaggcagtgctgccataagttgggagatcctcccaaggtttggaccatctatgcatctatgctatatatatacatacatacacacacacacacacacacacacacacacacacacacacacgtgcaattgattaaatgttgattaaatgttaggcatccaaatgcaattaagacttttaaagacaaaagcatctttatagatgggtgacacttaagaatttgataagggctttcttttttttggatttctgatggtttaaaataagagacccttctctcaacaaatccatgaaagcatactgggttggagtttactgctgttgtaaaaaaggattttggatgacagatagttcagagggcaagtcagctctgaaccagtgtcctggctctgtgtcaagggggcaactatgccccagaaggacccttcaacaggtaagggtaaaaatctgatcacacaaacgagggactgctaccacagcagtggacccaattagggtccactttgcctagttaaatatccaaatgagagaagagatcatttataaggccagtgtctgcagtcaattctctattctacagttcttatttatgctcaaggagtaaggacaaagtgtcagaggtatagaatgcttcctgactcctgtaatcagcacacccttactcctcttgtctgatggctacaattcattcttaggatcttagcttgaaatctacctactttaagtaactgtgttcaaatcctctgactctagattagttccctagttacaaactgaactgtatttttatcatacataagttaaaattactatttttaactaataactatgtacttagtagtgtgtgcaaaagtttatctcactatcaactcctgctgctctgtatgctcaaccaggacagctctgtcaactgctatattatgagtctctagaaagtgccttccacatattagattctcaataaatggctctaaataaatgaattctaccaaattgacttgacaatagaatagataactaataaagcatatgaatttaacatcctttactcaacaacttttaggtgccttgataaaagtgcatttatgcatgggtctatgcatattttattaaatcattataggcacgtaaagatagggaaaaatcatatatatatttattaatttgttaaattattatatattcaagctcttcccatttatgaactcagctttcaactaaataactgcatgagagtaagatgtaaatgaccaaaatggtggttttctcgtttttgtacatctgttctaagtaggttcagggtgatcaaaattgatatatgattatcacatagcaaatatttcaaaactaagatcttatccatggctttatacgacatcattcctcaaaagagatttggtcaatttgtgttcaggaagtacatctacagccaaatagtacacttaaatttagatctcaaatcaataagaatgatgtttcagcatttccatgtggaaaggtggcccatagatgcagtctcagaaaatcgtgattattatcacttcaattttgcatgatgctgtatagatggtcttactatattctttcatgggtaaattccttaaactctgtggtgacagcatttccattatgtaaatgttagccatttactgagaatgtaggaaaaattatatctgcaacacaaggaatctttacatcttttgtcccttttacaggagcccactgggccacttattttctcagaagttctatgcaggtggcccctagtgtaaatggctagaaagtcttttaaaattgtgtttggacagtaaggtggaaatttccagactttaaaatatcagaaaaatgcatcattttaagaaagattctttcccttctctacttattttctcctaaggtacttcacaatatttcctgtttgaaatttagtcatatatatgaatgtatgtaatatatgtaactatatatttgtatgtatgaatacatacacacacacacacacacacacacgcacaaacacatccccttagatgaactgcaatggcccaaaagatagtcaacttacaggaatggataccagaggtcctctagggtagtgtttttcaaattgtgggcttagaataaatttagtatgtcccaaagataattttctcaaaagtggaagagtagagtggaatgaaatagataattctaggcacaatgtgtgaggatattgaatctttcctaactttggaacacgggcactatgagcaaatcttgggggagggggaatttgtatgtgtatatgcacaagtaaatttgagaatggcttgtataatttgggaatggtttgtataatattcatggatattcatttgtaaagagctcacatatgtggagctcagacatactgaagctgagtctaacccaggagagagaggcttccagctcctgcctccaccctaagacccactggtgagggcaccgtactgtgctcttgttccctgcagtgctcatccagggataagaacggtatccgaatgctggactcacattagggaccctttctcacaaggctgtagtaaaaaccattgactcatttaaagaagggaaactcaccatgggttcctgaaattatcacaagagacagggacccctgggaggagtaagagattttcataataattgggtaggaaggagaaatcatttaattcgaatatttaaagaaatgggatctaatttcatacaccaagtaaagggggccatattgtttatacaaatatctcagctatgacaagttgtttggtctattaaaaaagctagttttcaaatgtaaccaaatatgcttgtgttaaaggagaatggtaacttttattaatgttaaaatctgagttcctacagttcttattttctgttgtactcattcctagagaaagaaggatacattagtatatatatgtttgcattaataaaaaaggcagaagaaggaaactctactctgttaagaatgtcccataattattatttttaatttttgaagtttctaatacagccagagaaaataaccctagtggaaaagaaggcataagctttgtaaaatatagatgcaggcaacaaaagagatttcagatgatctgaaaaaagagaaaccccaatatgtctcagagatttggtctctgaagtgtcctcggaagtaaacgtggccatataaactactcttctacagatgggccctgggcctcacagtacaaatctccttgacagaggaggatcttcctttgcccattctttttatacatgcacaccatccacaatatttctccttgagaacaaaaaatgcaggcatcggcaaagcgacaatcgaaaaagaatccaaatgtcacacaaccagacagatggaaggagacaacattgttttcttaccatatcactcaatcaacattgcactgaagcacatgactctgccaatatttgactgtttgactcacaaatatgacaattccacatgattcagcctaatatttatagcattcccaccatgtatagaatccataagggtaattacatttgctgtactattttcacaaaatgacaaagcaaatgacgatgaaacccttatgataatttcacaaaagtcacagaaagaattgtggaaggattctttaagacaatgtgtttgcaggagtgggaggttaacaagcaaggacatggaaaggcaaatcagtacatcgtcactgagtacatacaattcgcaagatatttggtccttgtcctcaagtacctacaatttagtttggaagatgtaatgcatgaaaaaaaaattgcacctaagacaattatataataatcacttgggacagagaaaatgacacaaagaatatcaaactgggcaggtccttagaatttaaatagtctaactcccttattattattattagtattagtattagtattagtattatttttgagatggagttcgctctgtcgcccaggctgcagtgcagtggcacaatcgcggctcactgcatcctctgccctcccggttcaagcgattcttctgcctcggcctcccgagtatcctgctcactacagtcatggtaaaaaaaaaaaaaaaaatgtttaaaggcagtgcttcactgatttaaatattgtatagaggtcaaagagagttaagaccaaataaatgccactggatttcacaaatagaagaagatgggcaaaaaaataaataaataaaaataataaaaaaataaatcccagagagatcaagtatttaaataaaaaggcatttcgttaaacatggcaggctgactgcatgtgcttatttccatctcattccaaagcccaactaaggcgacagtaaaggaataaaaaattatgaacatacaaggacaagaacaggaaagccagcattagtgaatacaagagttccatacattttacagatgctaaaaaagatgaaagaatggaaacaagtcagcagaatggaggaaactataagaaaaaaaaaagtgtgcctatacaggaacaaccaatgaaaaagcaaccaattatcaccacacagttacacacacaaacacactcagggttaggacctggtcccaccacacaccacacaccatagaaggtaagaatgaagcacaacactgacaacaggggactgtttgaaagcccgggaatataggatacttgagatttcaggtccattcctcaaccccaacactggcaaaagaagacccaggatgacatgtatgcaacaggtctacagaaaaatcagcccagattaccacaaaagggcagaggcatccaaaaaggatatctccaggatgagaaaatgagcaattacattatttgatatattgaacctcgaacaataatattgataaacatttgacatatctgatgaagcaagaagaaacaactttttaaagttcatttaaaaaataagcaaatttttaaaggcaaggcaattattaactccaggaaaaacaaaaagctgcatgaaaaacttaatcctcacataagacttcatgaaaactttaaactgccactcatcaaagggtaccactaagaaagtaaaaaagcaaggcactgtctggaagaaaatataagatgtccacctgataaagaactcatatcctgaatacatagaaaactaaacagcaacagaaaaaagacaagcaacccaaataaaatactggcaagagactttaatgaaacttcacaaaagaagatatcaaaattaccaataagtacatgtaaaggtgctcatcagggaaaagagagtaaagtaatttaaaaggtatgaacataaaaagacaaagaacaagaaaggcaaaagaaatggtaggtaactgggatggaagaaacattctgttacttatctgggtggtagctatgcagatatccatatacatagaaactcatgaagctgaacacttaagatttgtgcactttattcaataaaaattggacttcaatctttaaaatgtaatcttttgcaataacaatttttgttcagtgtataattgggggaagaactagaggagaaataaaaaagttaaatttacatatcttcaccatacattaaaagatagatcaagaaatagctgtataagcatatttttgagaaatctcatggttagcactattgcctctaacaagattgtaggttgaggagaggggaacaggggactgttatttttctttcttttttttaaattttaccttaagttctgggatacatgtgcagaatatgcaggtttgtcacataggtatacatgtgcaatggtggtttgctacacctatgaaccccatcatttaggttttaagccccacttcaaactatactacaaggctacagtaaccaaaacaacatggtactggtaccaaaacagatatatagaccaatggaacagaacagagacctcagaaataacaccacacatctacagccatctgatctttgacaaatctggcaaaaataagcaatggggaaaggagtccctatttactaaatggtgctcggaaaactggctagccatatgcagaaaacagaaactggaccccttccttacaccttatacaaaaattaactcaagatggatcaaagacttaaatgtaaaacctaaaaccataaaaaccttagaagaaaacctaggcaataccactcaggacataggcatgggcaaagactctatgactaaaacaccaaaagcaattgcaacaaaagccagaattgacaaatgggatctaattaaactaaagagcttctgcacagcaaaagaaactatcatcagagtgggagaaaatttttgctatctatccatctgacaaagggctaattatccagaatctaaaaggaacttaagcaaatttacaagaaaaaaacaaccccatcaaaaagtaggcgaaggatatacagtttttcatgataagctttttactaacatattttttaactgcacacataaaaatgttaaacaaatattaaatatgtgattatttatataaacctgggatggagaaggtctttcagggacgcctctgtgaatatcatttattttgccacccagtgtccactccccattctgtactctaagttccctacctcctccactaagagtccatatcgttcaggggaatcttcattcctggctttcgcactggctcatgactcaggcccaattcaaccagtccaacccgtggtcttggcccttgctctcagagatgttttttcttccagagataggcacaaggcccagtttgggccactgagagttataccaaagagttctgtaaaaatgctgaaggaggccgggcgcggtggctcgcacctataatcccagcactttgggaggctgaggcgggcagataacgaggtcaggagattgagaccatcctggcaaacatggcgaaaccccgtctctactaaaaatacaaaaaaaaaaaaaattagccggacgtggtggcaggcacctgtagtcccagctactaggaagatcgagaccatcctggctaacacggtgaaaccccatctctactaaaaatataaaaaattagccaagcgtggtggtgggcacctgtagtcccagctactgggcaggctgaggcaggagaatggcatgaacccaggaggtggagcttgcagtgagccgagatcgcgccattgcactccagcctgggtgacagagcgagactctgtctcaaaaaaaaaaaaaaaaaagctaaaggaaagatatggtctgcatatacttttacatatacatatgtataagaatatgtatataggctactataggtaagatattcatatatcttatgtgaatatatagcttttattcattaaaagctaatctaaatttatatgtacaagaaccatatataaattgttagatattattattattagcaattaaattccttttttccttaagccagtttgggttgagctttctgacacctgcatgtagcaggatcctgactaattcaaccacgcaaaagagaaaccagacaaaaccaaccaatagatgtaagcagatatacataaaacatcaacaaaaacattttctcagtagaaatcaccaaacaatttaaaagtaaatagaaaaggaagaaagaatggttgtaacccttaggcttgataaagtttttgcccttactaataacaagacagaattgctacagaaaacgggcagaaatataaaagcacaattcaagaacaaaaacacgaatgcacaaaagtttgctttttaaaaatcaaacaaatgaaattaatcatgaacaaattttatccaatgacatagctaaacattgttttaaattttattatccagagttggcaagtgtctcatggactgctgatgagaatgtaaattggtacacctttctggaaggcaatctagctataataaaaataggcaaaccttggatgcaataagtcttcttctaggaatttatctaaggagataattaaagaggtgtgcaaacattctccctacaaatttgctcactgacttgtatttccatatagaaacactggaaaaatgaatattcaaaagataaggcattcagtataatccatacattccaatagtgttcaataatttaaaatattgatggaaaatatgtacatgtatagaaggatgttcataattatgaagtgaaataaacaggtcttcaactatacagcaatgagcctgttttggttgtataaatacatacacacatggaaaaagatctactcagatacatatcaaatggtagtaaaatttccgagtagtagaattatgtgcttcgtaatttgctggagtttttttctgcttatatgtacatttcagccttgtggtttttttctgctgactaatacatttcagcctttctccaatgaatcttcactgactttcagtaagaaaaaaacgtatttaaaattcctaaaaagccatgtcacctctaaaagtgatttcagacatgcagttggagcctaaacatatgcaagcttttaggtgaagcacagatgataagaaagtcaagggagtggactctcttttaagaaaatttggttgtaaaaacaagaagcaaagggtctcagggacatatatggtctatagttattgggatgaagagtcttctctggagaagaggaagaggccaaaggtgtagaaagagggaatcacgtggggatatgtctaatggagcctctgacagtaacatactgtgctttcctttctccagcagcctccatttgggctgggctgctttacctggatgccaacatgcccttttctctttgtgccaagcatatcctgatgctacacagactcagaaaggggggcagaactcaccctggggaagagcctatactctcagcctcttagtgtttgaacctctatactaggtgcggcaggcacttttcatcagcacctttccccagtgaagaaaataggacgcttgaaacccccaagagggtctctcacccccgctcccatagaagactgaccaccatccacaactgcagtcataaagtacacttgaccttgatcgtgaaaaagtgagttttgacaattcacaggacttgaatgctccgtaagagattaggttttcttttcatttattttgagcatattaacagctggtgacctagattaagaaataattcaatatgtgaaaaggcagaccatatcactaaattccttcacagatggaaagtggattcagtgaaaagcctcagaccgaagagtcaagtaattacttggaaggcaggaggaggagtacctacaagtgggtaaaatgaagtgtggaaaaaggatgacaaaacctggcccagatcccaagccagcagatccctggctactttctgcacaagtaacccgggcctggaaggcagcaggcagccttgctaattcagctgcggagggagaggcaggaggaggatcactttagttcaggatgagcttgggtagatattaaaagaaatacaatcctcttactgcatggagagtgtgcatgtgtggagggagggactagaggcagccaccaagcctctgggcctggggacaaaagggatcagtgccccctctgctcagcaactcatggtcagccggaactgggaggcagcctgagattgagattgggtctgaagagggaaattcattgccatcctgagcaacatggcaaatctgacttccagtaaaacaggaaaacgctaaacaccccatatcctagggacggaaaatactgccacgtgaaagagaacacagttcaagtgataccaatcatggggctcattagccggtgttgattttcaagtacaatgctcaagctacaatataaaggaaatgtcctttgctcaggacacaaatgaagacctcagggccgtcatatacagcagtcaccagggaagccaggcaagcctggtgcctggtacaactcccctccacctgctttgggctgtgcttgctacggacctgggtttcattcatgcacgtctctggggaaaaaaaataaattactgtgcgcaatttactgagggacttgcaaaacaacagagaacccaatttgtgcaatctggattttttaaaatgcaataaaaggtccttctttgtgcagaaatatgcagaaaggaactattaggttcaggtcatatttatttttgaccttctaaagaaggacactggagtcaaaagggacacaaacatatagaccaaaattaaaagtgtgtatatctagatctctgttttgaactccagaactcaccagacagcactgtgtgatcacgatcctaccctattggtcctgggagatttttggtggcttctctgttaaatcgttcgtgtctgctgcacttaagtagccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccccggcgctgcgtcctcccgacccgctccccgcggcgcccgggtcgcgccttgcggcagtcaccgagctgagggcagggcgtcccagcgtccctggccccggccccgctccgcagcgcgccgcaccccgaggctcgggccccgcacagctgcagccggtgccctccggccaagcccccgcctggcgtccccggccccagccccggccgcccgccgctgaccttttcctgcgcgcggttgagtcgcttctggacgttcttggcgaagatgcccgtcttgatgtcggccatggctgcgggtccggggagctgcgaagagcagagcgcgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcgggactggctgtgacatggggagaaggggcgggggaagaaagagaaagaggccaagaaaaagagagggaaaagccagaagccagattgtctcctcgatgatagaagagtttcgagaggagaaagggaaccaagcctagcagaagtccctgggcccaggggcagctcgggggttcttttaatgcagtttgtatttggggagagtgaggggacctgattctttccagcaaaaaaagaaataggggagacaaaaaagggaagaaccctagggatgtggaagccagctggattggaactgctctgaagtggagctgatggggctggtcccttgctgctcccaaaagtttccagctaacagaggcccctccatacaccctgggtgttgcagaagaaggtatggaggtcgccctaccctcaggaggctcacagcccagtgaggggccctggctgggaaaccaacgaagtcagagctgcaggagagaggcgtgtggagagcaaagcggggagagaccatcgctgacacttgtttaaactttaaaacaagagttagcagggcggggaggtccgcgttgagaaaggtcagcttccggaagacaggcgatgtgttttggtcatctccaaaattcctgtgctgggcagaaaccttagaatagactactcttcaagaaatggtgcatggaacagtcaagtcccttatagcttcgcatcaaccatggaagacccagtcccccctaacttgttgcttccttggaaaccttttggcaaccttaacagggactcaccatccctattattcttattaatgcttgggagaagtacgaataatagggataaacctgccctacacctagagctcttgttggctctgaccagtggtcaaactattcatattccattctcactgagagtgtgaggagaagaagtcaggtggtgccctgcaaacagaggtcagaagtggtcactcacagtgaatcctatgagtccaggtgagcatcctactgtacctctgggggaaactgttacattggtagacctcagcgagctgccacctggtgttcactcttgtgtcaccctgtagtcccctcaccttgattctagaatgatgctatggccagctttaatcaataagatgtggtgaaagtgacgccatggtaattccagtcccccccccacccacccaacctagaaaccaggcaagttttgccctctggggattcctgtgacaccatataggaaattcagctaattcagctaccctgctgcaaaaataaaataaaataaaataacaaggagaggccatacagaaagggagaggccctgagattacgcagagagagagagagagagagagagcagccaagatgtcccagctgagcccattctccaatcagttcactggctggctgcagccacacaagcaaccatcagcaagaccagcagaagaaccactcagctaatcccagccagagtgcagaatgtgagcaaacaaaacagtttttatgagtcgatcacttttataatgctttattataaaacagtaggtacctggaacacctggtctatgtgcttggctcttatttccctaggataaatatctgccccagtttccttaggaattaaggaatttccaggacacaggactcttagtgctaacagtgggaaagttctgagcaaatttggatgagtcctacttataacactccaagtaaacagaggtttatttcagagagataaaaaaaaatccaccacttggtcaacattcaatgaaaaaggctatgctcagaaaccaggaatttgagtcacctccctcaaacaggggcctttggggctgtaatggttatactgagtgtcaacttgattgaattgaaggatacaaagtattgatcctgggtatgtctatgagggtgttgccgaaggagattaacatttgagtcagtgggcttagaaaggcagacccacccttaatctgggtgggcaccatctaatcagctgccagcgtgcctagaatataagcaggcagaaaaatgtgaaaagagagactggcctggcctcccagcctacatttttctcccgtgctagatgcttcctgccctcgaacatcagacttgaatttcttgttttggagttttggaactcggactggctctccttgcttctcagcctgcagacagcctatcgtgggaccttgtaatcgtgtgagttaatacttaaaaacacacatatatatatgtgttccatcagttctgtccttctagagaaccctgactgatacagggttcagaatctcagctctaccttgggatcttgactatgaggatacaagtctcagaatgctggaatacaccagaagtgttctagagaatatcaatccatagtcactcttgcactgtgagccccagagccacctacactggttttagatacagctccctctgcagacatcactgccctccctctgtcaggcaagggacaggagttccgagtaccagatttacttttttctgcttccttagagctcaagccctcagtcaccaaagtaccagcttttgtctgtcccgtaattattcccaccccacccaaccacatttttggaactcaataaatatattttaaaataaaattgcaaattattaatttttcttattattcagatgcccaaatctagttctgtaacataggtggaaaagggaggcttgtcatttcttaataattctatttggaatacatgctgagcatattaaaaagttgttacatgcaaactgttatcaaaacatttcactccaacagaaaggtaaatcggtgtccactttcaggttgccaggtggctcattctagccattctggaatattgactaagcactttagctggtatttagtagctgttctgtaaatatttgttggaaaatgcatgtatgcatgagaatagctcatgagcatccatcatgcaagatacgatgatgcctggcatgctagagtggggacgtacccactccttaagaaccctgagctaggattcatgaattcttccccaatgtatctttagaaacctaaaactggcatgttggatttgcacagatgctcacagagtggatgaatctagtttgccaaacctgataatgcaggtaaaagagacccctgaaacatgtgccaatgtgtagctttgtagatctttatttatttccattctttaataatgctgctgaaacagaggttgtgggggagtgaaggtcccaactacaatgactttaaacattgttattccatacagcagagtttttcttcacacaaaatgttatgtaaaacccaaatatattaatcagatgggcctctctggttgcagaaagtgttgggttcccagagccccacccattaggccactgtttactccccacactctctaagggccctctgcagaactgcaacactacgctgccaaaggaggggggtctacaggacaagatgatctcagcaggatcattcaactccaaagtggtagggccatgctttcatgcatacttccttcattctccaaccataggacatgtccacaatttcttgatggcttgtacctcttcctagtattggctatccatttttctcccccttcagtcaaggaaaaatacaatccatccaatccctatagatttactgttaatgaaaagtaaccacaattctttctaatttctgggacatgcttagacatcaaattatattcaatctttatttaggtaggcttcacaaaaagtatcacaacaccaactccagattttcatccatacaaggcagaattcctgagtcaattttcacttctgattcaccttccttccaagttgcacttcaaattggctgataagtcaaaatgtgcaaaatgtgaattatgacagatattgataatggatggaatagccccaaaattaccactgtattatcacagaactcattttccacatgttttaatggcacagaagtttatctctcttatctttatatcttggcagtccaatttagagccttagagaattctaggactttgctaacactcataagaattataatataacaccatatataatgtgatttatatgctaaaacatattccaattagctacaagttttttctaattattggtttctttgtgtcattgtgtagataattgaagagacattccatttaaatatttgcaggacctaattgaaattgggttctcaatcaaattatgactacttgctatacttagctttttgttcaaagaatcaaataacttttattttctctcacaaatgtcacttgaaaatggtagtgtaagtaggatgtttttcaaaaatatatattgactgagtatcttctgcatttcaggtgaaaaccatcaaaaatagactcagtcatgcttcaaattaggccaagtgtatacattttagctccacatatatttttactaaattgtgcctgcatgaatactctctttctttcccaattttaccaaataggtttgtttgtctaaaaataacaacttcctaatacattaataatgcatcactaatgtatcctgaaatgctaaataggaagcaagagctttgttttacacagagtcattggccactaaagaaaacaatgacactgtcttaaattgcctaataacttaaacatatttgaataccatctttgatgcttttatgcaaagtagatgcaaaacgactcctataccccaaacaaattgcttgtgcatcacttaatagcttacaagccaattgagaggtcagggagcaaaataaaacagaaattctaattagccacaactctttctgaagaaagagacaagttcctgcaaatatttgatgctattttccatccacaaataagctataaaaattccatgtacaatgcgagaatcagcacatttgtgctactgagagcacctttgtaattgcttttatagctccagcttggacaaaccccagctttgtaacagtgagctacttcaaaaccttttaacaaatgcttaactttatcatatattggcagagacttctttggttcagggaacctatttttagttaacttgatccacatttatatttttgtatgaatatggctttctagatgtgcccacctttgcatggcagctcctgtgccctcacccggctgttttctgcctcccgccctccttgaacacaaggactctcccaaagctgctcctggagctgtggccaccagcacagtagagggattaccttgcaccatgggatcccccactacaatgtgccaccactcagagcccttacttcagcaaaagcccctgggtaatggtgaagccaactcactgctcaccctcatcgggattatgggtatgactccatatgcaggaagcctggattaattatggtgctctcccttgtggtaaacagatcccaacttgcttgcagtagagcctcttccctctccagaggccacacaaccttctggctggtcttacattgacactttcctcactttctttacttcttttctctaaaggccccgaacacgctgctgctgggagccgcctccagggagatcagggagttaggtagtgacggagggaggagttcctatttctgttactttcagtgtaactgctacagttcagcattaaagctcaggcctaaagagtcttcagtgggctaatctaggaggaaatctgttgtggatggaatcgcgtcccttaaaaagatatgttgaggtcctaaccccaggtacccgtgaatatgaccttatttggaaacacggtctttacagatacaagacgtaagttaagaggaagccatactggagtagggtagtcccttaatccaatatgattgatgtccttaggagagaagaaatatggatacagacacacagagcagagaacaccatgtgtagacagacatagcaggaaggaggccatgggatgacagaagcagagattggcgttataaagttgctcgccaaggaacactgtggattgccgtcagccataggagcgaggagaaagggcatggcggtgctgactccttgatcttggacttctggcctccagagctgtgaatgaataaatttctgttgtttcaagccaaccattttgttacagcaggcctgtattagagaactaatatggaatccaacctgtttcttctcaaaatagggcatctcggaaaattcatcccccaatccaaatgactgacacagatctccaaaaacaagatcttcattagttggaacagcctgtgttcatctgttgctctcttttgaaacaatgtattttttaagtgtattatttgtccatattttccctcttaatttagtggaaaaatcagtagctttccaataagcctgtttccagttggattcttgggaagcagaggctgagatggagtttgggtacacattgattacagatcaacgagcctgtgacaggaagcgggggaagcaggactggcagaggaagaagtccagtccagcaagggctccatcctgagcattgccaagagtgtccccatctggctgatgtggctgagcctttacaccctgcccaccaatcaccccaatacatgtggcccaaggagaagcgtgagcacagctgctggagccaacccggaaggcgcaggcaggtggaggtggaggctgctgctggctgttgaagtggcatcagggcagcgggctagtccccttctctctgtggttccagtgtagagctctgagcccatagtagacatgtgttcctcagttctcctccccaaaatagcatcttctgtttcttcaccctcccatattttcatgccttgtacctacactgaggtgtttctgaagatatcttaatactgactcagccatactctcaaagcccagacttttacatttgaatatgggccatttgcctctaactgatgaagttaattatagacacctgtattgtcaagcttctccactctacagctacctgcttcccaattataaaaaataagaaagaaactcgtaaggagatactttgagactatgccaatatcttgtctcttgtcacactctccctctcccacttgagcatgcatcatgattcttgcctaaatctcttttcactatgatggcttataatcggcgattttctaaatccatcattgctactgtatcgattagtcagcattctactgtatgaagagcattccccttcttgtcattcatttattaacttattatttattatctggactcacagattcttattttattgttgtctattatttatttaccttgatattccaattatcccagatttggccagtgaaatccccttaaattttttttatatatcttcatcatttttgaatactttcttattttcttctggtacaatgagatgttccaggtacatcttgtattttctctgccccagcccttgaataagcactctttcatggacccctggttcctttgagtagtgaatggtatttagaaaccaagatctggtctctcagtttgcttattgctgcagtgtgtcattgtttctaggtttttcagtggacaacatatatatatacaaatgtgtgtatgtgtaagtgtgtgtaaaatatgtttatactgatgcctctactttgaatttgtccaaggttgttgtttaccttcccccattatgtatttatttctatctcccatcttctgtgttgctctggccccaacaacctcactatattcactcattcgctcagttctacaatacccacaaaatagtttcagaatattcataccactacaacaaacaagcctgttaatagttcaagatttgattacaggtatttcttcagaccaaagccaaagtactgtgctctaaacttatttggaatattggcataaaatcagacataaaccaatggaatagaataaagaccccagaaataaacctttatatatatggtcaattgattttccacaaaagtgccaagatcattcaatggggaaaggacaatcttttcaacaaacagtgttgctaaaatgatatatccacaagcaaataaatgaagttgggcacttatgttattccatattcaaaaattaactcaaaatagatcagagtcctaaacataagaccaaaaactataaaagtcttaggagaaaatgtacgggaagagcctcatgacattggatttggcaattattccttggatatgacactaaaagcacagacaaaagaaaaaatagataaattgtactacatcaaatttaaatacttttgtgcaccaaaggacactatcaacagaatgaaaatgcaaaccatgtaatcagaaaaaatatttgcttatcatatatctgataaaggattaatgtccagaatatttttcaaaaaaacccttacaattcagcaacaaaaaaaccaacaacccatttaaaaaatggacaaaggacttgaatagacatttctccaaggaagatatgcaaatggccaataagcacatgtaaagatgctcaacatcactaatctttaggaaaatacagaccaaaacctcagtgagatatctcctcacatccattaggatggctactattaaaaaaaaataacaaaagaaatatagcaagcattgatgaagatatggagaaagtagaatccttgttcactgttggtgggactataacatggtgcagctgctatagaaaacagtatggcagttcctcaaaatattaaaaatagaattaccatatgatccagtagtttcacttctgagtatatacccaaaagaatttacagtagggtctcaaagtgatatttgtacacccattttcatagcagcattattcacaatacccaaaggtggaagcaactctagtgtccataaactaatgaatggataaacaaaatgcataatatacatgcaatgtatttgtgtcccctttacaaaggaatgacattcaggtacatgctacaatatggatgaaccttgaagatattgtgctaagtgaaataagcttctcataaaaggacagatgctgtatgattccacccatctaaggtgcctagaatagtcaaattcacagagatagaaagtagaatggtggttgccaggtgctggaagcaatgaggagttgttgtttaatgggtgtagagtttcagttttgcaagatgaaaagtatttcagacatggatagttgtgatggcctcagaacaatgtggatgtacttagtgccacagcactgtacacttaaaaatggttaaaatagatgagccaggcatggtggtgcacacctgtagccccagcttctcaggaggattgcttgagtccaggagtttgagactaccctggatgacatagtgagtccctgtctcttaaaaaagaaaaatcttttaatagatacagatttcaaatggttacaatgataagttttatgttatgcatattttaccacaataaaaagaatttttaacttcatcagggaagttcctttactaattgaaagccattaagttcacttgttactgtttgcatttagtttgggttttcccccaccattgaaattttatttcattttattggatatgtaaagcatgcacatacaattaaaagtcaaaattgtatagaaagttatactcggagaaacatcatttcttcccctcccctgcaaccctacccgctcatctccttccctaattagtaaccagtttcattcatttttgtattatcagtcttctgtatctttttacaaaattatacagatatgtgtatattttcttgttttctgttcttttttttttcacaaaagatagcatattgcatatgttctcttttttcatttttaaataaattctggaaacttctccctttcagttcatggagatgtttctcattttttaaacaa

SEQ ID NO: 230 - DNA, 56639 bp, Homo sapiens
aactccaacacttaacattatacttaatggtcaaagaaagaatgtttttctcctaagaaagggaataaagcaaagatatctgctcttactactctaattcaatatcgcactggaagttttagccagtttagtaaagcatttaaaaaaaggcatattgatcggaaaggaagaaataaaactgctcacttttgccgatagcatgatggctatgtggaaaatccaaagaaatctattttaaaccaccaaaatcaacaactcctagaactagtaagtgaattcagcaaggttgcaggatacaacataaatatacaaaaaaatcaagtgtactttgagtgatgaacacttggatataaaaattaaaaatacaataagtaccatttataattgctcaaaaaaggaaatactcatttcaaattctaacaaaacattcataagacttgaatgctaaacattagaaattctgatgaaagaaatcaaagatctaaacaaatatcgagacaaatcatgttcttcaatttggagactcaaaatagcaaagatgttaattcttcccaaactcatatatacaattcctataaaaatttcagcaatatttttttgtagatgaatagaagattattttaaaattgtcatggagatgcaagggaactaaaatagctaaaacatttttgaaaaagaattaccaagttggaagaatcaatctatcccattacaagacttgttgtgtagctattgtaatcaacagcacgtggtattggtagagtgaaagatacacagacaaattaaacagaacagagaactcatacccacataaatataactgacaggttattgacaaaagcataaaagtaatgcagtgtggggaaaggaattttttcaacaaatattgctggagaatttgcatatccataagcaaagttgaatggtgacatgaacctaacactccatacatgaattaattcaaaatagaccatggacttacatgtaaaactacaaatcttttagaaaaatacattaaaacccttcaggacctagggccaggcaaagaatattttaaactttacaacaaaagcatcatcaataaaagtaaaaattgataaaccagatgctatcaaaattaaagaaaaaaattttgttctgtgaatgaccttgctaagagtatgaaaaaacaaactaccaactaggacaaaatgttttgaaagcatacaatagacaaaggattagtatctaaattacataaagaactctcaaaactcaatagtaaaataaacaaacagaaaatgggcaaatgatatgaacacgcatttcaccaaaaagcacagatggatgtcaaataagcacaaggaaggacatttaacatcatttgctattatgaaaataaaaattaaaattatgatgagctattactatacacatatgacaatggttaaataaaaaatagtgacaactccaaatgctagtgaggatgaagggaaattcttccccttatttactgttaatgggaatgtaaaatggtacagccactctggcaaaaagtttggcaattaaaaaaaatgacactggcagtgccatacaactcagcaactgcatccttgggcatttgtcccagagaaatgaagacttgggtttacacaaaaacctgcacataaatgtttagagcaagtttattcgtagtggccccaactggaaacaacctacatgtccttcagttcgtgaatgattaaacagtctgtggtacatccatagcacagaatactcttcagcaataaaaaggaatacactattgatatgcacaacatcctggatgaatcttcagagaattacagagtgaaaaaagccaatgctgaaaggctacagaatgcataattctgttgatataacattcttgacatgacaaaactatagaaatggagaatagattcagtggttgtcagagatgaaggagggactgggggcaggagggaggtgggtgtagctagaaaaggaaaacttgagggggcttttgcagtgaaggtaatgcgtcttgactgcatcaatgctaatatcctggttgtgatattgcaatatagctttgcaagatattattgttgggagaaactgagtaaatggaatgcagatctgtgtaaataatatcttaaaattatttgtgaatctacaagtatctcaaaattaaaatttaacaatacatatgttctacctctatccactgaatattccaggaaacaaaaatctagaagcaacaagcactcctgttgtctacattgtggactctaaatgtcacttccacctaaaaggaactagggatccttagagaaatggcttgttccctacctggtgcaggaaatgtaccagatgagcctggagcatcttgttataacagatgccaaggagccatcagggactactgggcacacgtgtaaagggtccagacgccaacatgaagaggctctcattggccaaatatgggataatttgagctataaaataataactggaatgttttgaaacatatcaaatatttgaaaaactcaagactttataataatattaagaatgctcattaagcaggatgtggtggctcgcacctgtaatcccagcactttgggaggccaaggctggaggattgcttgaggccaggagtttgagaccagactgggcaacatggtgagactttgactctagaaaaaataaaaaagtcagctgggcatggtggcacatgcctgtaataccagctacttggctgaggtgggaggataatttgagcccaaaacttcgaggctgcagtaagcggtaattgtgccactgcactccagcctgggcgacagagccagaccctgtctgtctaaaaaaaaaagccccatttgtttcctttggtggatgctagggaaccaactgattgctatgacaattggtaaatgaaggaaaagaatcaagcagtgatcctacatttcctgcacaaacaatactgaagactccagtgatgaggggaggctgctgcacatagagtcacctctgccctgacctccacgctttggctgttcaatctattctcagcgcttcaggagatgttcctgttagacaaaagtcagatcgtgtgactcctccactcaaatctgccaatggcatcccggttcactcataacatggacccaagcccttacatgagcaaaagggtcaacaccatctgtccccactgcctcctaacgcgggcccctccctcactctcattagccatcctggcctattgctctttctcacactcagcacatgcgggccccagggcctgtgcacttgcagagcctttcccagattcccctgtggctgtgccttcctcacttacccagcgcttggctcaagggtatccttattagagaggattcctgttttgtgtatccacttgtggtcccaaacctcacatggttccatctgattctacagatcgcatgcttctccactaagctggactgtgtcagggactaagtggagggcaaaaagaagaaaaagacatagtccctgccctgcacgatcttcaatttatagcagaaagccaggaacacacacacacacacacacacacacacacacacacacacagcctgctcaaagtgagtctgccctggaacgtgggaagctggcctagctctgcacaagaagggaaccctgtataaactgacttagcagagaaggtcatcccagaggaaatgaaccctgtgcgctgagctctgaagagcaggagggctggggtggtacaggggatggtggtgtttgtgggactgaaagtaagattatctggaattatctgggtgggtccaatctaatcccagaagcccttaaaagcaaagaacttagcctggaaggagaagacagttgcatgcatgtactacagtttggttatttacttcccagtagatggacatttgggttgcttctagtttggggctgctgtaaacacttttgcgcaaggctttttgtggacatgtgtttgcatttctgtagatgctgtggtgaaaaggaagaggtatgtataaatgttttaagaaacttgcaaacagtcttccaaaatggttgtatcattttacaccatacagtaatgtatgagaggtgctgttgcattagcaatgattagcctttttcattttagcaattctggtaggtctgtattcgtgtcagggggcaattttgatctgcacttccttgatgattaatgacgctgggcatcttttaatgtgctgatctgccatatatcttattttgtaaattgtcagttcaaagcttttgtgcattttaaaatttggatgttagtctttttattattgaattgtagcaacttttagaaaatatattcttaacataagtcccttgacagatacatatgaatattttctgtcagtctgagatttgcctgtttcttaagaatgtcttttgatggtcagaagatttaaattttaatgaactcaaatttttcaaaacaatgtggccagtgctttctgtcaattccttaacaaatttatgtccacccccaaagtcataaagatattctcctagtttttcttctaaaagctttctagttttactttatttatgagtaggcctgtgatcccttttggaataatttttatatagggtgtgaagtaagagttgaggtttgtttccccctcatatggatatctacttgtttccacatcattttttgaaaaaaattgttttcttttcgtattgaattgcttttgggtttttgttgaaaaaatcatttgaccatatatacatgcgtttattcctggaatcttttttattgatttattgtgttgtcttcaccactacattataatcttgaagactgtgagtttattctaaatcttgaagtcaggtagtttaagtcctctaaatttcttcattttcaaaattctttgggctattctaggttgcttttccatatatatcttatatattctagattgaatttccatatatatttttaaatcagcttgttagtttctatttttaacaaccaactagaatttggaatggtattccattgcatctatagatatatttggaaagaagtcatctgttaacagtagttttgtttttctcagcaaagttttagttttcattagttttcttacacacttttgttaaatgtatccctatgattttggatgctattataaaaggtatttaaaatgtttaatcttcaaatcctacataattatgcatgaatgtactatgggtaactttgggtttaaccaacatggattcacagaactttttggatttgtatatttacatctttcctccaatttgtgaggtttttggccactacatcttcaaataatttttccgcccttttctctttcttttgtctggggccttctataatgtatatgtgtttggtatatggtgtcccatagtctcttaggctctgtttacttttcctcactcttttcttttgctccttaacttgatagtttcaatggacttatcttcacgtttgctaattccttcttctgccttttcaagtctgcttttgtatccttctagtcaatttttctattaggttactctatttttcagctccagagtttctatttggttctctttacaattccaatctctttgttgatattcttatttgtttatatattgttttcctgatttcctttacttccttgtctgtgttttcctttagccctttaagcatatttaagacagctgctttgaaatcttgatctagtaagtctgagacctgtgttttttcaaagatgagtctggatattcattttcttcctttgaatgggctatgcatgttttcctatttccttacatgccttgtaagtttttgttgaaaactgcaatttggattaaatggccacctctcccaatctttgaagaatggctctgcgcagaggaagacctttgttaatcactctagtgtaaagatttaaggtcttttggacataaaccttccatgggcctatgtgtgtgctatttttccaaataccccacatagacagctgttattaatgtcttaatttccctaggagattcactcctgcctcttctagaggcctcagcattctattgcattttttaatcaaaaacctctttccgctggcatccctggttctgtagcttggtacatttttcacaagccatactcactgcttcttgcagattccactaccctgagatttgagctagtcacttttgccatctgagttctgatttaggccacacaaagaccaactcctcagccacctccaacaggtgagagtgttacgtatctggtcttctctgcattttataagttgaggtttcatggctgctaggtatatttcataacttattttattttattttatttatttatttatttactccactatttactactaaaacttcctaagcctacagatatttccaaggaaggtcttggagaaaattaagtagaggcagtaaaaagctgacatagagatccacatggagattttcaggaagtcatggcattatgacagtaaaataaaagtttctttgtcctcatgcaattcaatcattcttttaacaggcatttactgtgtgcttactctctaaaagtcattggagataaagcagcaacaaagtggaaacaaatcctgccctcatgaaacttacaatctagcgatgaaggagagaaatacacaaataaggatggtatttggcatgccaaatgataatgagagctgcaagagaaatggggcaggaagttggtagggggtggtttgggggtgggtgtcaacactgttcctaatggatgatcactacaagtgatctggggagacatcattgacaaggtgacatttcagcagagattggaacagaagagagaccatcatttgggtatcaggggtagcaattcaaagcagagggaagagcaaatgccaagccctggggcaggtgcatcttcatgtattcaaggagcagcaaggtaaccttttagactgcagcagagtgagtgaaggcccagctctggagttagatcagagagataaccagtggccagctcagcctggacttcatgggtgatgggcatattttggcttctactctgatgagtggaaatatattggggttttgagctgaggagtgacctgggaggttattctggtgctgactggagcacagactgggtgcaaggacaggagaaggaatattgttagtaggcagccacagtcatcctgtcaagaagtgatggtgtcaagaacagatgaaggcaaagaagtggtaagacacaggcatatcctgaaggtagggatagaggctttgctgatgggatggagaagaggcaacaggggaataagtcaagaaataccacaaagctgtattctgaacacctgtcaggatgatgttgctttcacagcaaaggggtactgagggacagtaagtttggagaagtctaaggtttggttctgacacgtcaattgtccacatgaacagttagtttgagaggagttagttttcaggggtcttttaaatatcaaagtagaaataaccagtgctcaggaggatataagggtctgaggctcaagagaaaggtcatagctgcaggtataaatgtgatggctcatcggggagtgagctgtccaagttctgtgcagatttcaaggggtaaattcaatgagcctgtttgtggccacagccttcctcaggcttcccagtatccacattaccacaaaaagcctcagtggtgatctacttgagtctgtccccacatgttggggcttgagttatgcagaatccccatcttgctccctttctccaacatgacaagaagacctcagttagccaaaatgtcctgaagagggctgaggaatttggtctgaatcatcccacaaattcatggtacaggaaataagtgctgcttttgtcgttggctctagaaagatgatatcggccgggtgcagtggctgatgcctgtaatcccagcacttagggaggccgaggcgggcggatcatgaggtcaggagatggagaccatcctagctaatacggtgaaaccccgtctctaccaaaaatacaaaaaattagctgggcatggtagtgggtgcctgtagtcccagctactcgggaggctgaggcaggaggagaatggcatgaacccaggaggcagagcttgcagtgagctgagatggctccattgtactccagcctgggtgacagagcgagactctgtctcaaaaaaaaaaaaaaagaaagaaagaaagaaaggaaggaaggaaggaaggaaggaaggaaggaaagaaagaaagaaagaaagaaagaaagaaagaaagaaagaaagaaagaaagaaagaaagaaagatgatatcaaccaatgttttgccataagactttgctttggattgggattttaactctgggatctggctctaggtctcttgccttcctctttacgaggttaacttgggatggttagccatccaaccaagtcctcatgtttctgagagtcattcccagccatatcatcctattaaccattgaatccattgtctaccactgcccaaggctgggatgcagtttttttttttggttagcttcattgagatataattgacaaaaattatgtctttaaggtgtacaatatattttgatatgtgtatacgttgtgaaatgattaccacaaccaagctaattaacattcccttcaacatacatagcattttttttttttttttgagacggagtctcactctgtcacgcaggctgggagtgcagtggtgcaatcttggctgactgcaacctctgcttcccaggttcatgcgattctcctgcctcagcctcctgagtttttgtggtgagaatatttaagatctactctctcagcatatttcaagtatacattaactagagtctctatgttctacattaggtttccagaaagttactcattttacatgtaaaaatttgtaccccaacatctgtccattttcctcaccctcagactgctggtaaccactcttctgcttttggtttccgtgagttcgactttttcagattccatgtataagtgagatcatttaatatttatctttctgtgtggcttatttatttcacttagcgtgtcttccacgttcatccacattgtcacaaatagtaggatttcctactattgcttgaacccagaaggtggaggttgcagtgagccaagatcgcaccattgcactccagcctgggtgacaaaagtgagacttcatctcaaaaaaaaaaaaaaaaaaacctttgaaaagaagtgaggatttgaggcttggcacagtggctcatgcctgtaatcccagcactttgggaggctgaggtgggtggatcatttgaggtcaggagttcaagactagccaggccaacatggtaaaagtccatctctactaacagtacaaaaattagctgggcatacatctgtagtcccagctactcaggggctgaggcaggagaatagcttgaacccaggaggtggaggttgcaatgagctgagatcacaccactgcattccagcctggggaacagagtgagacattatctcaaaataaaataaataagtaaaataataaaaagaaatgcagatttgggacaatggggacacttagctgatgcacagcgcaggtgagcagtccttcttttgtgaccatgaagacataattcccaggagcccaccttggggtctcctagaaaaagcatgtgggctgctcaccagctgcatatccacctttcctttcctgcactctcaggaagatgggagttctggattcagctgaactgagttcaagttcagactctgtgactcactggctgtgtaattctgggtaagttacttgctctccttgagtcccgtatcctccatggtaaaatggagaagtggagttattgtaaggatttgaaggcaaggcaagagttaaagaaacacacacacacacacacacacacacacacacacacacacacacacacacacacagagagagactggccgcttcaacagcaacacaggtttattactagcaaaaccctgcggagggggaaaccagcttagtgtcagtgcccactgccgctcacaggctggggtaatcatagcgctgggagggagggctctggacagtatagcttgctgctcagtagaagatgataaggatgttcctgaagtcaggctgttgggcctttgcccagcaggatgtgataaggatgtttctgcagtcaggtggttaggacatttctcacagcccgagttcccatggaatgttttactccaaccaggatctgcaaaacagcaaggggtttaccaaatagtgcagcttagactaacagtaacctctcccaggtagacagttctataaagtaaacttcccttgagcacctacactgtaccagacatggtgctaggacccaggccacaggaggaacaggacagatgaggcccctgccatcctggtgctcttgtctgatgaaggaagctaacaggtcgtaagaccaggtcagatggtggtggtaatgaaagacattaccagagtgagatgagctagaaagaaactgagggagctgttccaaacacagtgacagggagagacccctccaagaggtgacctttgagcagcaacctgagagatgttgggtggggggaggcatggaaaaggagctgcccctgaagccatcccaggagtaaagacccagcacgaggtgggcaacagaatggcctgacctgtgcgtccttcatgcttccttcctcagtggtgcccaaacagaaacatggggcaattccacgcagggtccatggagggagcagaaagcagccgcaatgaagagccacggtggggatgaaatctggcccaacagtgaagctagaagcaggtgctgcttaccactcaccaaaacacaggtcatgaagcatacccagcccctgaaggcacgtccagggccagaccagctggctgggctgccagcatcctagtagagatcccagaagatcagataagctggttgaaggtgggggagaaaaggaaagcttcagaaaattccataggacccatgacacttagcatggactttccctgagtgggatctgtttggcattgctggttctaaaaagttggtcccaccacccccacctgcccggtgcccgaccaggggaaaacctgggataaggtccacagaaacaatccctgtggaatgggaaagggtgttctcatccaaaaccaagggaggaatcccacaaaacaccactcataaggagcagaggggcctacagggagaaacaggattctgctgctcgctggggaatctgcttttcagcaggaaaaggaacatgcaggatgcagaagcaaagtggaccctgagctgtggggttaggggagctagctggtgctgacactgtcagggatgagccacaataggaggcttagaaccccttacttagaacacactaactcagagggcacctgagagtaacctgagatggtccctaaagacttttcatccaagcaggatccctcccttgccatctccagacctgcccgacaagctccctccctggtctcctggctgttgttcactccttccaggaagccttccacagtcatctctaaaacgtggctgactgtccctcctttatccagaaccttccatggctccccagagccctccagatcaagttcaagttctttgatcagacacttgatctcaagctgcattctacctcctgaattaagatcccagagatgcccaccttgctcggcacaagtgcatcaatgaagtccaaagtcttgaatgtggccttggccttgaggacgtcaacaccctggctagtgagggtgcagtgccgctccaggatgatggtgtctaaagttgagcaccaggtcgcaggcccgcagaagcatctcccctcaggagtgaggtagtacaggaagtctgtgcacaggcagatctgctggtgccattacactatgagggcatggagctccaagatggtggcaacatagtcactagaattcctacagggtaaggctggggagaggaagtagctgcataacacatatgataccctggaagcacttcccagccagagtctcaggaccacattacatccagatacaggtgccctctgagcacacttctctctctgcctcccactctgagctgcctcctggccccacatgggcagcctggcccaagggttggagcccagcaagtgttcagtccatggtgttgactgctccctgggccaggagagcccttggtgactctctgactcctcctgtggaacctctgactctgccttgggacctcccaattcccatgggaagcccccatggctctggattgccccaccttgccttggatcctccagccccacaggccttacttgatgccttagccctcccagaacatgacatgttcctcagaatgtggctgatgtccagggccatatgtggatgtttgctgggggcttcttgctgttctcctttatggtctgtagggcagggcaaggccaaaaggagaaaccaatccaacctcagaatggacaaaatgctcactgccacaaacggcaaccacttacagtcagcagtgcttctggaaacaaaggtttcattctgcaaaacgctccttgttggcttctttctgaagccagggaaggataccaagcccagcttacctgcagtgcctgcattagcatctgtgcctaggatgtgcgatgggcccctgctcccactgcagggttgacgttccctccagctggagacctgggctcctgacaccaccgggcctgtttgtcctgctctggatgagggtggaaaggctgtatctggcattttcctaggtccttagtttccaccttctagacatccagcaggagtgaccatgcccagccccacacctgaaatgggactcccttgtagagcagctgagacatctacagacagaagagtgctctggtgagacaggccacaggggtccccagggagggttgggggccagaagattctgaaggcttccagtcttgggctctgtggttcctcaaagaggttaggtttaactaaaaccaggcctcccctcccacgattcaaagagtgggtgagtgctctgcgtcaggaactctgatctggacctattttttcatttaggtcaccaagagacaacccctaacccccaagctagggatggtgcaagctctggcatgagattttcttctagcaacgtgatgcttacagggacaggtagaaaagctggtgatcaggcctgctgtcctccgggtaaagacagtgggccacccacgctctgagaggccggtggtgccaggccacaacactgggtgcctgtacccctggctctgcagacaccggtcatggaggccctcccctctccatattaccctcttgctgctcctatatttcttctagttattaaacaatttgggccatttttctgtgcatccgatctgacatttttgctctcagatgaaacatgataaaggaagccaagccgccagtattcctggaggggaccttgggtgctgggtcttgggctccagggccctaatgggactgaaccagaaggagccagggaagggcaaacactggggctgaggccctaggacccaatggccattggtggccgggacttatggccccaacacaccctgtcctcaggccacagacaccatgggcttcggtcaggtcccagcctcccagtagtgtcctggtactagcaggtgctgacccctgagccacaagcacaattctgggttttgggttttggtaaaaccacctcagggacagagttctggggttgggtttggcaggaaccatggtgcctcccagggatggtgtgtcactcctacttgccacaaaatgtgcacacaggctgtcccactgtccagcccatcctgctggacaggatggaggaagtcagggaacaggtagggtggacatctggggtgcagggaggggcaggtgcatgctgggaggtcagaccctgcgagggctgtgggggcatcaggcggagtgggctccaggtgcaccctcaatgcactgggcaggtctcaggccaggctccctggaccccggctgggtgatgtggtcactccctgggggactgctgtcaggccctggccacccaccctgggcagcaccgtcctatctcaggactggaatttctgcagtctgagacaggacagtactgtccaggcctgacagactgggaggacccgttaagtcctccatccctagaccagcctcccacacagcaaggacagtctcttagctctaccttcagggcactgactgatcctgctcactctgaggcaaccaaggcagagctgaggacctgtgccaaggctgggagccagtcccctccctaaatgggcctgagggaagcaccatccctgtcccagtccactgcaagcttcagcccaggagacacatagggaagggaggacggagcccctctgcttcctgacactgcaaaagcgggacccaggagaagagggagtacagggctggcaggggacactccaggccaatggagagctccagctgcaccatggggctgcccctcctgggctggaggctgtgccctctgcaggatctgagaaagtccagtcctgagatgggacagtgctgcccatggtgggtgcccggtgcctgacagcagtcccccagggagtgaccacatcacccagccggggtccagggagcctggcctgagacctgcccagtgcattgagggtgcacctggagcccactgcgcctgatgcccccacagccctcacagggtctgacctcccagcatgcacctgcctctccctgcaccctgctgcccaccctgcctgttccctggcttcctccatcctgtgcagcccatagactgtgaccatctatctggccactgtggcccttcctttccctttgtcctgttggaatctctgagcaagatctcccaggtccatcgaaacacctgctttgtccagttttgactgggtctttgggcactactgggccatcccaactgtccacagggccctcaataacgtgcattgcacctgacatctcccagcagtgctcagcagcccctgctgaccaggtccaggtccctgctggccatatcccacacatcaggtcctccctgaccacactctcactgattagaaccccatgaccaggccccactaaccaggcccttgctgctaggccaacagtgtccaggaccccactgaccaggaccttactgaccagggcctcactgaccaggttcttactgaccagggcctcactgaccaggttccactgatcatgaccccattgcctggcaccatagatgaggccccactgaccaggcctccagggaacaggctgccactgaccaggcccctattaaccaggccataggtgacaagatgcccctgactgtgaccctagtgagtaggccccactgaataggcacccactgctcagatccctgctgaccaggtcaccccacagaccactgctacaagagccaccactgaatgcgctctctctgaacaggccgccactgattaggttccactgaccaggctgcgctgaccagggccccactgacaagggcctcactgatgaggacatggccagcaggccctgctgactgggtcccatgtgaccaggcctccaatgaatagcaccccttgagctggtcaccagtgacccggcccatgctgacaaggccaccactaagccccagctgaccaggtctccattgacaaagtcctgcagcctagttttacactgaccagacaccaaacaagtggctgccactaggtccccactcaccaagaccccactactagatccccctaatgagaccctctctaagcagacccctgctgaccacaccccccaataaataggcctcactgaccaagtcccagctgactaggtccactgatgaggcccacactgatcagggccctcataaccataccagaaggacaagcgacaatgagatatttcatatggcaggagtaggagcaagacagagagagaaaggaggtgccacatcctgttatacaaccagatctcatgagaactcactatcaggagatcagcatcaagaagattaaccactggtgaaggaaacaccacccacaccaccacccactgtttgcaggcagaagcctcctgcagaggcagagcctcttgggaaacttctaccatggcagtgcagaagggaaacatgggcttggagccccgacacaggaggtcaccatcctccagaccccagattcataagcccaccaacagttcacatcctcagtatggaaaagctacaggcactccacaccagcctagcccatgagagcagacatgggggctgaagcctgcaaagctgcaggtgcactgccctagcagaggtttcccatgagcctctgcctctgaagcagactactcccccttcctactacccaccaccctcccaccaccctactgccaacctacttcccaccctacccaccccttttccttccaaccccaaacccctcctgccatgattacatcacctcccaccaggccccacctccaacattaaggagtacattccacaggagttttggtaaagaaacacagccaaaccatattattctgaccctggtaccccagaatctcatgtccttctcacagagcaaaatacattcatgccttgtcaaaagtttccaaaagtcttaactcattccagcattaactcaaatgtaaaaagttcaacatctcatctgagacaagtctacagtcccttgcacctatgagtccctgaatttaaaaggatgttcttttctttcagggtacaatgatggtacaggcattgggtaagctttctcaattcaaagggaagaaatttcccaggaaaaaaccacaaatagaaccacacacccaatgcaagtccaaaacccaggaggccagtatccattcaatctcacagctccaaaatcacgaagagaactcactagcataagcacagcaataaggagatggtgtttaatcatttgtgaaggatccacctcccaccaccacttttcacccctcacccccaccataatcccctcattctccctaccccccaccttccaacccacactctccaccatgattaaatcaccctccaccaggccccacctttaactttattattctgtccctggctcccaaatctcatgtccttctcacattgcaaaatacaatgatgccttccctacagtccccccaaatcttgtatcattccagcatttatacaaatgtccaaagcttaaagtctcatctgacacaaggctatacagtcccttaggcacataagcctctgaactataaagcaagttaactgctgccaagctacaatgcttgtgcaggcaatgggtaagcattctcaactgaaaggaaaaattttgccagaaagagcaaaacacatagaggacttacaggccccatgaaactccaaacccagaaggccagtcattcaatcctacagttccaaaatcaccctttttgaaacgttgtcccacatccagggcacagggacatgagggctgggctctgaaggccttgggcagccctgcacctgtggctttgcagggtttatgccccacagctgcccccatggactgggcgggtgttgagtgcctacagcttttcctgactgatggtacaagctgttggtgggtctatgaatctggggtctgcatgacggtggcctccagtgtgggggctccaaccccatattttccttctgcactgccctagtagaagtttcttatgaggctctgcatttttgggatgcttttgtctggtcacccaggcatttccatacatcttccaaagtctacaaaaaggctcccaagcctctagtctcatgatccatccacctagtggcttaacactatgaggaagttaccaaggcttctagcttgcaccctctgaagcagtgacccaagctgcatctgtgcattttcagccatggctggagctggagctgcagggacgcaggcagcagtgccctgaggctgcacatagagcggggtcacaggactggcccaggaaaccatgcttctctcctagggcccagggcctgtgatagcaagggctgctgcaaaggtctccgaaatgccgtcaagggcttttccctattgtcttggctattagcactgggctccttttcatgcaagtttctgaagccttcctgaattttccccctgaaaatcagcttttctttttgaccacttggccaggctgcaaattttccaaacttttgagtcctgtttctcatttaacataagagttgggactcatttaatataagtcccatccagaggtcattttctcagtcacacatcagagcacaggctgttcaatgcagacaggacacctcttgagctttgcttcctagaagttcattccaccagatatgcactgcatcatcaacctcaagtttaaagtttcacagatctccagggcagggtcaccatgcagccatgttctttgctacagcaaaataaaagtaaccttggcttctgttcccaggaagttcctcatttttatctgagaccttccaagtctggttttcactggccattttcctgtcagccttctgatcacaagtagttaacaattctttacaaagatccaaacttttcttcattttcctgtcttcgaagccctccaaactctcctgatctctgtctgccacccccttctgaacctgcttctacattatcagctatctttgtcacagcctggcaatgtggtaaaggaagacaagtccattttcagggagaaaattcaagaagccctcagatacttgaatgaaaagaagctgagtactgactcccaagacaatagggaaaaggccttgaagacatttcatacatccacttcccagtactaattttctctatgatcataaagaacctcatgattctgcaggctgtaaggaaacatactggcttctgaatctgggaggactcaggaagcctcccaatcataccagaatgtcaaggggcaatgagatgattcacgtggcaggagtaggagaaagacagagagaggaaagaggtgccatgccctattatacaagcagatctcatgagaactcacaaggtcagcatcaaaaagatggtgtttaaccattggtgaaggatttgccccccacccccaactcccactgtttccaggcagaagcctgatgcagaggcagatcctcttggaaaacctctactagggaaatgtggaaggaaaatatgggcttggagcccccacgcagatggccaccaacctccagaccccagatccatagacccaccaacagctcacagcctcagtttgaaaaaggtatgggtagtcaacaccagcccaccccatgagagcagccacaggggctaaaccctgtaaagtcacaggtgcactgtcctagtagaggttttccatgaaccactgcctctgcagcaggttactcccccttcctactacccaccaccctcccatcaccctacagccaacccattcctccccaccctacccaccctttctccttccacccccaactccctcccatccatgattaaatcccctcccctaggccccaccttcagcatttgggattacaattccacatgagtttcacagggacacacagccaaaccatattattctgaccctgataccccagaatctcatgtttttctcacagagcaaaatacaatcatgccttttcaaaattttccagaagtcttaactcattccaaatgtaaaaacttcaaagtctcatctgagacaaggctaccttctcttctgcctatgagtccctgaattcaaaagggatttcttttctttcaaggtgcaatgatagtacaggcattgggtaagatttctcaatccaaagggaataaatttcccagaaaaataacacaaatgcaagtccaagcccaggaggacagtattcactcaatcttaaagctccataatcatcaagagaactcactatcatgcagacagcattaaggagatagtgtttaaccatttgggaaggatccaccccccatcctcatcttttgaccccactcccaaaataatctccaccattctccccacacccgtacctccaacccccatgcttcaccatgattaaatcaccttccaccaggtcccaactttcacattccccattacaattccacatgagtatcggtagggacacagaaccaaatcgtattattctgaccctagttcccccaaatctcatatctttgacacactgcaaaatacaatgatgccttctctacagtcccccaaagtcttaagtcattccagcctttactgaagtatccaaagcccaaagtcttatctgacacaaggctgcagtcccttctgcctctgagcctctgaaatacaaagtaagttaattactttcaaggtacaatgattgtacaggcattgggtatgaattcccagccaaaagaaaaaactttgccagaaagaagcacaaaatatagatgagacttacagatccgatgcaagtcaaaaacccagcaggccagtcattccattgtacagctccaaatcatcacttttcaatccaaatcccacatccagaacacaggggtgtgatggctgggctcccaaggccttgggtagctctgcacctgtggctttgcagggtctttcccccacagctgccctcatgggctgggctagtgttgagcacttgtagctttccacactgagggtgcaagctgttggtaggtctatgaatctgggtttgcagaatggtgcctccatgtgtgggggttccaactctatatgttccttctgtaatgccctagaaaagctttcccatgagggtctgcctcttggaaaagcttctgcctggaaacccaggtttttctgtacatgctctggagtctagacgaaggctcccaaggctctcctcttttgctctgtgcacctgctggcttaacactatgtagaagccaccaaggcttgcatcttgtacccctgaagcagtgacccaagctgtgcctgtgcatctttcagccatggctggagctggagctgcagggatgcaggcagcagtgtgctgtggctgagcacagcagtggagccttgcagctggcccaggagaacattcttctctctcaggccttagggcctgtgacagcaagggctgctgcaaaggtctctgaaatgccttcaaggcctttttcccattgtcttggctattagcactggactccattttatacaaatttctaaagctctcttagattttcccactgaaaatcaggttttctttttgaccacttggccaggctgcaaattttccaaacttttaagttctgcttctcgtttaaatataagtttctacttgaggtcatttatttggtcacaccgaagaccacaggcttttggacacagacaggatacctcttgagctttgctgccaaaagttcatgcctatgatttagatacaccctaaatcatcaccctcaagttcaaagtttcataggtctccaggttaggggcatcatgcagcgacgttctttgctaaggcaaaaccaaagtaaccttggctcctcttttcagtaaattcctcattttcatctgagaccttgtaagcctggccttcactgtccatccttctgtcacccttttaattataactatttaacaagtctctacaatggtcaaaacttcccttcatcttcctgacttcttccaaggcctccaaactttccaacctctggctgttaccctcttgtgatcctgcttttacattttcatccatccttattgcagcctatcaatgcagtaaaaagaagaaatgcccattttcaggggaaaaattcacaaagggatccgatatctgcatgaagagaagctgagtgctgattgccaaggcaataagaaaaaggctttgaaggcatttcatagctccacttccaagcactaattttctgtaagatcataaagaaaagatgttgaactggctcatggttctgcaggctttaaaggaatcatagaggcctctgcttctgggaggaatcgggaagcctcccaatcataccagaagaccaagcggcaatgggatgtttcatatggtagaagtaggagcaagacagaaggaggaaagaggtatcacaccctgttatacaaccagatctcatgacaactcactatgacaaaatcagcatcaagaagatgatgcttaatcattgttgaaagatctgtcccccccaacacccccaccccaccactgtttccaggtagaagcctgttgcagagccagagcctcttggaaaacctctactagggcagtgcagaaggaaaatatgggtttggagcccccacacaggaggttaccatcctccagaccccagatttatagacccaccaacagctcgcaccctcagtatggaaaagctacaggcactcaacaccagcccaacccatgagagccgccaaggtactaaaccctgcaaagccacaggtgcaccgccctagtagaggttttccatgaggctctgcctctgcaggaggctactcccacatcctaccacccaccaccctctcaccagcttactgccaacctactcctccccaccctacccacttctttttccttctacccgcaaccccctcccatccatgattcaatcacctcccaccaggccccacctccaacgttcaggaatacaatttcccatgatcttttgtaggaaaacaccaccaaaccatattactctgaccctgacacccctgaatctcatgtccttctcacagagtaaaatacaaacaagccttttcagaagtttccaaaagtcttaactcattccagcagtaactcaaatataaaaaagattaaagtctcaaacaacacgaggctgcagtcccttctgcttctgagtccctgaatgtaaaagggagtgcttctctttcacgatacaatgatggtacaggcattgggtaagctttctcagtccaatgggaagaaattttccagaaaaataacacaattgggacacaggtccaatgcaagcccaaaagccaggagagtatgtacgcattcatcacgagaactcactttcacacagacagcattaaggagatactgtttaaccatttgtgaaagatctgcccccccagccccatctttcacccccacccccagcataaaccccccaaacttaccacaccctcacttccaatcccaactgtccgctgtgattaaatcaccatctaccaagcaccacttttaacattccccatcacaattctacatgagttttggttggggcacagagacaaatcatatagttctgcccctggccttccaaatctcatgttactttcactttgcaaaatacagtgatgtcttctctacagtcccccgaagtcttaactcattccagcatttactcaaatgtccaaagcccaaagtctcatctgagacaaggctgcagtcccttctatccctgagcctctgaaatacaaagcaagttaactactttcaaggtacaatgcttgtccaggcattgggtaagcagtcccagccaaaaggaagaaatttgccagaaagaagcacaaaacacagatgggacttacagaccccatgcaagtcaaaaacccagcaggccagtcattccatcgtagagctccaagtcatattttttgaatctacatcccacatccagagaagagggtggtttaatggctggtctcccaaagccttgggcagctcagcacctgtggtatggcaaggtctttccccaaagctgccctcatgggctgggctgctgttgagtgccagtagcttttcaacactaagggtgcaagctgttggtgggtctatgaatctggggtctggagaatggtgcctcccagtgtgggggctcccaccgtatatgttccttctataccatccttgtagaggtttaccacgaggctctgtctgttggaaaagcttcacctggaaacccaggattttccatacatactctggagtctagaagatgaagactccgaagtttctcgtcttgtgctctgtgtacctgctgacttaacactatgtggaagccaccaaggcttggagcttgcacccctgaagtagtgacccaagctgtacctgtgcatctttcagccatggctgcagcaggagctacagggatgtaggcagcattgtcctgaggctacacacagcaggggaccatggggctgggccaggaaaccattctgtcctagaaaaccattcttctgtcctaggcttcagggcctgtacagcaagggctgctgcaaaggtctctgaaatgccttcaaggccttttccctgttgtcttggctattagcactgggctccattttatgcaagcttctgaagctgtcttgaattttcccactgaaaatcaggttttctttttgaccacttgaccaggctgcaaatttttcaaacttttaagctctgcttctcatttaaatatgtttctaactgaggtcatttatttggtcacatagaagaccaggacacagacaggacacctcttgagctttgctgccaaaagttcattctgccggatacacccgaaacatcaccctcaagttcaaagtttcacagatctccaggttaggggcatcatgcagtgacattctttgctaaagcaaaacaaatgtaaccttggctcctgttcccagtaaactcctcattttcatctgagaccttctaagcctggcctttactgtccatccttctgtcacccttttaattataactatttaacaagtctctacaatggtccagactttccctcatcttcctgtcttcttccaagtcctccaaactctccaacctctggctgttagacaattctcaacctgcttctacattttcagctctctttgttgcagcctgtcagtgtggtaaaagaagaaaagtccattcacagggggaaaattcatgcaggctacagatatttgcatgaaaagaagctgagagctgattaccaagacaagaaggaaaagaccttgaaggcatttcatacctccacttcagagcactaattttctgtaagatcataaagaaaagatgttgaactggctcatggctctgcaggctttaaaggaatcatagaggctcctgctcctaggaggaatcatgaagcctcccaatcataccagaagaccaagcagcaatgggctattttatatggcagaagtaggagcaagacagagaaaggagaaggttccacactgttatacaatgagatctcattggaactcagtatcacaaggtcagcatcaagaagatggtgtttaaccattggtgaaagatccaccccctaccaccaccccaccccccactgtttccaggcagaagcctgttgcagaggcagagcctcttgcaaaaacttacgagggcagtgcagaaggaaaatatgggcttggagcccccatgcaggaggccaccatcctccagatcccagattcatagacccaccaacacctcacattctcagtgtggaaaagctacaggcacacaagaacagaccagcccatgagagcagccatggggctaaatcctgcaaagccacaggtgcactgccctggtagaggttttccatgagcctctgcctctgcaggaggctactcccccttcctactacccaccaccctcccaccaccctactgccagcctacacctcccgaccctacacacttgtttttccttccacccccaccaatctcccatttatggttcaatcacctcccaccaggctgcacttccaacattcgggagcacaattccccatgagtttttgtaggtaaacacagccaaaccattttattctgaccctgagaccccctaatctcatgtccttctcacagagcaaaatacaaacgtgccttttgaaaagtttccaaaagtcttaactcattccagcagtaactcaaatgtaataagttcaagtttcatccaggacaatgctgcagtcccttctgcctatgagtctctgaagggaaacgggagttcttttctttcaagttacagtgatgggtaagctttctcaatccaaagggaagattttcccagaaaaataacacaattgggacacaggcccagtgcaagcccagaagccagcaggagagtattcatttatcatgagaactcactatcacacagacaggattaaggagatagtgtttaaccatttgtgaaggatctgccccggtctccatgtttcacgaccacccccaccatgaacccccattcttctcacacccacacttccaacccccactgtccaccatgaataaatcaccttccaccaagccccagctttaacattccccattacaattacacatgagttttggtagaggcacagagccaaatcatattattctgcccctggccccccaaatctcatgtccctctcacactgcaagatacaatgatgccttctctacagccccccaaagtcttaactcatcccagcatttactcaaatgtccaaagcccaaagtctcatctgagacaaggctacagtcccttctatccctgagcctctgaaatacaaagcaagttaactacttccaaggtataatgcttgtccaggcattgggtaagcattcccagacaaaaagaagaaatttgccagaaagaagtgcaaaacacagatgggacttacagactccatgcaagtcaaaaacctagcaggccattcattctatcctacagctccaaataatcttttttgaaactacatctcacatccagagcacagggtggtgagatggctgggctcccaaggctttgggcagctcagcacctgtggcatggcagggtctttccccaaagctgccctcaatggctgggctgctgttgagtgccaatagcttttcaacactaagagtgcaagctgttggtgggtctatgaatctggggtctggaaaatggcgcctccctgtatgggggctccaaccctatatgcttgttctgcaatgcccgagtagaggtttaccatgaggctctgcctgttggaaaagcttctgcctggacacccaggctttcccatacatgctctggagtctagacaaaggctccaaagcctctagttttgtgctgtgtgtacctgctggcttaacactatgtggaagccacaaaggcttggagcttgcacccctgaagcagtgacccaagctgtgcctgtgcatctttcagccatggctggagctggagatgaaggtgtaggggtgcaggcagcagtgtcctgaggctgcacatagtagtggggccatagggctggcccagaaaaaacattcttttttcctaagccccagggccagtgacaacaagggctgctacaaaggtctttgaaatgtcttcgaggccttttttcccattgtcttgaattattagcactgggctccttttttatgcaaatatccaaaggcttctggaattttctccctgaaattcagcttttctttttgaccactttgccatgttgcaaattttccaaaggattaagctctgcttctcatttaaatataagtttcaactcaaggtcatttctttggtcacacataataccacaggctgttcgacgtaggcaggacaactcttgagctttgctgcttagaagttcattccaccagatagaccctaaatcttcaccctcaagttcaaagtttcccagatctccggagcagggacactgtgcagccaaattctttgctaaggcaaaagaacaaaaccttggcccctgttcccagtaagtttctcattttcatctgagagcttctaagcctggccttcactgtccatccttctgtcagccttttaatcacaactaacaagtcattacaatggtccaaactttccctcatcttcctgtcttcttccaagctctccaaacgctctaacctctggccattaccgaattccgaacctgcttctacattttcagctatctttgtcgcagcctggcaatgtggtaaaagaagaaaagtccattatctggggaaaacttcaagaaggcttcagatattagcatcaaagaagcccagtgctaccagccaaaagattggggaaaaggccttgaaggcatttcatagcttcacttcacagcattgattttctgcatgtacataaagaaaagaggttgaattgactcacagttctggaggctgtaaggaaagcatagtggtttctgctttcaggaggactcaggaagcctcccatttataccagaaggccaagcagcaatgaaatgtttcatattccaggagtagaagcaagacagaggaaagatgccacatcctgtcatacaaccagatctcaagagaactcagtatcaggagatcagcatcaagaagatggtgcttaactattggtgaaggatccacccaataccccacatccaccccccagtgtttccaagcagaagtctgaggcagaggcagagcctcttggaaaacctctactagggcagtgcagaaggaaaatatgggtttggagcccccacgcgggataccaccatcctccagaccctagagtcatagacccaccaaaagctcccaccctcagtatggaaaagctacaggcactcaacaccagcccagtccatgagagcagccatgggggctaaagcctgcaaagccacaggtgcactgccctagtagaggttttccatgagcctctgcctctgtagcaggctactcccacttcctactacccaccaccctcacaccaccctacagccaacctactcctccaacgttacccacttctgtttacttccaactccacccctctcaagtacaggaataaatcacctcccaccaggccacacctgcaacatttggaattacaatttcccatgtgttttggtagagacacacagccaaaccatattattctgaccctgatcccccgaatatcatatccttctcagcgagtaaaatacaatcttgccttttcaaaagttgccaaaagccttaactcattccagcgttaacacaaatgtaaaaggttcaacatctcatctgagaaaagtctacagtcccttttgcctatgagtccctgaatttcaaagggaggtctttttttcaaggtacgatgatggtacaggcattgggtaaattttctcaatccaaagggaagatatttgtcaggaaagtaacacaaatgggatcacaggcccagtacaagtccaaaaccaagcaggacagtatctattcaatcttacagctccagaatcatcacgagaactcaccatcatgaggaaagcattaaggagacggtgtttaaccatttgtgagggatcctccccaacacccacctttcacccctcacccccaccataatccccccatcctccccaatccccaccttccaacccccactgtcctccatgattaaatcatcttccacctggccccacttttaacgtttccaattacaattccaaatgagtttctgtagggacacacagccaaatcttattctgtccctgcctcccccaatctcatgtacttctcactttgcaaaatacaatgatgccttacctacagtcccacaaggtcttaactcattccagcatttactcaaatgtccaaagcccaatgtctcatctgagaaaaggcagtctcttctgcccctgagcctctgaaatacaaacaagttaactacttccaaggtacaatgattgtccaggcattgagttcccagccaaaaggaagatttttgcctgagagaacaaaacataaatgggacttacaggctccatgaaaagtccaaaacccagcaggccagttattcaaacccacagctccaaagtcatccttttttaatccttgtcccacatccagggcacaagggcgtgagggctgggctcccaaggccttgggcagctcacctgtggctttgcagtgttcagcctgtgcagctgccctcatgggctgtgctggtgttgagtgcctggggtttctaacccatggagggtgcaaagctcttggtgggtctatgaatctggggtcttcatgatggtggcctccagtgtgggggctccaaccccatattttccttctgcactgccctagtagaggtttcccatgaggctctgcctttttggcagccttctgtctggacacccaggcactttcatatatcttccaaaatatatatggaggatctcaagcctctgaactagtgctctgtgcacccattggcttaacactgtgtggaagccaccaaggcttatagcttgcaccttctgaagcggtgtcccaagctgtacctgtgcgtctttgagacaaggctggagctggagctgcagggatgcaggcagcagtatcctgaggctgcacacagcagcagagccatggagatggcccaggaaaccattcttttctcctaggtcccagggcctgtgacaacaagggctactgcaaacatctctgaaatgcctccaaggctttctcccccattgcgttggctattagcactggccttcattttatgcaaatttttaaagccatcatgaattttccctctgaaaatcagcttttgttttgaccacttggccaggctgcaaatgttccaaacttttgagctctgcttgtcatttaaatataagttgcaacttgaggtcatttcctcggtcacacataaaggcacaggctgtttgacacagggaggacacgtcttgagatttgctgcctagatgttcattccaccagatacaccctgaatcatcaacctcaagtttaaagtttcacagatctccagggcaaggtcaccctgcagccatgttctttgttacagcaaaacaaaagtaaccttggctcctgttcccagtaagttcctcattttcatctgagacctcataagcctggccttcactgtccctccttctgtcagcattttaatcacaagtatttaacaagtctctacaatggtccaaactttccttcatcttcctgtcttcttccaagtcctccaaactctccgacctctggctgttagccacttctgaacctgcttttatattttcagctatctttgtcacagcctggcaatgtagaaggaaaaaaagtccattttcaggggcaaacttcaagaaggcttcagatatttgcactaaaaggaagaccagtattaatagccaatgtgatggggaaaagtcattgaagacatttcatagcttcaattcgcagtactaattttctgtaagatcataacaaaaaggggtttaattggcttatagttctgcagtaggctgtaaagaaagcatagtaacttctgcttctgggaggactcaggaagcctctcaattataccagaaggacaagcagcaataaaatgttgcatatggccagagtaggagcaagacagagagaggaaagaggtgtcacagcctgttatacaaccagatctcatgagaactcagtatcacaaggtcagcatcaagaagatggtgcttaaccattggtgaaagatccaccccccaacacacttccacccctcactgttgccaggcagaagcctgctgcagaggcagagcctcttggaaaacctctactagggcagtgcagaaggaaaatatgggcttggagcccctatgcaggaggccaccatcctccagaccccagattcatagacccaacaacagctcatactctcagtatggaaaaggtacaggcattaaacaacagcccagcccatgagagcagccacggggctaaagcctgcaaagccacaggggcactgtcctagtagaggttttccatgagcctctgcctctgcagcaggctactcccccttcctactacccaccatcctatggccagcctactcgtccccaccctccccacccctttttccttacacccccaccctccttccatccaggattaaatcacctcccaccaggcttcacctccaaaattcaggattacacttccacatgagtttttctagggaaacacagccaaaccatagtattccgaacttgacccttccaaatctcatgtccttctcacagggtaaaatacaatcatgccttttcaaaagtttccaaaatccttaactcattccagcattaactcaaatataaaaagttcaaagtctcatccgagacaaggctacagtctcttacgcctatgagtctctgaagttaaaatggagttcatttctttaaaggtacaatgatgacacaggtattgggtaagctgtcttaatccaaggggaagaaatttcccagaaaaataacacaaatgggaccagaggcccaatgcacatccaaaacccagcagaacagtattcattcaatctcaccgccacaaaatcatgaagagaactatcacaaggacagtattaaggagacagtgtttaaccatttgtgaaggatctgccccccacccgcctttcacccccaaccccaccataattttccccaattcgccccaccacccccaccttccaacctccactctccaccatgattaaatcaccttccacctgcaccccacctttaacatttcccattacagttccacatcagtgggacacagagccagattgtattattctgtgcctgcccctgcaaatttgtctttctcacattgcaaaatacaatgatgcctctcctacagtcccccaaatcttaactcattccagcatttactcaaatgtgtaaagcccaaagtttcatctgagacaaggatacagtcccttccgcccatgagtctctgaattataaagcaagttaactacttccaaggtacaatgattgtacaggcaatgggtaagcattcccagccaacaaaagaaaaattgccagaaacaaaaacaaaacaccgatgggactcacaggatacatgaacgtccaaaacccagtaggccagtcattcaatcctacagctccaaagtcatccttttggaatccttgtcccacatccacggcacaggagtgtgagggctgggctccaaaggctttgggcagatctccacctgtgggtttgcagtgatcagtccccgcagctgccctcatggacggggctggtgttgagtgactgtagctttcccacattgagggggcaagctgttggtgggtctatgaatctggggtttgaaggatggtgcctccctgtgtgagggcttccacctgatacatcccttctttcccgccctagtaaaggtttcccatgaggctctgcctcttggaaaggcttctgcctggacacccaggcttttctgtacatcctctggagtctagacagaggctcccaagcctctagtctcttgctctgtgcacctcctggcttaacactatgtggaagccatcaaggcttggagccacctctgaagcagtgacccaagctgtacctgtgcatctttcagccatggctggagccggatctgcagggatacaggcagcagtgtcctgaggatgcacacagcagccaggccatggagctggcccaggaaacaattctctcctcttccccagggcctatgacagcaagggctgctgcaaaggtctctgaaatgccttcaaggccttttccccatagtcttggctatttgcactgggctctttttttatgcaaatactttaagtgctcttgaattttccccctgaaaatcagctttcctttttgaccacttggctaggctgcaaatttttcaaatttttgagctctacttctcatttaaatagaagttgcaacttgaggtaatttcttaggtcacacataagaacacaggctgttggatgtagagaggacacctcttgagctatgctgcctagatgctcattccaccagatacatcctaaatcgttacccccatgttcacagtttcagagatctccagggctaaggccaatcaaatgtaaccttggctcctgttcacaagatgttcctcattttcatctgagaccttttaattctggccttcactgtccatctttctgtcagccttctgatcacaagtatttaacaattattttcagtggtccaaatttttcctcatcatgctgtcttctaagcattcccaactctcctgacctctctgttttacccacttctgaacctgcttctacattctcagatatctttgtcacagcctggtaatgtggtaaaagaagaaaagtccattttcaggggaaaaattcacaaaggcttcagatatcttcatgaaaagcagctgagtactggttaccaacacaatggggaaaaggccttgaaggcatttcatagctccacttcacagcactaattttgtgtacaatcataaagaaagaggtgtaattggctcacggttctgcaggctgtaaaggaagcatagtggcttctgcttccgggaggactcaggaagcctcccaatcataccagaaggccaaggggcaaggaaatgcttcatgtggcagcagtagaagcaagactgagagaggaaagaggagcccgccctgttatacaaccagatctcatgagaactcagtatcacaaggtcagcatcaagaagatggtgcttaaccactggtgaaggatctgcccccgcaacccccacctccacctcccactgtttccaggcagaagcctgctgcagaggcagagccagattcatagacccaccaacagcttgcacccccactgtggaaaagctacaggcactcaacagtagcccagtccttgagagcagccgtgggggctaaaacttgcaaagccacaggtgcactgccctaacacaggttgtccatgaggctgtgcctctgcagcaggcgactccccactcccactacaccccacccttccaccaccctacaccagcctactcctccccaccctgcccacctctttttccttccaccccacccgcctcccatccgtgattaaatcactcccaccaggccctcatctttttgtcattttccaatccctgcaaaccctcccaatctttgtttgttacccacttctgaacctgcttctactttttcaggtatctctatagcgggttggctatgtagtaataacacaaaacccgatttaagggggaacattcaagaagacttcagaaatttgcatataaagaagccctgtgctaatggccaagacaaatggaaaaaggccttgaaggcatttcacagctcctctctgcagttctaattttctgtattatcctaaataaaagaggtttcattgactcagggttctgcaggctgtgaaggaagcatagtgtcttttgtttctgggaggagtcagggagcctcctaattataccagaaggccaagggacaatgagctgtctcctatggcaggagtaggaggaagacagagtgaggaaaagaggttccacagcctgttaaacaaccagatcacatgaaaactcactcactatcaggaggacagcatcaaggggatggtgctttatcattcgtggaggatctacctgcaccattttatgactaaatctttttccacctaggccccacctctaacgttagggagtataattccacatgggttttgatagggatatagagacaaaccatattattctgtccctgatcccatgaatctcttgtccttttcacattgcaaaatacaatcatgccttgccagcatgagtcttaactcatttcagcattaactcaaagttacaaagttcaaagtctcatctgagtcaaggctgcagcctcttttgcctataagcctctgaaataaaatgcaagatcactgcttctaaggtacagtggtggtacaggcattgtgtaagctttccatatccaaaaggaagacattttccagaaagcttcttatttctatctgagacctcctcagcctggccttcactgtccatgtttctgtcaggattttggtcacaaccatttaaccagtctctaagatggtccaaaccttctcatctgtcttcttttgagccctccaaactcttccaacctctgtccattacctagttccaaagctgcttccacattttcaggtatctttatagcaatgctccagtcctcatttgccattttctgtatgattcattatgaaaaagaggtttaattggctcacggttctgcagggtggacaggaagcacagggcttctgcttctgggaggcctcagaaatctttcaatctttgtgcaaggcaaagaaagagtcagttgtctcacacggcaagaggaaaacatgcagagtagggaggtgacatagagttttcaatgaccaggtgtcatgagaagtcactcatgattgtgaggacagtagcaaggggatggtgctgaaccattcatgagaaatttgccttcaggattcaatcaccttagaccaggatccaccttcaacgttaggaaatataattcaacatgagatttggtgaggacacatattcaaattgcatcatcaatctttgaatataaagacatccacagcaggctttatccagccagcttctttgagactcttcacagggtttgaggtctacagcatatacacgaaaatattcatacttcaaaaagcaataaagtaagtggtatcattcttccaaaagttacaatggtagtgtaggaattcatagcatggtttaggtcatgtttgctactgtttctattctatcgccatattaactgtttcctacacaattctatgttcagccgagtttcaattgagaacaaagccatccttgtactaccgccaatacctggcactatctctttgctagtgttattattctgctgtagaaagcatccttgaactggaaacagtgcacaatcgagtatctagtcattcaacactatcaattcctgggtgaccttttgaaaaaatagtatctcttgttgcaagaaatgctgcatctgtgagtccatgtttctcactggaattggatggaagtggtgaatttcagccacagtgtccaaagaaatcctgttcctgtgattctgatgtcatcagcctctgcatctctgtcttcccttctgccacatgttgcctgctctccatgactttggtaagagcttccttgtgtatgtggatgatgtccaggatgatgacctggtgtcccagagacagcactaacaggtccatgactgggtccagttcctggctgggctgattggcaaagagctcaccgacggtgttgaaggcatctctggtgaagtgatggcctggtccagctccaagacctggctgaggctgaagagctggccaccttctgatgctctttcttaaagcccgtcaccataatctgcttgcatgtcaactcattggctgagaagttgagctgagtgccctgtggtccatcttcttggtgaagcgctcgaagccgtcaattttgctctcccactcttaaaggttgagggccaccttgggggtgggctcagggtcaggaagaagctggaattcaccacctcatccttcgcagccttcctcttgccctgtctccaggctgtctcttcagtgctggtgtggcacatcacgaagtgatggaagacgtggcactgtgcctgcacccagaagctggccatgtggttcatccacgagattgggccctttctgcacttgaacatggagtccttctcaagatggcctgcggtctgcctcttggcacccaagaagcccacagtgctgtaggagccctcatgcatggactggagccccaaaggcagcgcacagcctgctcctgagcctgctgctcatttcctctatgtggctccatctgcagcacagtggttgcattgaggcctgtgcatgccaggcaaggccaagctggctcaaagagcaaccagccacctctgcaagggtgtgccaggagcaggtggaccagccaccaacctcactcgctgccagtcagggtaaatcagttattctgccctggaggtagggccccagtgccatctgcttttcctcaggcctctgctccatcagccgtcaagtggcagcccctcaggctgtgggaacctggccacccctgattccttgagtgggtgaggttggtggccggtccacttgctccaggcacacccttgcagaggtggctggttgctctttgagccagcttggccttgcctggcatgcacaggtcctgggtactgacaccctgctctgagtgagcttgtcctgtcttgggccaaattctaactctggccagggccacagaaggctgagtcccctgggtggtaatgctgactgctgctggggggaccatagtgcccctcccctcccagggcccaggatgaggcccaactgggccaggaccctttaggtatggatctcgctccccagcagggggcctctgtcccacaggttggatgacaagatgctgctggctgccagggttgttcggatgccacgttcacccttccctccagggacatcaaagtttccagcttcccctttgagaatgacttcccaaggcccaggtgccatctggggctgcagggcagctggctgcatgctgccctggcttcttccatgttgggctggtcactacccaccaaggggggtcagatgcaggaaccaagtagggcggttgtctctggacctgcatcttggttatcacggagcgagactgggcctggtgacagggccatgatggggttgtcctggtggtcctgggggtgtccagaggagatgcagaatggaattgctgcaaggatgaatgagatgactgtcagcacagaacaggcacctggtgagtgctcagggattaccctcagtagctgcccagaggccaaaaccacccacccgatagcgactgtccccaagccaggaggaagagaagagagcaggtcccactcacctgagtccgatcagtcagctgtgttgagatgtgcctttcacctagaaaacaatccttcatgcagagccactcacagagactgctgcgtgtctctaactgctccacaacacagaggcgatggggactcagcaagagtgacattgtggggtgacacaacccaccacaacaggagcctgcttgggtcaagagggcccagagtcggtgtcctctatcccctgaactgacatgtgtgcatgcattgtgtttgtgtatgcgtgtgtgtgtgtacatatgggtgtgtttgtttgtcttgcttctctggccaggcctagctgctccactcacaggtgcacccaggtcctcatcactgtcaccaccagggcccagggccaggattagagcctcccacaggtgctccccaatttcttccctctccactgagggtggtcctggggatgcagacagaggaggggtgccgagcagagcagagagggctggcaccctttctaggtggaacccaggtactgtgtaaagttggaggtctgccaagcagtgctgaattcaacacatcttctcacgttctctttccagccaccctccagggtgccctgactcaccttccctacagatggaggcaaagaggctccacagacaaaccccctgcctgaggtcacacatcggctaactggccaggttcctactgaccaggtggccccaacgaggcccctaatgagcactcccccattgaccaggccccactgaccaagtccccacggaccatgtctccctaaccaggcccccattagtaggcctcatggaccagaccccactgaccaatttcccactgacctggtccccactgactgggttcgcactgacaagaccacaatttaccaggttgctgctcacctcacccccattgaataattctccatggatcagtccccagctgactgagccccctctgaccaggctctcactgaccaggctccaagccactaaggccccacactgaccagacccctaatacactgaatacaccccaccgaccagttttttattgtttatgttccaaccgatcaggccccactaataagagcaccactgaccaggtccccactgactaggcttccaatgactaggtcacaagatacccactgggtgaggccttcactgaggcggccaccactaaccaggtccctgctgatcaggtcccaactgaccaggtcgtgatggctaggtcatctctgaccatggtccactgacgaggcccttgagcagctgtgttcaaagtctcattacaatgccaccatcagctcacagaacctcccctccctgcatgtgtgcccaggggtcaggcctggggggttttcttgggctgcaaggcctctcctccaagacacagggagggagtcagcctcaggctccaggtacccagcttcacactcaccccgcaaggccctctgggcccatctcaaaggagacaatgaggtggcctggcactgcctggacatgccatcttccctattcctgagtgtcagagtgggaggaagggagggacatttggcagacaagacatcctgtgctgctgggtctcccagggcccttcctgaagagccccgacctagagacacagcacagagactgcagggagactaatcaagaacccttgaggctgagccagggaccacatgaggactgtccccagacagctagaaggccctttgctagtttcttggtacctcagtggatgcgacagtggttcttctgttggggactagtgagcgcatgatgggaagggctcgcctgtgcttccttggtgctgccgcagagaaaatacattagtttagaacaccttgtgccagaaagtaaaaaagtgctgacagaataatggggacaattcaaaaagacataaagtcagcttgaaatgtctaccactggcctaatcttggggaactggagcaccagaatcatgagctttcccttctcctttatttattggttttatttctccatgtagaacaaagaagaaaataagaaaaacaatcatctggcaaccatcacagtaatacttgttcaaacacaagtcatccatgaaatgctaaatctagtgggttttgaggagtaaccagatatttacagagcttcaaagtatctccacacaaaatactattgagctacaagaagaaaaccgtaacactagtatggacaaacctggcagatactctttaagtctcctactacatatggtaataaaaactgtaaaatgcaaagaagccctcgatgacctttactaaagtatcaatgatgacttggttgtttggctgtttaaacagctgacattcaggcaatttgagtaggccaaactcaataacgctggtgttcatttgcaagatccacttaaaacttaaggaggctaaaaaacatcatttaaaataacatataaatatacaccatatgtgacatgaaaatattctactttagtaaagattatgatgttttatattatatgagaaacaattaaaatttcatgtaaatagcccagtaataaagttttatgatcttttaaatcatacaacttttccttaagattttatggttaatctcttcattagatgtggcttaccagtggattctacaaaagaaagtagacgggagcaagtgctcaacatagcaaaacctggaaagaaaaagaaaggattatgttctttacctaaaacatttcagttaacgaagtgtaagtttaaaatgtggagttgagaacgttatcagagttaataagaatgagaaatatgtacgtgcaattacaatacaaaattactattaaatcatttacacatggcgttaattccaattgtggttaaatatcacagctttttcattcttcattcatgtactcaacagccacgtgctaaggtactagagccagcactggaattacaagatgaagatggcatggtccacctcccaatagtcatatgctataacctaaaagaccggcaggtaatgtccatatagagtcatagataccatgacaggtatacagcagggcactactggaacatacagaagggacatctatcccacttttgtgtcaatatcatgggctttctggtggaggggatacataggttgatgactgaaggacgaggaaaatcttgccagatagagggaagaggcgaaggcaaagatcctgaggtaacaaagagccctgcggagctctattctgtccactttggtgctagagcaaagggcagaatgcagtaagtggtgagagacaaggctgagtaacctgacaagagttacattgatgtgagtgtttttatttcatggtgaaatttttggaacttttcctgagaacagatgtaagccaactgatgcctttgtttttggagaatcgtttcagtgtgctggctgacagttccatgaggatggcaaaagtgaacaaattgtagagctggtaaaaaagagatggatccacttcttgggaattttttaagctatggaacatgatgaattaatgatgcataagtatactcttcactgtgaaagttttcgttttcacatctttcattagatgtgtgtaagaaaaagatactgaatatagtatctactaacccaacaatgaaaaggaatgccatttgctatttacactttattactaaaataaacctaaatttaattaatacattttggcaacatacttttctttgttcctgtaattatttgttctacacggtccagctccatctaaaataagtaaataataataataataatgtttaagttaaacaagaaatattatcatgagattaatatattacaaaatgtggcccttagtatttttagtgactagacataacacaaagtttgcttaaatagaaaattaatcacattaagtaaagtaaaatttctacttattctaagtttagataatagaggatgtatctgtgtaatgctatttagagtaatctgacaaaaatagataatattggtctattggatatacataattttagaaaggtggtgttttatttgtacaaaggttaaacaatggccgggcacagcagctcatgcctgtaatcccagcactttgggaggcaaatgtgggcagatcacaaagtcaagagatcgagaccatcctggccaacatgatgaaaccctatctctactaaaaatacaaaaattagctgggtgtggtggtgcatgcctctagtcccagctactcgggaggctgaggcaggaaaatggcttgaacccaggaggtggaggttgcagtgagccgagatcgtgccacggcactccagcctagtgacagagcgaaactccatctcaaaaaaaagaaaaaaaaaaggttaaacaattaaagtcacattttgcaatgaatgaatgcattgctttgaaattcttagcaaaactctgtcctttacaaaagtttaatccattttttacttaaataaattttttcttaaaaagaaatttatattctttagttactgaaaaaaatatgtaaagttttcttttttttttctagtttgtattctaaattaaagcggtacctgtgtaagtttcttccaaaagtatattgaggaatgctaaggtttggagtacaattgaacccatcacacaggtagtgagcataggacccaagaagcagtttttcaaccctggcccactctgtccctccccattcttatttcccagtgtctattgttcccatgtttatgtcaatgggcacctgatgtgtagctcccacatatgagagcaaacaagatatttggtttctgtttctgcgttagtttccttaggatagtggattccagctgtatccatgttgctgcaaaggacatgattttattcttttcatggctgcatagtatttggtatatatggaattttccaatctaccttggattttcaaactaccttgggtgcacctggattgactccatgtctttgctattgtgaatagtgctgcaatgaacatacatgtgcatgcatctttttgttacaatgatttatattttcctttaggtataaccctagtatagtaatggggttgctgcatgtgggattacaggtgcctgccaccacacctggctaatttttgtagttttagtagagacggggtttcatcatgttggccaggctggtatcaaactcctgtcctcaggtgatccgcctgcctcggcctcccaaaatgctgggattacaggtgtgagccaccacacctggccaagcacaaagcttttaacagaaaaatggaaatgaacctttcagtgttttgtttatttaattcataaaatgcacttatttggggttctattaaataataaatatctatatgttgttaagtgtttggttgcctgtcattcacttgtgattatgggtggaaagagttaagttggtgcaaagaaactttaaaagtggtatgggctgggcacagaggctcacccctgtaatcccagcactttgggaggctgaggtgggtggataacaaggtcaagagttcgagacctgcctggccaatatggtgaaatcccatctctactaaaaatacaaaaattagccaggtgtggtggcagacacctgtagtcccagctacttgggaggctgaggcaggagaatcacttgaacccaggaggcagaggttgcaatgagctgagatcatgccactgcactctagcctaggcaacagagcaagacaccatctcaaaaaaaaaaaaaaagtgatatgaaccacagacaaactacaatcaagtagagtaagacaaagcatttcaaagtataccatcagttattaggcaataacatgcattttctaaaacctaacttaaatgcagcttttaaagaaattttaaatgtgtcagtttaaccacatttattgaataaagttagcaaatgggtgtctcttgaaaatgagagctccagggaattaaaaaatgtaaagtttccatttcctttctgtgttaacacagctaattataatctttacttaacatgcgtaagtcaacagaactcagtatttcatcaaattatagacaagaattatattagagaaatgaaacccaaaagagaaatggtcatataactaacctcagtcaagaagttcttgcagttatttgaagtctgtgggtttgaagtaggaattcttatggccgttttgggaatatattttctgttgagttctatactattaagattttcaacacaaggtaactctggttctggccttgtaggaagagtgctgagaaaatatttcatccgctgtttctccgtaaagagcttggtgctgatcactgctattttcttatccgatctgtaaagagagcaaagacaaatgcttagtatttcatttttccttgaatgattcttaatgacttgcattttttaaaaagttgccctgagagtaaaccaaaatacccattaaacagtgctttcacacaaagatgtgtgagggcatacctcttgtaagtaacggtaattttaaaatcatcctaaataagtatatgtgtttctaaggtgatttctactgaacaagcagttcaaagtggacagggaagagaaatggctatcagtgatgtacggctcaacaggtaacctagctgccttctaaaatagctctacttataagattctaaagattcctttagatatacttgtatttaaagggtaactatgtgggaaaatgattacgttaatttgcttgactataagaactacttcactataaataattatatgaaaacatcatgttgtactccttaaataatgtagattaagaaaactaaaatgaacaaaaataatctagaaatacttgtgtttagtaaaccagtttcaggtttcacccttgtacatttcacccattctctaagaacacttaagtatttggcactgaggaataactcagagcaacaactcctgggggagaactagactggttggttggtgatcaaaaagaactaaagcatctctgaaggcaattagccctcaacaccgtgaccaaggcactggaggtggggcttgttctttctgccttccacacagcccttcaggctgaaaaaggtgttatttttgaacccttgtggattacccttcttttcattcctgtgataattattccctctttcacaaggatgactttatgtaacaccttgaaaatgttacacaaatagtctttcttgaggcaccctctagtgataataccaaagatcacaatcaaaaacagtccctgcctgagtgccaggatgtgcccagagtagcagtatcacttgacactttgggtttaggttgtgatctaccaaaaaataaattaaactcactaatattcccatttagggaaattctgacaagtaattttataacaagatcactttattgatcataaagcttcaaaaatacttagtgaaaaaaactaacaggtcaggttaactacatgagacttttcaggggaaaaaagccacacaaaaacaaaaaaagagaagagagacagaaactatccttgatgaacattttaaaggtaggattatttactaacattattttccaaaattacattatcaaattagcattcacttcctactgatctcctgaagccatctcactaaaaattatgcttttaagacaaattaatgagctgaattcattttctatgagtgtatgttttgacttacttcattaatttttttgacatggaattgttagctttcactgctcctgcaaaggcttccttaaattcttctaattcagttgtaacctcttcataagcagttttcattttggagaatttacattccacatctttaagtgtgagttccttcttttttagtgaagccgtattatccttgtttaactgctctaattgtttttcatattctgcttgtttctaaaacaaatgaaaagaatacacttttaaaacaattataagttaattaccataggtttgttgcctttcattttgaatcagtgattcgaagagcaattttgagtatgttgaaaagaggctgaagcttaaaatatttatcagcaatatcaacaaaactaataactgaattcagaattgtctgatttaaaaaaatttgaaatcatacttatgttagtattaatgtaatcttgtcctataaaaagtaatagaatccatttataattttaaaaagtgaacaatgaacaacgtagcttaagaccaattcaaaagtatcatataatttctaaatcacagttttctcttatgccacctggtcttaatcatcaaattcccccttttactctatagtgagaatcattactttgaaagattgattttgttataataataatggaaatttaaatatttaaaaggaaaaaagtcactttttttctagaactctacgaaggaaattgctgtaagagaggcagaggaaacacaatatatacatatccaaaatatagtttgcagtgaaataaatgaaagcccattacagataaacttacctgattttaaaaactaacctgtaaatggatttcttctaatttttctatttcctgcactgccctttcatccagctccgatttatattcttgtagtttaccaagttctaccatatctttttccatatgtgtcttaagatttaatacttcttcttccaacatctttttatccttctcaagtttttcacatttctcttgtacatttctcatagataataactcctgatgaagaacttcattgtctttggccaaattgacacattctgaagacacagcttccttctcggccacaagatcattaaactgcattaagaaaataatagagcttgataatgaagtaggctgagaataatccaatacaaaaccaatagcaaattttgaaatgcattgacttgaaataaaatgttatctataatgtagtagattcttcaaatgtgaacccttaaattactcagaattttaagaacaaagttaaagctaccatgagtcacaaaaatgtgctttactgtcatcatctttgccacagaacttttgcacttgcttttacttttatttttctgataattcatttttgttcctccttaaatggcactaagttatctcttagtaaaaagtgtctaaccctcttccctcatcatcattccccaaaatttgtcaaaaaaactttcagagatatcatattgagttatttaggccaaagtcaataaatggctctcagaataagactttgaaaataatataatactctacgctaggcatggtggctcatgcttgtaatcccagcactttaggaggctgtggcagaaagatcactggaggccaggaatttgagatcagccagagcaacatagtgagacccccatctctacaaaaaaacaaatttaaaaaattagccaggcatggtggctcaggcctgtagacccagctagttgggagactgaggcaaaaggatggcttgtacccagagttcagggctgccgtgaattatgaccacatcactgcacttcttcctggacgatagacaaagacaatatctcaaaaaaacacaaaataatgaatcctgtaaataaggattctgatgccataagcctttccctaaactgcaaatgtttcatgctaatttgaattgcattttaagaagtaatgattcttggggtaaaggccatagaatacagcacccagaaacaaatccacatatttacagccaacttattttggaataaggtgccaagaacatacattggggaaaggacaccctcttcaaatgaatagcgctgggaaactacccatatgaagaatgatactagcttcctatctatatagcaccatatagcaaaataaactcagaatcgattgaagactgaaatgtaaggccccaaattatcaaactattataagtaaacatagggaaaatgcttcaggacattagtctgcacaaagatttgtataggtaagacatcagaagcataggcaacaaacaaatgatagacaaatggtactacaactgagtgaagagaaaacctgtagaatggaagaaaacattttcaagcaattcatccaaaatatccaaatacacaagacaaatatccaaagtacacaaggaactcaaacaccctgacagtaaacaaaaataatctgagttcaaaactaggcaaaagatccgattagatatttctcctttttttaagagaaaaaaaagaaatacaaatagcgaacaaatacattttaaaatgttcagtatcactaatcatcagggaaatacaaatcaaacctacaatgtgatataatcttgctccatttcaataaatggctatcacagaaaacacacaaaaaagtgctggtgaggtttcagagaacagtaaactcttacatgctgttcgtgggaaggtaaattagtgcagctactatagaaaacaacatgaggctttctcaaaaaatgaacaatgcaactgccgagggatccagcaaccccactactgggtattcaggcaacagaaaagaaaacaatagatcacaaggatacttgtcctcatatgtttattgtagctctattcacaacagctaatgtataaaatcaacctacatgtccatcaacaaatgaatggacaaaaaaattgtggtacacataaacaatggaatactcaccatataaaaaaatgaaatcctcttacttgtagccacgtggctcagtctggaggatattatgttaagtgcagacacagaaagataaatactgcacattctcactcatgtgtgggagctaaagaaaaattgagggctgggcaacatggctgatgcccgtaatttcctagcactttgaaagaccgaggcaggagaatcacttgaagccaaaagttccagagcagcctgaacaacatagagagacatctctacaaagtaaaaaatcagacaggtgcaatggtgcacgcccataatcctagctgctcagcagggtgaggtcagaggatcacatgggcccaagaggttgaggctgcagtgagctatgatcaaatcactgtctctagcctggatgactctacagttgcccagagcccagactacactagcaagaccttgtctcttaacaacaaaaaagctcatagaagtaggagaggggagtctggttaatggatacagaattacagttagataagaggaatgagttctgatgttctgtggcattatagagtgaatatggttaactatgatttattgaatatttttaaaaagctagaagattttgaatgttcacaattcaaagaaatgaaaaatgattgaagtagtaagaagtagtaaatatgctagttagcttgatcattatgcactatataaatttatcaaaatgtcaccctatagcccataattatgtatatacatgtcaattaaaacaaaagagaatctatattcatcccattaaaagaatagaatatgggccatccttactgatggccttctcctaatgaatagaatgcagtaaaagggataccatgtagcttccctatctcagactgctttcccttcgaactcagcccccagattgtgagagagatcagtccacaaagacagcctgggagtgccagtgtcggtgttcatgctgcctgccccagccgaggttccagccagtggccagcatcaaccatcaaacacatgggtgagcaaagcttcagatgattcaatttctccaacttcctagggaacctgaggggagcagagacaagctgtcctggccaatctttttccaaaccacaggttcatgaacaaaataaatgtttttcttttaagccacaaaactctgggtaattgttagaaaaataagttttaaaaagagacaacaggaaacaacttaggtagcagaaaagagtctcctttaaagtaggatctaataaatgttgagattaatttgttgatgacaaacattattgagaaacagcagataaccaggagagagatgtaagctgctgaggaggaacttttcctaaaacccccttcaattatgaactctgataataaggcaagggtgtctccttaccatttcccctcaagttaggaaataagactgcaaagcaagaagacacatgatttgaaaaacaactggaaatacttggttacataaccaaaatcagacatttacctgatttcaattaatgaaaattctaaaagaagaagctctaagtatttattaatcaatctagtattcgattttcattttcctttttctcaatgaggaaataaggagaaaattatggaatgacttttactcttcacagaagtaaaataaacacagcatactttgagtgttaagacatcaaatgcattttctcctttaccttacttcacgtttgtttgcatggagaagttaagaccatcccatctctgtattataccgcaatgcttctctatagcacacaacttggctctgaaattttgaaattcaaaatactaatctactatttgtctctgataaattgcctgaatattacctgatttttaagtgctgcactcctaaaactttttcttggaatgagttaaactttttattccaagaatcctctactgagctagaaagcagagctgtgcatctctgtttcagtaataggaggtcaatacagaaaccgtggtttctgagaatgcaagatctgcaccaagaaaaggattagccacagtgttacacaagagaacaagatgccaggtggaaagaggatctgtgaactgaaagatgatgacttcacttgatttccactgaggaaagctggcagctcagacttaaactcctccttcctggatggtaaacatctatggatgattctatgaattataatgagttagtaaaacataaggcactaaatagtagactatttcagcagatactgcgaccaaaatttactgaaaatgaaactatagagggaggcactggataagagactaaaggttcaaatggagaaaaaaagaaatagtgtgtctcgtaagcctgacttgccatcatgtcttagagtaagtaaggtataagctggccacagactcctttgagacacaaaaggtgaagttaaagatattctactacatttaatttttattatgacataagacaactggtaatatgcaacatgattgaaaaaattttctcagtaaattcaatttggtcctcgtataagaatagacataaactaagaattgataacctaaaaataaacctgcacatttacagtcaattgattttatacaaggtaacaaaaaaacagaatgggaaaaaatagtcttttcaataaatgatattggaacaactgggtatccatgtgcaaaaaaaattacaaagttggactctcacctaataccatatttaaaaattaactcaaaacagttaactgtaacagctaaaactataaaactctcagaagaaaacattggcataaatctttgtgactgcatttggcagtgttttcttagctatgactccaaaggaaaaatggattcaatggacttcaaaattgaaaactgctgtgcctgagaagacagtatcaagaagtgaaaaggcaagacactgagtagaagaaagtatttgaaaagtgtatatctgataagggacttacatatataggatatataaagaacccttgccattcataaataacaagataacccaatttaacaaatgggcaaagaatttgaatagatatttctgcaaagaagatataaagacggataataagcacattaatagatgcttaatgtaattagtcattaggaaaatgtaaatcaaaaccaccttgtggtatcacttcacaccacaggaccaaatctttgttcaataaaaaagagaaaataagtgttaggaaaaatgtaaagaaattaaagcccttatccaatgctgccggggatgtaaagtggtgcagccactttggaaaacaaactgtcagctcctcaaaaggttaagcatgaagttactgtatgacccagaaattccagtcataagtatatactccagaaaaataaaaacatatgcaagcacaaaaactcatacataaatgtttacagcagcattattactatattttttttgagacggagtcttgttccgtagcccaggctggagtgcagtggcgtgatctcagctcactgcaacctctgcctcctgggtccgggttcaagcaattctcctgcctcagtctcctgagtagctgggattacaggcacacaccaccatgcccagctaatttttgtatttttagtagagacagggtttcaccatgttggccaggatgctctcgaactcctgacctcgtgatccacccgccttggcctcccaaagtgctgggattacaggtgtgagccaacacacctggcctacagcagcattattaataagagtcaaaaagtggaaagaacccaaaggtccatcacctcatgaatggttacataaaatgtttaatgtatccatacaatggaatatttctcagcaataagaagaaatttagtactgatactgatagaagcaggagacagcaaaatgcctaggcagatatggaagggtccccagagaatctccaggcccacaagtgtctacaccagataaaacgtccggtgcagataagggaacctgcacaggggcttgcctggacttgccagcagcagactggaggcccacatgcactggggggatggggtggagccaccaggaattcacgccttatgcagaggaggagcctggcctcttcagctcctgtgtgcctgtcctggtattcaattgtgaggtggaaatctgtttgcaggacccctctctttgctgagagcttccctttcacttaataaattctgtccttctcacccttcaatgggtccacatggctaatttttcctggtcatgagagaagaacccagatttggctgaactaaggagcgaaagccctgcatcaatacctgctacagcacagatgcagcatgaaaaattatgctaagtgaaataagccagtcccagtcgaccacttgctttttatttcagaggcttatatgcaaatctatacaaagaaggtgggtggttccctagggctgagggaggaagggaaaactagtgaagatagctaaatgatgtggggtttgtttttagggtgatgaaagtgttctaaaattgatgtaatgatgattacataactctgaaaatagtaaaattgaatgacttgtatattttaaatgagtgaattgcatggtgtgttaattacttctcaataaacctgttacaccccaaaatttatttggtactagtgatctggagacatgggctgcttcgtttcagatcactggccagggttcaagacataagagaatcaacagcacatcttttgtaaggaaaaatatatacatacatatattttaaagtatctttttattagtatcaagtctgtaaaattaaatgaaaaatctttcactgcttaaagcactgagagatttatattgaggagcaagaccttgtattcttttgccccagtttctatctaaagggtctgggaatcacacccttcaaacaatcaaatctcatcagatgggttttattaactcttataatgtggtttactttctaacctgattctggtacagcatcacagagagaagaagctgaaaaaaatcaaagttattttacccccaaatatatattttttgacatattttgaaatggctgttgcagggccaagagattgaaatggcagtacaaagctgccttctgtgggggaatctgcatctgtaagaagtcttcattaatgtagcccaatctctccccttctaggtcttcccagatctagggaagattaactaagatcctgatgcatttcaagtctgaaaagatatatttaccctctattttctctgagggctgccagctaggaggcttcatctacataataagaaccttaacctccataatgaccttatcttaattaaggccttcctttatacctatttccagttttagacaacagattttctttatcaattgtcacctaaagaatccttaaaacccacctatgacttgttagcccctcctttttgatgtcccacttttaggctgagccaatgtatgtcttcctcatattgatttatgattttccctacaactctgtctgctggaaatgtacaaaaccaaactgtaatgtgactgtctcatgaagcattctcaagagctcttgagattgggtaatccagggccacagtcaccatactggctcagaatcaacctccttagatgtattttggctgaatttgggtttatccattattaatatttctccaaattacataattttaatccccaaactgatttaaaattaccttatgtttaaatataaattattgtattatgaagacacatgtatttgtatgttcattgcagcactattcacaatagcaaagacatggaatcaacccagatgtccatcaatgatagacaggataaaaaaatgtggtgtatatacatcatggaatactatggagccatacaaatgaatgagatcatgctttttgcagggacatggatgaactcggagctgttatcctcagcacactaacgcaggaacaaaaaaccaaacactgcatcttcttacttataagtgggagctgaatgatgagaacacatggactcagggaagggaacaacaaacaccggggcttgttggggtcaggagggagagcatcaagattaatagctaatgcctacggggcttaatacctaggtgatgcattgatacgtgcagcaaaccatcatggcacacatttacctatgtaacaaacctgtacctcttacacatgtaatctagaccttaagataaaataataattttttaaaattaccttctgttttagcttcttaaacagaatatccattttcagttggtctgtatttaagtctccatggcaactgaagtcctcatttgcaaatgcatttaacatatttattgtcatttctaggcatttcttatatctgcagaaatgtaagaactagtaagtcaagtatttttaagagtaaatatttaataattgtttaaacagatattatgttatggcatatcaaagaaacaaatctataaactatgatcctctcagtttcaactgaacatagtttgaaagcattctatatgaaattataatcttatataaataatatgaagaacaattttatggtatatatagcaggtaaagtgataatagccatacagtttttggttttttttttgtttgtttttgttttttgagatggaacttcactcttgttgctcaggctgaagtgtgatggcgtgatcacggctcactgcaacttctgcttcctggactcaagtgattctcctgcctcagcctcccaagtaagctgggattacgggcatgtgccaccatgcctggctaattttgtatttttagtagagatggggttcaccatgttggtcaggctggttttgaactcctgagctgaaatgatctacctgccttggcctcccaaattgctgggattacaggcatgagccaccacacctggcctaaccatacagttttttataaatagactattcatatccattttggtatgctaagatgaaataacgtattagtaaatataaggcataaccgagagatgagtaaccaagatttttaaaaagtaaaacacatatatgtttgaaaaagacacaaaaatacattttgatatccgttgaccacagtctataagaagaaaaaaaagtacacccaaaaagcacaaggacattattcaatgtagaaaaagagaagaaaacatctttaatgtctgaattgaggagaaaaagaaaacgggcagttttagaaaaaaggaaaggtggagagagatatgtgatgatttaaagactttg
